United States Patent 7,745,391 (HUMAN THROMBOSPONDIN POLYPEPTIDE) - sequence listing, part 33

SEQ ID NO: 75330 - DNA, 2763 bp, Homo sapiens
  misc_feature (46)..(46): n is a, c, g, or t
  misc_feature (187)..(187): n is a, c, g, or t
agcgggggggagggggcggaccccgagccgcgaggggcgcggggcngggcgcggggtcccgggagagggcgctgggcgcttcgggcccagatcatctttcttgctgacaagtatcatctaggaatcactctacctcgctggcaattttgagaaaatagccagttattttgtgctgaactttcatctngttaagggtcattccttcagtattcaagtgagtaagaaaagacctattctgcttttgagcgggcctccccttcctcatcatcgagacaagcaccatcaagccttaccaccgagggttttactgcaatgatgagagcatcaagtacccactgaaaactggtgagacaataaatgacgctgtgctctgtgccgtggggatcgtcattgccatcctcgcgatcatcacgggggaattctaccggatctattacctgaagaagtcgcggtcgacgattcagaacccctacgtggcagcactctataagcaagtgggctgcttcctctttggctgtgccatcagccagtctttcacagacattgccaaagtgtccatagggcgcctgcgtcctcacttcttgagtgtctgcaaccctgatttcagccagatcaactgctctgaaggctacattcagaactacagatgcagaggtgatgacagcaaagtccaggaagccagagcccgcctgctccggcccctcctgcagttcaccttgatcatgatggccttctacacgggactgtctcgcgtatcagaccacaagcaccatcccagtgatgttctggcaggatttgctcaaggagccctggtggcctgctgcatagttttcttcgtgtctgacctcttcaagactaagacgacgctctccctgcctgcccctgctatccggaaggaaatcctttcacctgtggacattattgacaggaacaatcaccacaacatgatgtaggtgccacccacctcctgagctgtttttgtaaaatgactgctgacagcaagttcttgctgctctccaatctcatcagacagtagaatgtagggaaaaacttttgcccgactgatttttaaaaaggaaaaaaaaaatgttttactatgtggccttccaaaataggtagtgtttgcctatgtggaaacaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagaaatagcactgaatcaagaaaatagccattgcggagctgccctcttgagtctttctgtccatcccattctattctgtactgtgacttcagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccgggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagttttcctcatcctctatccgtaagtgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttttaaataaaagctcgtaacacaactaattaaggacttgcaaactgga

SEQ ID NO: 75331 - DNA, 2771 bp, Homo sapiens
tttccttaaaaattatattttcagggtaatacaattcaagtcacaataaagacctgaaagcctcaggtttgtaggtgaggaaaaatgcattttagctgtacagccctaacttttacttgacccaaggccagcaagaaaatgtttctttttatttatatatattttttctttggtgacaatttggtgtttctgaacgctaggggctcccggtttctctggtttgagagtaacttttccttttaggacttttttttttttttttgaagggggtgggggaaaatgtggccttaattatcctacgtcttaggcagcttaaggaaggggctgtgctttcggaatcccatccgagccaagtaaggaggtccctctctctctctccccccacgtcttctctttttaaaggacctcgtgaaataaaagtgcagaaaacaaacccaggcgatcacagcagcagccgccgcggcagcagcaccaacagcaggaggagcaggaggagccggaggaggaggaggaggaggaggcaaagttagagttggggctggcgctccggagttgctgggctcagcgcagctcccattcattaaggaaccagctgcggaggaaggtggccgagcgcccgcgctgcccactcgctcgctcgcgcactcagacgcgcgccacaacagcgcgccccaagctgcgcagctctgcaaaagtttctgctcgggatctggctctcttccccttgatcatgatggccttctacacgggactgtctcgcgtatcagaccacaagcaccatcccagtgatgttctggcaggatttgctcaaggagccctggtggcctgctgcatagttttcttcgtgtctgacctcttcaagactaagacgacgctctccctgcctgcccctgctatccggaaggaaatcctttcacctgtggacattattgacaggaacaatcaccacaacatgatgtaggtgccacccacctcctgagctgtttttgtaaaatgactgctgacagcaagttcttgctgctctccaatctcatcagacagtagaatgtagggaaaaacttttgcccgactgatttttaaaaaggaaaaaaaaaatgttttactatgtggccttccaaaataggtagtgtttgcctatgtggaaacaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagaaatagcactgaatcaagaaaatagccattgcggagctgccctcttgagtctttctgtccatcccattctattctgtactgtgacttcagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccgggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagttttcctcatcctctatccgtaagtgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttttaaataaaagctcgtaacacaactaattaaggacttgcaaactgga

SEQ ID NO: 75332 - DNA, 2958 bp, Homo sapiens
acagtgctgtcattagtagtgagcacattaccatctgcaggacaaagactcatcaattcagaaggctgttgggtgtagaaactttgatagtgttttagtcgctattttgaaatccagccaagtgtttcctattaaattacatgactgatagctgccgcttatggttacttagtaaaaactcctgttgctaaatggctcaaatggatgtctgtgtgtttattttgccatctaatacaaagcataaatttttcttactccgggagctgggcaaacccttgaatctttcatcataagcacattgaggcaggaactatgcctgtgccatcctcacacctttgcaagtggcactcaataaatgtttctcaagtattgttcagactcagtgaggtcacatccccaggaggaaaaaggacgctgggaatgagtgatacgagatttgtcattaaccgttcctccacgtttagttgccaactttctcagcaacgagaacctggtttcttgacccccgtcaaatggttgatatcactaagttttcaggaaaaagtagttaccactgcctgacttcagctcttgctgataggagttcatgttggctgatctttttcggttacaccctgggattcctttgtgaggaaagggaaagtagtgtgaattaatgactatcactaattatgacctgcttcctttgttgaggaacttatctttcattgctattcgtttgccttgagaaataaggaagtatgggttgcagatatgggcaatggactgagagtccttagaaggggattctactgaaccagtgttgtgcaacctgggacatgtcactgccttttcccgggtctcagtttccctatctgtacaataaaccttgatgatatgatctctgttgtccttccctattcaaagagttatgatttggggccccttttcctgaagtctgcgctcctctgaccttccttttccctctgtacccagacccccgatgtcagttactgacttcgatctctgatttgtgcttctaggttttcttcgtgtctgacctcttcaagactaagacgacgctctccctgcctgcccctgctatccggaaggaaatcctttcacctgtggacattattgacaggaacaatcaccacaacatgatgtaggtgccacccacctcctgagctgtttttgtaaaatgactgctgacagcaagttcttgctgctctccaatctcatcagacagtagaatgtagggaaaaacttttgcccgactgatttttaaaaaggaaaaaaaaaatgttttactatgtggccttccaaaataggtagtgtttgcctatgtggaaacaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagaaatagcactgaatcaagaaaatagccattgcggagctgccctcttgagtctttctgtccatcccattctattctgtactgtgacttcagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccgggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagttttcctcatcctctatccgtaagtgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttttaaataaaagctcgtaacacaactaattaaggacttgcaaactgga

SEQ ID NO: 75333 - DNA, 2214 bp, Homo sapiens
tattgaggtcgatctagagcatcccccatcttcctgtacaacagatgggagggtgaagggggcagaatgaaaatcgaaccaaccttttagctgttgcaaactcagaaggagccagagaagcaggcagtctcatgcatgagaggttacccttcaggatgacagagctgagggtctttgtaggagttgctcttgctgtgtaaagcactactgtcttggggttgagccatagggcagttctggcaggatttgctcaaggagccctggtggcctgctgcatagttttcttcgtgtctgacctcttcaagactaagacgacgctctccctgcctgcccctgctatccggaaggaaatcctttcacctgtggacattattgacaggaacaatcaccacaacatgatgtaggtgccacccacctcctgagctgtttttgtaaaatgactgctgacagcaagttcttgctgctctccaatctcatcagacagtagaatgtagggaaaaacttttgcccgactgatttttaaaaaggaaaaaaaaaatgttttactatgtggccttccaaaataggtagtgtttgcctatgtggaaacaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagaaatagcactgaatcaagaaaatagccattgcggagctgccctcttgagtctttctgtccatcccattctattctgtactgtgacttcagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccgggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagttttcctcatcctctatccgtaagtgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttttaaataaaagctcgtaacacaactaattaaggacttgcaaactgga

SEQ ID NO: 75334 - DNA, 1945 bp, Homo sapiens
agcgtttcttctcctgtttctccagcttcctagtaatctcagcagccgctctccctgcctgcccctgctatccggaaggaaatcctttcacctgtggacattattgacaggaacaatcaccacaacatgatgtaggtgccacccacctcctgagctgtttttgtaaaatgactgctgacagcaagttcttgctgctctccaatctcatcagacagtagaatgtagggaaaaacttttgcccgactgatttttaaaaaggaaaaaaaaaatgttttactatgtggccttccaaaataggtagtgtttgcctatgtggaaacaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagaaatagcactgaatcaagaaaatagccattgcggagctgccctcttgagtctttctgtccatcccattctattctgtactgtgacttcagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccgggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagttttcctcatcctctatccgtaagtgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttttaaataaaagctcgtaacacaactaattaaggacttgcaaactgga

SEQ ID NO: 75335 - DNA, 1713 bp, Homo sapiens
agctcggtacccctgtatcccggggagaaaaaaaaaatgttttactatgtggccttccaaaataggtagtgtttgcctatgtggaaacaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagaaatagcactgaatcaagaaaatagccattgcggagctgccctcttgagtctttctgtccatcccattctattctgtactgtgacttcagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccgggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagttttcctcatcctctatccgtaagtgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttttaaataaaagctcgtaacacaactaattaaggacttgcaaactgga

SEQ ID NO: 75336 - DNA, 1704 bp, Homo sapiens
gcagaagatctacctcatcgtgcagaatcaccttactatgtggccttccaaaataggtagtgtttgcctatgtggaaacaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagaaatagcactgaatcaagaaaatagccattgcggagctgccctcttgagtctttctgtccatcccattctattctgtactgtgacttcagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccgggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagttttcctcatcctctatccgtaagtgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttttaaataaaagctcgtaacacaactaattaaggacttgcaaactgga

SEQ ID NO: 75337 - DNA, 1650 bp, Homo sapiens
cgagtgtcgaccggagacacttacgaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagaaatagcactgaatcaagaaaatagccattgcggagctgccctcttgagtctttctgtccatcccattctattctgtactgtgacttcagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccgggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagttttcctcatcctctatccgtaagtgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttttaaataaaagctcgtaacacaactaattaaggacttgcaaactgga

SEQ ID NO: 75338 - DNA, 1655 bp, Homo sapiens
gactcgaggtagtacccggagacacttacgaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagaaatagcactgaatcaagaaaatagccattgcggagctgccctcttgagtctttctgtccatcccattctattctgtactgtgacttcagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccgggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagttttcctcatcctctatccgtaagtgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttttaaataaaagctcgtaacacaactaattaaggacttgcaaactgga

SEQ ID NO: 75339 - DNA, 1654 bp, Homo sapiens
tatacgactcgagttagtaccaacttacgaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagaaatagcactgaatcaagaaaatagccattgcggagctgccctcttgagtctttctgtccatcccattctattctgtactgtgacttcagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccgggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagttttcctcatcctctatccgtaagtgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttttaaataaaagctcgtaacacaactaattaaggacttgcaaactgga

SEQ ID NO: 75340 - DNA, 1444 bp, Homo sapiens
tctggctcctctgatttgcaacagctaaaaggttggttcgattttcattctgccctcttgagtctttctgtccatcccattctattctgtactgtgacttcagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccgggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagttttcctcatcctctatccgtaagtgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttttaaataaaagctcgtaacacaactaattaaggacttgcaaactgga

SEQ ID NO: 75341 - DNA, 1332 bp, Homo sapiens
  misc_feature (1228)..(1228): n is a, c, g, or t
  misc_feature (1255)..(1255): n is a, c, g, or t
  misc_feature (1273)..(1273): n is a, c, g, or t
tttccttaaaaattatattttcagggtaatacaattcaagtcacaataaagacctgaaagcctcaggtttgtaggtgaggaaaaatgcattttagctgtacagccctaacttttacttgacccaaggccagcaagaaaatgtttctttttatttatatatattttttctttggtgacaatttggtgtttctgaacgctaggggctcccggtttctctggtttgagagtaacttttccttttaggacttttttttttttttttgaagggggtgggggaaaatgtggccttaattatcctacgtcttaggcagcttaaggaaggggctgtgctttcggaatcccatccgagccaagtaaggaggtccctctctctctctccccccacgtcttctctttttaaaggacctcgtgaaataaaagtgcagaaaacaaacccaggcgatcacagcagcagccgccgcggcagcagcaccaacagcaggaggagcaggaggagccggaggaggaggaggaggaggaggcaaagttagagttggggctggcgctccggagttgctgggctcagcgcagctcccattcattaaggaaccagctgcggaggaaggtggccgagcgcccgcgctgcccactcgctcgctcgcgcactcagacgcgcgccacaacagcgcgccccaagctgcgcagctctgcaaaagtttctgctcgggatctggctctcttccccttggactttagaacgatttagggttgacagaggaaagcagaggcgcgcaggaggagcagaaaacaccaccttctgcagttggaggcaggcagccccggctgcactctagccgccgcgcccggagccggggccgacccgccactatccgcagcagcctcggccaggaggcgacccgggcgcctgggtgtgtggctgctgttgcgggacgtcttcgcggggcgggaggctcgcgccgcagccagcgccatgcaaaactacaagtacgacaaagcgatcgtcccggagagcaagaacggcggcagcccggcgctcaacaacaacccgaggaggagcggcagcaagcgggtgctgctcatctgcctcgacctcttctgcctcttcatggcgggcctccccttcctcatcatcgagacaagcaccatggccaatgtcagcacaaggctgaggcccttactagagtcaggtcattgttggtgatctttacccaaatctcaaaatctcganatttgctcaaaccctgtgacatcaaanctaccctttaccttgtcngttgattccttcattttagtaatttccttttctatagttaaagttctttgtctctcccc

SEQ ID NO: 75342 - DNA, 360 bp, Homo sapiens
ggtaggtacattcattcattcattcttttgtttattcatgaattcataggtgcctgctatgttccaggcatgggtccaaagcactaccaaggatgcaaaaatgaacagggcctagtgcctgctctcaaggttacagtctagggagggaagacagacagacaagtgtgtatcagggatgtgaatacggccctttcatggccctctcttgctcttgcaggaagtccttcttctctggccatgcctccttctccatgtacactatgctgtatttggtggtaagtacccaccctttgatttgagcagtgctcagttccagcttcgatcccttctgatatgatagccctcaaaatagtttagggg

SEQ ID NO: 75343 - DNA, 3716 bp, Homo sapiens
tttccttaaaaattatattttcagggtaatacaattcaagtcacaataaagacctgaaagcctcaggtttgtaggtgaggaaaaatgcattttagctgtacagccctaacttttacttgacccaaggccagcaagaaaatgtttctttttatttatatatattttttctttggtgacaatttggtgtttctgaacgctaggggctcccggtttctctggtttgagagtaacttttccttttaggacttttttttttttttttgaagggggtgggggaaaatgtggccttaattatcctacgtcttaggcagcttaaggaaggggctgtgctttcggaatcccatccgagccaagtaaggaggtccctctctctctctccccccacgtcttctctttttaaaggacctcgtgaaataaaagtgcagaaaacaaacccaggcgatcacagcagcagccgccgcggcagcagcaccaacagcaggaggagcaggaggagccggaggaggaggaggaggaggaggcaaagttagagttggggctggcgctccggagttgctgggctcagcgcagctcccattcattaaggaaccagctgcggaggaaggtggccgagcgcccgcgctgcccactcgctcgctcgcgcactcagacgcgcgccacaacagcgcgccccaagctgcgcagctctgcaaaagtttctgctcgggatctggctctcttccccttggactttagaacgatttagggttgacagaggaaagcagaggcgcgcaggaggagcagaaaacaccaccttctgcagttggaggcaggcagccccggctgcactctagccgccgcgcccggagccggggccgacccgccactatccgcagcagcctcggccaggaggcgacccgggcgcctgggtgtgtggctgctgttgcgggacgtcttcgcggggcgggaggctcgcgccgcagccagcgccatgcaaaactacaagtacgacaaagcgatcgtcccggagagcaagaacggcggcagcccggcgctcaacaacaacccgaggaggagcggcagcaagcgggtgctgctcatctgcctcgacctcttctgcctcttcatggcgggcctccccttcctcatcatcgagacaagcaccatcaagccttaccaccgagggttttactgcaatgatgagagcatcaagtacccactgaaaactggtgagacaataaatgacgctgtgctctgtgccgtggggatcgtcattgccatcctcgcgatcatcacgggggaattctaccggatctattacctgaagaagtcgcggtcgacgattcagaacccctacgtggcagcactctataagcaagtgggctgcttcctctttggctgtgccatcagccagtctttcacagacattgccaaagtgtccatagggcgcctgcgtcctcacttcttgagtgtctgcaaccctgatttcagccagatcaactgctctgaaggctacattcagaactacagatgcagaggtgatgacagcaaagtccaggaagccaggaagtccttcttctctggccatgcctccttctccatgtacactatgctgtatttggtgctatacctgcaggcccgcttcacttggcgaggagcccgcctgctccggcccctcctgcagttcaccttgatcatgatggccttctacacgggactgtctcgcgtatcagaccacaagcaccatcccagtgatgttctggcaggatttgctcaaggagccctggtggcctgctgcatagttttcttcgtgtctgacctcttcaagactaagacgacgctctccctgcctgcccctgctatccggaaggaaatcctttcacctgtggacattattgacaggaacaatcaccacaacatgatgtaggtgccacccacctcctgagctgtttttgtaaaatgactgctgacagcaagttcttgctgctctccaatctcatcagacagtagaatgtagggaaaaacttttgcccgactgatttttaaaaaggaaaaaaaaaatgttttactatgtggccttccaaaataggtagtgtttgcctatgtggaaacaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagaaatagcactgaatcaagaaaatagccattgcggagctgccctcttgagtctttctgtccatcccattctattctgtactgtgacttcagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccgggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagttttcctcatcctctatccgtaagtgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttttaaataaaagctcgtaacacaactaattaaggacttgcaaactgga

SEQ ID NO: 75344 - DNA, 3662 bp, Homo sapiens
tttccttaaaaattatattttcagggtaatacaattcaagtcacaataaagacctgaaagcctcaggtttgtaggtgaggaaaaatgcattttagctgtacagccctaacttttacttgacccaaggccagcaagaaaatgtttctttttatttatatatattttttctttggtgacaatttggtgtttctgaacgctaggggctcccggtttctctggtttgagagtaacttttccttttaggacttttttttttttttttgaagggggtgggggaaaatgtggccttaattatcctacgtcttaggcagcttaaggaaggggctgtgctttcggaatcccatccgagccaagtaaggaggtccctctctctctctccccccacgtcttctctttttaaaggacctcgtgaaataaaagtgcagaaaacaaacccaggcgatcacagcagcagccgccgcggcagcagcaccaacagcaggaggagcaggaggagccggaggaggaggaggaggaggaggcaaagttagagttggggctggcgctccggagttgctgggctcagcgcagctcccattcattaaggaaccagctgcggaggaaggtggccgagcgcccgcgctgcccactcgctcgctcgcgcactcagacgcgcgccacaacagcgcgccccaagctgcgcagctctgcaaaagtttctgctcgggatctggctctcttccccttggactttagaacgatttagggttgacagaggaaagcagaggcgcgcaggaggagcagaaaacaccaccttctgcagttggaggcaggcagccccggctgcactctagccgccgcgcccggagccggggccgacccgccactatccgcagcagcctcggccaggaggcgacccgggcgcctgggtgtgtggctgctgttgcgggacgtcttcgcggggcgggaggctcgcgccgcagccagcgccatgcaaaactacaagtacgacaaagcgatcgtcccggagagcaagaacggcggcagcccggcgctcaacaacaacccgaggaggagcggcagcaagcgggtgctgctcatctgcctcgacctcttctgcctcttcatggcgggcctccccttcctcatcatcgagacaagcaccatcaagccttaccaccgagggttttactgcaatgatgagagcatcaagtacccactgaaaactggtgagacaataaatgacgctgtgctctgtgccgtggggatcgtcattgccatcctcgcgatcatcacgggggaattctaccggatctattacctgaagaagtcgcggtcgacgattcagaacccctacgtggcagcactctataagcaagtgggctgcttcctctttggctgtgccatcagccagtctttcacagacattgccaaagtgtccatagggcgcctgcgtcctcacttcttgagtgtctgcaaccctgatttcagccagatcaactgctctgaaggctacattcagaactacagatgcagaggtgatgacagcaaagtccaggaagccaggaagtccttcttctctggccatgcctccttctccatgtacactatgctgtatttggtgctatacctgcaggcccgcttcacttggcgaggagcccgcctgctccggcccctcctgcagttcaccttgatcatgatggccttctacacgggactgtctcgcgtatcagaccacaagcaccatcccagtgatgttctggcaggatttgctcaaggagccctggtggcctgctgcatagttttcttcgtgtctgacctcttcaagactaagacgacgctctccctgcctgcccctgctatccggaaggaaatcctttcacctgtggacattattgacaggaacaatcaccacaacatgatgtaggtgccacccacctcctgagctgtttttgtaaaatgactgctgacagcaagttcttgctgctctccaatctcatcagacagtagaatgtagggaaaaacttttgcccgactgatttttaaaaaggaaaaaaaaaatgttttactatgtggccttccaaaataggtagtgtttgcctatgtggaaacaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagaaatagcactgaatcaagaaaatagccattgcggagctgccctcttgagtctttctgtccatcccattctattctgtactgtgacttcagttcaggaagttttgttttgtgttttaaatccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccgggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagttttcctcatcctctatccgtaagtgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttttaaataaaagctcgtaacacaactaattaaggacttgcaaactgga

SEQ ID NO: 75345 - DNA, 3662 bp, Homo sapiens
tttccttaaaaattatattttcagggtaatacaattcaagtcacaataaagacctgaaagcctcaggtttgtaggtgaggaaaaatgcattttagctgtacagccctaacttttacttgacccaaggccagcaagaaaatgtttctttttatttatatatattttttctttggtgacaatttggtgtttctgaacgctaggggctcccggtttctctggtttgagagtaacttttccttttaggacttttttttttttttttgaagggggtgggggaaaatgtggccttaattatcctacgtcttaggcagcttaaggaaggggctgtgctttcggaatcccatccgagccaagtaaggaggtccctctctctctctccccccacgtcttctctttttaaaggacctcgtgaaataaaagtgcagaaaacaaacccaggcgatcacagcagcagccgccgcggcagcagcaccaacagcaggaggagcaggaggagccggaggaggaggaggaggaggaggcaaagttagagttggggctggcgctccggagttgctgggctcagcgcagctcccattcattaaggaaccagctgcggaggaaggtggccgagcgcccgcgctgcccactcgctcgctcgcgcactcagacgcgcgccacaacagcgcgccccaagctgcgcagctctgcaaaagtttctgctcgggatctggctctcttccccttggactttagaacgatttagggttgacagaggaaagcagaggcgcgcaggaggagcagaaaacaccaccttctgcagttggaggcaggcagccccggctgcactctagccgccgcgcccggagccggggccgacccgccactatccgcagcagcctcggccaggaggcgacccgggcgcctgggtgtgtggctgctgttgcgggacgtcttcgcggggcgggaggctcgcgccgcagccagcgccatgcaaaactacaagtacgacaaagcgatcgtcccggagagcaagaacggcggcagcccggcgctcaacaacaacccgaggaggagcggcagcaagcgggtgctgctcatctgcctcgacctcttctgcctcttcatggcgggcctccccttcctcatcatcgagacaagcaccatcaagccttaccaccgagggttttactgcaatgatgagagcatcaagtacccactggccatcctcgcgatcatcacgggggaattctaccggatctattacctgaagaagtcgcggtcgacgattcagaacccctacgtggcagcactctataagcaagtgggctgcttcctctttggctgtgccatcagccagtctttcacagacattgccaaagtgtccatagggcgcctgcgtcctcacttcttgagtgtctgcaaccctgatttcagccagatcaactgctctgaaggctacattcagaactacagatgcagaggtgatgacagcaaagtccaggaagccaggaagtccttcttctctggccatgcctccttctccatgtacactatgctgtatttggtgctatacctgcaggcccgcttcacttggcgaggagcccgcctgctccggcccctcctgcagttcaccttgatcatgatggccttctacacgggactgtctcgcgtatcagaccacaagcaccatcccagtgatgttctggcaggatttgctcaaggagccctggtggcctgctgcatagttttcttcgtgtctgacctcttcaagactaagacgacgctctccctgcctgcccctgctatccggaaggaaatcctttcacctgtggacattattgacaggaacaatcaccacaacatgatgtaggtgccacccacctcctgagctgtttttgtaaaatgactgctgacagcaagttcttgctgctctccaatctcatcagacagtagaatgtagggaaaaacttttgcccgactgatttttaaaaaggaaaaaaaaaatgttttactatgtggccttccaaaataggtagtgtttgcctatgtggaaacaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagaaatagcactgaatcaagaaaatagccattgcggagctgccctcttgagtctttctgtccatcccattctattctgtactgtgacttcagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccgggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagttttcctcatcctctatccgtaagtgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttttaaataaaagctcgtaacacaactaattaaggacttgcaaactgga

SEQ ID NO: 75346 - DNA, 3626 bp, Homo sapiens
tttccttaaaaattatattttcagggtaatacaattcaagtcacaataaagacctgaaagcctcaggtttgtaggtgaggaaaaatgcattttagctgtacagccctaacttttacttgacccaaggccagcaagaaaatgtttctttttatttatatatattttttctttggtgacaatttggtgtttctgaacgctaggggctcccggtttctctggtttgagagtaacttttccttttaggacttttttttttttttttgaagggggtgggggaaaatgtggccttaattatcctacgtcttaggcagcttaaggaaggggctgtgctttcggaatcccatccgagccaagtaaggaggtccctctctctctctccccccacgtcttctctttttaaaggacctcgtgaaataaaagtgcagaaaacaaacccaggcgatcacagcagcagccgccgcggcagcagcaccaacagcaggaggagcaggaggagccggaggaggaggaggaggaggaggcaaagttagagttggggctggcgctccggagttgctgggctcagcgcagctcccattcattaaggaaccagctgcggaggaaggtggccgagcgcccgcgctgcccactcgctcgctcgcgcactcagacgcgcgccacaacagcgcgccccaagctgcgcagctctgcaaaagtttctgctcgggatctggctctcttccccttggactttagaacgatttagggttgacagaggaaagcagaggcgcgcaggaggagcagaaaacaccaccttctgcagttggaggcaggcagccccggctgcactctagccgccgcgcccggagccggggccgacccgccactatccgcagcagcctcggccaggaggcgacccgggcgcctgggtgtgtggctgctgttgcgggacgtcttcgcggggcgggaggctcgcgccgcagccagcgccatgcaaaactacaagtacgacaaagcgatcgtcccggagagcaagaacggcggcagcccggcgctcaacaacaacccgaggaggagcggcagcaagcgggtgctgctcatctgcctcgacctcttctgcctcttcatggcgggcctccccttcctcatcatcgagacaagcaccatcaagccttaccaccgagggttttactgcaatgatgagagcatcaagtacccactgaaaactggtgagacaataaatgacgctgtgctctgtgccgtggggatcgtcattgccatcctcgcgatcatcacgggggaattctaccggatctattacctgaagaagtcgcggtcgacgattcagaacccctacgtggcagcactctataagcaagtgggctgcttcctctttggctgtgccatcagccagtctttcacagacattgccaaagtgtccatagggcgcctgcgtcctcacttcttgagtgtctgcaaccctgatttcagccagatcaactgctctgaaggctacattcagaactacagatgcagaggtgatgacagcaaagtccaggaagccagagcccgcctgctccggcccctcctgcagttcaccttgatcatgatggccttctacacgggactgtctcgcgtatcagaccacaagcaccatcccagtgatgttctggcaggatttgctcaaggagccctggtggcctgctgcatagttttcttcgtgtctgacctcttcaagactaagacgacgctctccctgcctgcccctgctatccggaaggaaatcctttcacctgtggacattattgacaggaacaatcaccacaacatgatgtaggtgccacccacctcctgagctgtttttgtaaaatgactgctgacagcaagttcttgctgctctccaatctcatcagacagtagaatgtagggaaaaacttttgcccgactgatttttaaaaaggaaaaaaaaaatgttttactatgtggccttccaaaataggtagtgtttgcctatgtggaaacaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagaaatagcactgaatcaagaaaatagccattgcggagctgccctcttgagtctttctgtccatcccattctattctgtactgtgacttcagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccgggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagttttcctcatcctctatccgtaagtgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttttaaataaaagctcgtaacacaactaattaaggacttgcaaactgga

SEQ ID NO: 75347 - DNA, 2231 bp, Homo sapiens
agaccagaggaacagcctcaagttcagtcggacctttctaaggaggttttgttggaattccacaagaccctagttctgaaggtaggacaaagaaggagaagagaactgcactgacagactatacctgcaggcccgcttcacttggcgaggagcccgcctgctccggcccctcctgcagttcaccttgatcatgatggccttctacacgggactgtctcgcgtatcagaccacaagcaccatcccagtgatgttctggcaggatttgctcaaggagccctggtggcctgctgcatagttttcttcgtgtctgacctcttcaagactaagacgacgctctccctgcctgcccctgctatccggaaggaaatcctttcacctgtggacattattgacaggaacaatcaccacaacatgatgtaggtgccacccacctcctgagctgtttttgtaaaatgactgctgacagcaagttcttgctgctctccaatctcatcagacagtagaatgtagggaaaaacttttgcccgactgatttttaaaaaggaaaaaaaaaatgttttactatgtggccttccaaaataggtagtgtttgcctatgtggaaacaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagaaatagcactgaatcaagaaaatagccattgcggagctgccctcttgagtctttctgtccatcccattctattctgtactgtgacttcagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccgggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagttttcctcatcctctatccgtaagtgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttttaaataaaagctcgtaacacaactaattaaggacttgcaaactgga

SEQ ID NO: 75348 - DNA, 2872 bp, Homo sapiens
tttccttaaaaattatattttcagggtaatacaattcaagtcacaataaagacctgaaagcctcaggtttgtaggtgaggaaaaatgcattttagctgtacagccctaacttttacttgacccaaggccagcaagaaaatgtttctttttatttatatatattttttctttggtgacaatttggtgtttctgaacgctaggggctcccggtttctctggtttgagagtaacttttccttttaggacttttttttttttttttgaagggggtgggggaaaatgtggccttaattatcctacgtcttaggcagcttaaggaaggggctgtgctttcggaatcccatccgagccaagtaaggaggtccctctctctctctccccccacgtcttctctttttaaaggacctcgtgaaataaaagtgcagaaaacaaacccaggcgatcacagcagcagccgccgcggcagcagcaccaacagcaggaggagcaggaggagccggaggaggaggaggaggaggaggcaaagttagagttggggctggcgctccggagttgctgggctcagcgcagctcccattcattaaggaaccagctgcggaggaaggtggccgagcgcccgcgctgcccactcgctcgctcgcgcactcagacgcgcgccacaacagcgcgccccaagctgcgcagctctgcaaaagtttctgctcgggatctggctctcttccccttggactttagaacgatttagggttgacagaggaaagcagaggcgcgcaggaggagcagaaaacaccaccttctgcagttggaggcaggcagccccggctgcactctagccgccgcgcccggagccggggccgacccgccactatccgcagcagcctcggccaggaggcgacccgggcgcctgggtgtgtggctgctgttgcgggacgtcttcgcggggcgggaggctcgcgccgcagccagcgccatgcaaaactacaagtacgacaaagcgatcgtcccggagagcaagaacggcggcagcccggcgctcaacaacaacccgaggaggagcggcagcaagcgggtgctgctcatctgcctcgacctcttctgcctcttcatggcgggcctccccttcctcatcatcgagacaagcaccatcaagccttaccaccgagggttttactgcaatgatgagagcatcaagtacccactgaaaactggtgagacaataaatgacgctgtgctctgtgccgtggggatcgtcattgccatcctcgcgatcatcacgggggaattctaccggatctattacctgaagaagtcgcggtcgacgattcagaacccctacgtggcagcactctataagcaagtgggctgcttcctctttggctgtgccatcagccagtctttcacagacattgccaaaaattcacattgcagcacatgatgccagaaatagcactgaatcaagaaaatagccattgcggagctgccctcttgagtctttctgtccatcccattctattctgtactgtgacttcagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccgggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagttttcctcatcctctatccgtaagtgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttttaaataaaagctcgtaacacaactaattaaggacttgcaaactgga

SEQ ID NO: 75349 - DNA, 147 bp, Homo sapiens
aagtttaacaaggcagggaggcacgtagaatatttgtgaacaatagtacagttagccatattaattgtaatgactttatctggacaagcatagcttgttttactgtactttgccttgctgtccttcacagatactgcattttttttt

SEQ ID NO: 75350 - DNA, 577 bp, Homo sapiens
gcagttttcaaccctttgttcagactcagacgggtttcaactcaagcgggtaatctaccccagcagcaggggtgcaaagtccaaaacagctttgtggtgcctggggagtgactaggcagcctgctcacaggggctggagtcatctaaagctagtgatgagctggaatagctttgaaccggttcatccgaactgattgttaaactttcagaacttttgagagtcagttgagaaacatagctattactaaaaaattaaataagattagataaattatagctaaaagcaaaggcaacatatagtcaaagctcatcactttctacttattttactacattttaccattatctgtgcccatgaggtaatgtatgcctgttatgtctgtatggtagaaatactgtatacaggtatactactacacacaccttcccaagtgacagtatttttgtagtttgagatcagctatagtggtggtatttataccatggaaagcaacaaagccatggaaagcaacaaagccatgcaaatcagactcctcctaacccctaagacagttgttaaacatttgccagcatacca

SEQ ID NO: 75351 - DNA, 363 bp, Homo sapiens
actgggaaagaatattgtacaataacgtctacaaaattattacttttcagcctggaatcacgtttgtgatcttctttggaacttatcaatgcaaagcttcataataacggaatgttttcctattgttgcttggattgccttaatctcttaccataactttttcatcccccaacatttaaagtttttgtatactaaaaagtaatagctatttatttaatttaaaatattttaccagctttgaagttacagtgtgtggatatctaagatatcaatctaagctctaatctatacaggcagaagtgctggtgcttgtgaaagcaggacctggaaatagactgggttcaagtcctaagtcaaccccca

SEQ ID NO: 75352 - DNA, 2677 bp, Homo sapiens
gcaattctcctgcctcagcctcctgagtagctgggatcacaggcgtacaccaccacacccagctaagtttttgtacttttagtagagacggggtttcaccatgttggccaggctggtcacggactcctgacctcagatgatctgcccgcctgagcctccgaaagtgctgggattacaggcgtgagccactgcgcccggcatggagctgctattgatgggtgagctccacagcttttgcagaagcagaggatatgacttgagagcagtgctgtcacctctcagcatgtccccaagcccaactggggcctcctggagatgcctcagtcggcactggccccaagggaatcgtggggaacagttgcacaatttgcaagtttctgagtgcagcttttcccatccttgggatcagcagataagttgtaaacacagggaggtactgcttattggatatacttttcataagtaggacagaattcttttgggactctagagttgggaactaccacttactagcggcgtggctgaggcagtcttcctcctctgtggctcaggcccttcatctgtgaaatggggtcacagcatctgcctctcagggtcactgtgaggtgtcgatgtgagcaaggcctgaggcttggcaagaagtcaatgtctgcaactcagcagggagcaatggcaggggcagtcaggggtcggctcggataggggtgggtgggctcctgaggttggaagggtaggaattacagagctcttgttactattgttgttactgtttttaaagatacgatatttcagataattcaggagcacgtaaggatgaaacttaggataacctaaaatcacacaacctagagagaagcgcatttttgtcttcccccattttctaggcaaaaatgaaagtactttgtcctcttgaaaaacaattctctaatgaatatcctatgttacatagaggcctgtgtaatgcatttgtgtggccacatggtgtcaatttcatgaatatacaataatattattaattccctgctgaggacattaactggtttccaaggctgcttgttgtttttgctactacaaataatgcattgatgataaatacttttacatacatggttgtatgtttatctgaactattttcaccaatatattcacctagtgtgtatggaagtgtccatttttgtcatacccctggtaaccctgtgatattatttttaaacattttgctaatggatctctgttcttgtttgaatgtatttaatttccagcagaatgagccccattccttattttgattggccatttatcatgtacatatggtgaaatgcctattcgtgacttagccaatgttgtttctttttcttactgattactacagtacatttttatatgaaagcagcctttgtccccttctcttgtttttcagccctgtgttagaaacaactaagctcacatattcacaaaccaacttttccagttcatctagggcagtggtgctcaacaggggcaattttgccccccagggaacatttggcaatgtctggagacatttttgtcacaggtggggaggagggcagtactgtgggcactcgtggagggaggccagggatggtgcccaacagcccccacgacacagaattacctggctggaagtgggagccgggtggagggagggaagccctgctctggggtcatatctccccgttagattgaacagaggagctcctggtagctgagtgctgacttcattatttttccccgcccttgctttctaccctgctgaagtgctgctgattaaattaccctgaaatccccacaggacacattacttcctcacaggtctctactagcccagcgctgcctcaaggaatggcattattcctttgccactgtgtcctcaccgcactcttggactccgccgaatgcagacaccctcctgtctgcagaaggatctggaggggtagaacgcttcccctctacgacggattgactccccagcacctcaccagcagttctttgaatggagtggctttggaggtgggagttgaggaagaaatgtgagcctgtcattacaggttctgtttagaaaactagtcattctactaaaaaggtatcacataagtaagtaggagcaataaaaacaaagaagatagtgggactccgagaagctttccccgcctctggcctgttagtctatcgttcgttgggcaaggctcttccagtgtgtgaccttttgcgtgttatcacagcatgagtgcagttttgtgtacaggcatccctatattcagcatgtatctgcaacatgccttacctcgtctgctgtcacagagcaaagtggagcaagtggtcgccgttggtctgcacctgagctgggagccgagtggtgacgtgcatatgggccgactgcgtctccacagaacctactcagtgatcttcctgtgtacgactcagtccctgatgttggagttgaactgtaggactgtctgtaaaatgaaagtgcagactttaatgtagtaaagagaatgacttgccagttacaaccaatgagcaaagcagttaattattcaaatattttaccaagagtccaggtttattttttctcaggactacacattctgtgagaccagagggaccaagacatatcactaccagaaatgtgttttcatcagcactgccagaggtt

SEQ ID NO: 75353 - DNA, 1626 bp, Homo sapiens
actaaattcgcggccgcgtcgaaataatgcattgatgataaatacttttacatacatggttgtatgtttatctgaactattttcaccaatatattcacctagtgtgtatggaagtgtccatttttgtcatacccctggtaaccctgtgatattatttttaaacattttgctaatggatctctgttcttgtttgaatgtatttaatttccagcagaatgagccccattccttattttgattggccatttatcatgtacatatggtgaaatgcctattcgtgacttagccaatgttgtttctttttcttactgattactacagtacatttttatatgaaagcagcctttgtccccttctcttgtttttcagccctgtgttagaaacaactaagctcacatattcacaaaccaacttttccagttcatctagggcagtggtgctcaacaggggcaattttgccccccagggaacatttggcaatgtctggagacatttttgtcacaggtggggaggagggcagtactgtgggcactcgtggagggaggccagggatggtgcccaacagcccccacgacacagaattacctggctggaagtgggagccgggtggagggagggaagccctgctctggggtcatatctccccgttagattgaacagaggagctcctggtagctgagtgctgacttcattatttttccccgcccttgctttctaccctgctgaagtgctgctgattaaattaccctgaaatccccacaggacacattacttcctcacaggtctctactagcccagcgctgcctcaaggaatggcattattcctttgccactgtgtcctcaccgcactcttggactccgccgaatgcagacaccctcctgtctgcagaaggatctggaggggtagaacgcttcccctctacgacggattgactccccagcacctcaccagcagttctttgaatggagtggctttggaggtgggagttgaggaagaaatgtgagcctgtcattacaggttctgtttagaaaactagtcattctactaaaaaggtatcacataagtaagtaggagcaataaaaacaaagaagatagtgggactccgagaagctttccccgcctctggcctgttagtctatcgttcgttgggcaaggctcttccagtgtgtgaccttttgcgtgttatcacagcatgagtgcagttttgtgtacaggcatccctatattcagcatgtatctgcaacatgccttacctcgtctgctgtcacagagcaaagtggagcaagtggtcgccgttggtctgcacctgagctgggagccgagtggtgacgtgcatatgggccgactgcgtctccacagaacctactcagtgatcttcctgtgtacgactcagtccctgatgttggagttgaactgtaggactgtctgtaaaatgaaagtgcagactttaatgtagtaaagagaatgacttgccagttacaaccaatgagcaaagcagttaattattcaaatattttaccaagagtccaggtttattttttctcaggactacacattctgtgagaccagagggaccaagacatatcactaccagaaatgtgttttcatcagcactgccagaggtt

SEQ ID NO: 75354 - DNA, 812 bp, Homo sapiens
ggccatcagggcagacctgctatggacctgaaagattccgccccaggtcagccctccactccccacctccccacaatttgagaatgagagggaacaggagtcaggagccggagtgttggccccagtagactccaatcaatgttggacatgattctgattggctaaacactgtgtagatgtttttaaacaaagtccatttaaggttactgcactaatcaaggagtactggattataaaaacatctataaatctgagtttgagtattttttaaaacaaaattgttaaaccagatgtgttgcttttttttcttgtcatctctaagtatagtcctcagttaaatatactaataagcaaaatgcaccaaaacttttggctaatagttgtgctttaacttaatatttgttatttcatagagactgctatgaaaagctttttattctgaatcactgtacagttattctttgatcctgtcagtcaaatctcatttttagggtcttgactaggttttatgaaagcccagtaaggcagtttgcccataaggcagtcatcagtcctgtttcctgatgccacatgacagaaggggtccatgtagaatttcgtttcttcctggaagtcccaaggaaacctgcaagtattatgataactaggaaggaaacctgcaagtattatgatgaactgggaaggaaacctgtaagtattatgatgaaccacaaagtagccctcatcagacactgaatcagccagtgccttgctcttggacttcccagcccccagaactgtgagaaataaatttctgttgtttataagctaaa

SEQ ID NO: 75355 - DNA, 1529 bp, Homo sapiens
  misc_feature (325)..(326): n is a, c, g, or t
  misc_feature (329)..(329): n is a, c, g, or t
  misc_feature (352)..(352): n is a, c, g, or t
tcgtgcgcgtagcatgtggcacttgggcgtctttgatactggttatgtgttacgtgtggatctgcctgggtggattaacccttgctgtggatagaagcagctttaagacctgtgacagaggccgttctttctgcaagcgacagagaatcgtacggcagggctctctccataccgagaccttgttggattctctacatgctttggacctgattaccctcgacgggtccatctgatccatgaggtcaccaaggtgttgctggtgctagagcttcaggggcttcaaaagaacatgactcggttcaggattgatgagctggagcctcgnngancccgataccgtgtaccagatgtnttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctcatctctgatgttttccggcaatatgctagtctcacaggaaccaggcgttgcccccactcttctccctcggtaccaccagagccgttggaactaccgggacgagctgatgtgctggaagtggaacagggcttgatgatcacaaacttgccctgtgatgtcatctggctagacattgaacatgctgatggcaaagcggtatttcacctgggaccccagtcgcttcctcagcccggagcatgcttgagacgcttggttactagagggcggaagctggtggcatcgtagaacccacatcaggggctccggtaccgagttcacgaggagctgggacctggggcggttttaaaccggatggtctgaacataggcgggagccagcacgggtcaccggtctatccgaagaggcgtgggaagtcgaaa

SEQ ID NO: 75356 - DNA, 291 bp, Homo sapiens
attcggcatgaggaaacacccagggatggcgacaccagaggagactcaggggaaggcagagaaagatgagccaggagcctgggaggagacattcaaaactcactctgacagcaagccgtatggccccatgtctgtgggtttggacttctctctgccaggcatggagcatgtctatgggatcccttatttaggagccctgaactcccccagagtctatccattcatgcctcttgtatgttgatgccacttcttggaagaagatgagggcaatgagttagggctccttttccc

SEQ ID NO: 75357 - DNA, 1591 bp, Homo sapiens
  misc_feature (325)..(326): n is a, c, g, or t
  misc_feature (329)..(329): n is a, c, g, or t
  misc_feature (352)..(352): n is a, c, g, or t
tcgtgcgcgtagcatgtggcacttgggcgtctttgatactggttatgtgttacgtgtggatctgcctgggtggattaacccttgctgtggatagaagcagctttaagacctgtgacagaggccgttctttctgcaagcgacagagaatcgtacggcagggctctctccataccgagaccttgttggattctctacatgctttggacctgattaccctcgacgggtccatctgatccatgaggtcaccaaggtgttgctggtgctagagcttcaggggcttcaaaagaacatgactcggttcaggattgatgagctggagcctcgnngancccgataccgtgtaccagatgtnttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctctttctcggataaggttaatctcacgcttggtagcatatgggataagatcaagaaccttttctgcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctcatctctgatgttttccggcaatatgctagtctcacaggaaccaggcgttgcccccactcttctccctcggtaccaccagagccgttggaactaccgggacgagctgatgtgctggaagtggaacagggcttgatgatcacaaacttgccctgtgatgtcatctggctagacattgaacatgctgatggcaaagcggtatttcacctgggaccccagtcgcttcctcagcccggagcatgcttgagacgcttggttactagagggcggaagctggtggcatcgtagaacccacatcaggggctccggtaccgagttcacgaggagctgggacctggggcggttttaaaccggatggtctgaacataggcgggagccagcacgggtcaccggtctatccgaagaggcgtgggaagtcgaaa

SEQ ID NO: 75358 - DNA, 368 bp, Homo sapiens
tgtgttcgtgtctaatctctgctaccagactgaaagccccttgaaggcaaagcctacatcttctttgatctctcacagaattgaataaggacatagaccatagactcagggtagcacatctcattcaacctcagccatgtagacctttgactcaagacctcaccattcaggggaggaaaaattagagttctgtgggtgtttggtatatctctagtttgccagagaaatacatagaattaacactacaggaatagggaaaactatgggaatgctgtggcaataggcaaaagggggttctattatgcagcctccagaattcctgaatctatctggagaaagaaaaatgctcacccttgcttcctgctttc

SEQ ID NO: 75359 - DNA, 313 bp, Homo sapiens
gcccagtagcctgagtctaatcttgttatgtctgggaatagagttactagattttctgctaatggctgtattttacatgataataaatccagtcttttctacaaagtctacttaatttatgcaaaacagatataatttggaatgtgtatgaatgaagctattctttcaagggagcagagaggctgctgtagagcctgttaaatacaattttatgggccctcatgtcaggttaacacaagcaaatgttggttctgtggtcatcaaaggtaatgcttattggatagtttcaggtaaaacaaaaaacagcttttga

SEQ ID NO: 75360 - DNA, 247 bp, Homo sapiens
tacaatgcagcagttgcacagatacggtccctaaagtgagaaatgaatgttcgaaagaaggtgctctcgtttggcatggagtgaatgccttgtttccacctcaaatcctaagatggaacacatttttcctggtgacttcaggcagatggcacacctcccacttccgttgtgtgtcatgaaggaggagacacttctatagccagggctgtgcctgaataatgatgtacatgggggggagttcacattc

SEQ ID NO: 75361 - DNA, 613 bp, Homo sapiens
tagatctgaactatatttttatactctgcatgtgtgtgtataacagtatcggaaaagaaaaacattccattttgttatacagattgcgctgtatctttggaaggtcatatgtgctctagtgaaccaagggctgggattaaccctggagaggcagcaccccccacctgtacaccctgccacttgtgtgaagattcctggaatgcccaggttctctccctctagatattttcaaggcctgtcataatgcaaaagagttttcataatctcgtctcttttgaacaccaaaagacatacttcatggaaaataaaatgtgattatataaaagtaatcctgagatttgccacttcctgttgctagggaaggtactgaattgacgtgatgatggaaattgagtgcttacttgcgcatggcagagcagtgatggcacatcccagagggcagtgtaaggattaagagagagcatgtgttttcttttagaagggagcagagtgctttagggatcagggttgtggttaaggtgtcattgtgagatttcagtgagtgtctttttagtaaaattgaactactttcagccagagccaagtgaaagtctccagccctactttaatcctt

SEQ ID NO: 75362 - DNA, 923 bp, Homo sapiens
ggttcgcgccggaagtggaagaccaggcagcccagctgaaggcagtaagctcggctcacagtcgcaggagagttctggggtacacgggcaaaggggcttgagaaggcccggaggcgaagccgaagagaagcaactgtgccccggagaagagaagctcgcccattccagactgggaaccagctttcagtgaagatggcagggccagaactgttgctcgactccaacatccgcctctgggtggtcctacccatcgttatcatcactttcttcgtaggcatgatccgccactacgtgtccatcctgctgcagagcgacaagaagctcacccaggaacaagtatctgacagaaaatatctttcaggcctggtgcaatggctcacacctataatcccagcactttggggggctgagatgggaggatcccttgagcccaggaatttgagaccaaccttggcagcatgtcaagtcctaattcgaagcagagtcctcagggaaaatggaaaatacattcccaaacagtctttcttgacacgaaaatattatttcaacaacccagaggatggatttttcaaaaaaactaaacggaaggtagtgccaccttctcctatgactgatcctactatgttgacagacatgatgaaagggaatgtaacaaatgtcctccctatgattcttattggtggatggatcaacatgacattctcaggctttgtcacaaccaaggtcccatttccactgaccctccgttttaagcctatgttacagcaaggaatcgagctactcacattagatgcatcctggtaagaactttcttttgtttaataaaaacacaaaccacactttgggaagccaaggcgggaggatcacttgagcccatgagtttgagaccagcctgggcaacagagtaagaccctgtctcaaga

SEQ ID NO: 75363 - DNA, 654 bp, Homo sapiens
atcccagcactttgggaggccaaggcgggcagatcatgagatcaggagatcgagaccatcctggctaacatggtgaaaccctgtctcaactaaaaatacaaaaaattagctgggcgtggtggcgggtgcctgtagtcccagctactcaggaggctgaggcaggagaagggcatgaacctgggaggcggagcttgcagtgagccgagatcgcaccactctcagtttgagtccctgcttcctcagtaagctagaggcagatattattcagggaaactagagcagagtggcattttgactgtcttttcttcagaaattgccacagatttccttgtggaagtcgttttccaaaagctatgtggcacagagttcccacctcctctgagaaagagtcacacttattctaaaaataaaacagctcagagtgattgtgaactttttcttctctgcagccaaggtcccatttccactgaccctccgttttaagcctatgttacagcaaggaatcgagctactcacattagatgcatcctggtaagaactttcttttgtttaataaaaacacaaaccacactttgggaagccaaggcgggaggatcacttgagcccatgagtttgagaccagcctgggcaacagagtaagaccctgtctcaaga

SEQ ID NO: 75364 - DNA, 1089 bp, Homo sapiens
  misc_feature (977)..(977): n is a, c, g, or t
  misc_feature (1020)..(1020): n is a, c, g, or t
  misc_feature (1028)..(1028): n is a, c, g, or t
  misc_feature (1051)..(1051): n is a, c, g, or t
  misc_feature (1058)..(1058): n is a, c, g, or t
  misc_feature (1077)..(1077): n is a, c, g, or t
ggttcgcgccggaagtggaagaccaggcagcccagctgaaggcagtaagctcggctcacagtcgcaggagagttctggggtacacgggcaaaggggcttgagaaggcccggaggcgaagccgaagagaagcaactgtgccccggagaagagaagctcgcccattccagactgggaaccagctttcagtgaagatggcagggccagaactgttgctcgactccaacatccgcctctgggtggtcctacccatcgttatcatcactttcttcgtaggcatgatccgccactacgtgtccatcctgctgcagagcgacaagaagctcacccaggaacaagtatctgacagtcaagtcctaattcgaagcagagtcctcagggaaaatggaaaatacattcccaaacagtctttcttgacacgaaaatattatttcaacaacccagaggatggatttttcaaaaaaactaaacggaaggtagtgccaccttctcctatgactgatcctactatgttgacagacatgatgaaagggaatgtaacaaatgtcctccctatgattcttattggtggatggatcaacatgacattctcaggctttgtcacaaccaaggtcccatttccactgaccctccgttttaagcctatgttacagcaaggaatcgagctactcacattagatgcatcctgggtgagttctgcatcctggtacttcctcaatgtatttgggcttcggagcatttactctctgattctgggccaagataatgccgctgaccaatcacgaatgatgcaggagcagatgacgggagcagccatggccatgcccgcagacacaaacaaagctttcaagacagagtgggaagctttggagctgacggatcaccagtgggcactagatgatgtcgaagaagagctcatggccaaagacctccacttcgaaggcatgttcaaaaaggaattacagacctctattttttnaagaccgagcagggattagctgtgtcaggaacttggagttgcncttaaccntgtaactttgtttggagctggcncctcttnaaataaaaaggaggatgcncgagcaaaaaaa

SEQ ID NO: 75365 - DNA, 421 bp, Homo sapiens
aatgaaggcagagaggacagacctgaaaggctaagagggacagatcagcgtccatggaaagcaggagcagaagccagtcttcttccaaacactggcacaaaccactgcctactggatacatttcaccagacaattcaccccagtgtccaagagtttatcttgcttctagaatatattgaaaagagccaccctctgaacaaatggcaaacactatatagtataaataggatgcactgaaaatagtaggcttatttcttaagctgtcatcacgaacattaaccagtaattatatttctccactttttgtagaagacataaatggcaaattctgaatttataatttctaatacttcatttttctgctcttgtaaagttcattttgaactttcaacataaaaatattaaagatttttaattgtgc

SEQ ID NO: 75366 - DNA, 414 bp, Homo sapiens
agaagaataaggatgtgtcttgggttttttgcttaaggtagctggaggccttatttactgagatggagattcctcagagagaatagaggtaagaggtataattttggatgttaagtttgagatacctatcagagagctgagtggaggtatcacgaaggtaatctgacactcaagggagaggtcagagcttaagactcatcagcatacagtctttaaagtcaaaggaacagctctgaaggttttttttgaagctggaaaaataaactagccacgtcttctcttcagaagtagacatgcatggagtggatagaactacatattcatgcagcacaccaacatggcacatgtatacatatgtaacaaacctgcatgttgtgcacatgtatcctaaaacttaaagtataataataatta

SEQ ID NO: 75367 - DNA, 446 bp, Homo sapiens
ctttaaacttcaatccttggctgttgtaggtatacttcaggacttgttgtcaaaataccaataatcaagagaaggtgtcacaatcttagtagtagtaattatcttgatcatcataaagagatagaaatgttatgcagtgaggtcagaaaacaacatgcttgatactcatgtcctccctgagatatctcttggcattttcttacccaattttattgtttaatgctcatgtacagtagactgagggaagcatgaagacctggagttcaaacccccttgggagtgaataacttcttggtcaacttacgaataagaccctaagccagtgaagatccttgttaaaattgacgggaatctagaactggtttttaaaaaagaaaaaaaaagagagagagagaagcaaattatgtcttcaagaccagctacagtggtgatgttgaagttttttc

SEQ ID NO: 75368 - DNA, 374 bp, Homo sapiens
agagtgcaccattgcactctagtctgggtgacgagtggaactccgtctcaaaaacaaagaaaaacagaaaagaaaatccctaactcctaactcgtttgctataataagttatatattgatgtttattcactgcttaaatgaagcaaattaaaataatctttaatttttaaatcccttaatgttatattaattgattaactatcattctgttacccaacagtatacttgaccaatgtttttaacataaaggactactttacagaaaacaaacttacgaatattaagcagcagctgtttgaagtattcatttacttgataggttttattaatatgtgtgcttgtttaaatggtttaaacatgtataactcattgaa

SEQ ID NO: 75369 - DNA, 424 bp, Homo sapiens
gagcccctctctccaataggccctgaggggccactggcacctggctttttggcttggaggcagggccgccggctcaggtgtgttcatttcttcctccatccctttgtttgcgtctgtcatagtcaggctctgtgctggcacatgggtgcagggaccagtgatctagtccctgtcctcaagctgctcagtctactgtgggagacagctcaagggacaggtacccgaccctgtggtcagctctgtgttggaggccacagtgatgatcctacagggtcatggggctaaaaatgctcctctcgtgggcccactgagccaggccccttgctcaaacccagagtctgggctatggctccttgtgcacaaacatcaactgaaagcagcgtccgccgcctgcagccccaggtcaccctgctgggctgcttca

SEQ ID NO: 75370 - DNA, 632 bp, Homo sapiens
aatagcttctgaagcctcccttcatccctgccactcctctttccacagatgcctttggcaggagctggtccgggcctggaaggcagtgcacgcccacagcgccctctgctgaacggtatcagaacagcaggcttggagggcgaaggcaattcctgcaaaggatccctggtttcctacccatgggaaaccccagattctgaagccaggaatgaagggtagatggagcctgggtcagcacccgagaggacccatatgtgcaacctggaggatcttggagcttgggagtagcgtagggggtggttagttcagttcgggatggctgaggaagccgttttaaacaactttcaccgagatcttactgagggatcttactgagggctcaggaacttggcatggccaccatcctgggtatccagggcccctccttcccccaggctaggagaggaacccctcccagcagatgccttcccagactacccttgtctcacttatcatagaggacgtgacgtgtgccgccttccttctcccaggccctggatctggggttgctggacttggtgcgtgggtggtctggatgcttctaggatgaattcataattgggagattctaggtgatgctcagatggaaatga

SEQ ID NO: 75371 - DNA, 151 bp, Homo sapiens
gtgtcatataagcaaagaaccaaggaaatgaatgtcattacaaaaaataaccatttcactgagttaaactgactcttccctttgaactcagaaacacctcatcacagtggtgatgagtcacccctagttttatgatttccttgttaccaag

SEQ ID NO: 75372 - DNA, 460 bp, Homo sapiens
agctctgtgtgatttttaatgcccatgtatattaagatattttgctgctggacgtgcccggaatcccagctactggggaggctgatgtgggaggattgcttgagcccaggagttagagtccagcctgggcaacatagtaagactctgtctctaaaaaactaactaaataaataaaacaatgttttttttttaaagtttatattttgcattcaccctacctaaaataagcagcacagagcaactttaaaacgtggtaagtacttaggcaagccaaatgtttcgatcttctattttagctctgaattttcttattagcaaagctgattatgtggtaaagtaagtggggctataattctatttgttccttacccagaaactttctttaccagccaaacttattgatagaggaagatttgttatacagttgatttaaggcctgtttctgcataaaggcaaagaa

SEQ ID NO: 75373 - DNA, 1480 bp, Homo sapiens
cgagctcggtacccccctcacggattacctcaataagtgccattttggactgtcaaatttagatgctttgtttcagaaagataagccagcatttagttttaaatcactttcctggtttgtaacttgatgctgtttagttaaattgctagttttcctaacactacaatattaattcttctcgtggaagtgtactgatttattatttttattccaagtcagcagatttggaagcattgtggtaaagtctaaggttttcatatccatagtgctgtttggtgagtaccggcagtacagttgaggggagcagggaacagcattgccccgtattgaaggtggagatggttacattcttcactgctttttgcattttgagttgtgtgcctataaaatttggccaaaccattttattattttgttcaaacttgactaagctgagtgatctaaaattatacagaacctaaatcaaagaagagaatgtaaagtcctttagttacttctaagaatttgaagtcaagcacgaatctaagacatagattatttttatatagctaatgaagagtatgttacgaaattgttgggtttttgaggtatctgagggtggcaaattttgtgaatcatgcatgcttcacagaaacaaccaggtttttccagaattagtctggatcagtgcctaacaaagctgttattaattctccacacatgagtctggctaactgggccagctctcatgttttactcctgtctggctacaaatagcactgtgcatagtagccctgtttccccatggtgttggactgtggtaaagtatgttgtgacatactggaattctaataatcctgttgtaagtatgtacagaatctatgtaacttattgttgacatacagaggtttgggaagtagtctaatggacattccttacaatagaatggctgggaagggaaagaaaaaaaaaaaaaaactacctaactccaatcttaatgttgtagttttatagcaaacaaaaattgtcagctttttgtattgaaaggtcagtggtggtaagacaaggtgtcttgtaaattaagattttaagaagtgcattaaaatgttttagaattactctgggaattctgtatatcacactaaaatttttatatcattatgttaataaaagttattgactttgtaattctgcattttgaaatgtgtgaaaagggtctttaaattaccccgaataggttgtatcttattttgctttttttctgactataaaagcagttatgcttatagcataaaatctagaaagcacattaaagtataaagaaaattaaaatttcttataattctacctctgagtaaacagcagcattcgtatgtaacataaaccctctcagggatttattttttctttttaaaaattttttacaaaattaggatcaagtgcttttttaaataatttgcttttgtacttaataaattatagactttaaaatctattacat

SEQ ID NO: 75374 - DNA, 3122 bp, Homo sapiens
ctgtgtccagttgcacccagggaggcagtggtgtctggctcatggggccacgagaacttgatgaagcacgcagaacccagagcccgtccacagctattcttgctgtggtcgggactcggctcatctgggctttgccataggctctgtgacttttggcaaatccctagtcctctaatctttcctactggtcagtgacgtgatgcctcccctcttcgccctgcctcgtcccccatccccacaggctcagtgtggtcttggtgggaccgggtagcgtttccatgaagaatgaaatacgctttcctgagcacgcacagcctgcatcgtcacggccccactcccgtctgagctcactctctgcaggactcccaaggacaaatcatgtgtcgcctcttgcctgtgaaagcccagagcgttcagaatacatgtgggaacactaatgttgctggtgtctcctgtttaacagatgacatcccaaaaaagaagatagcaagcgttttcaggcccccctcccccgatgtcctcgcatacttggacttcagcgtgtcaaccactgggatattagcgggagtgaaggtaggtcctctgaaatcttgtttgcttcagcccctagaaatcaggaggagtggacagaaaggatgtcagatgcagatttaaactgacaggtccttcttatgcaaagcacaaagcaacaattttgcttcttaagatttgtgttaaataccaataaatgctaagatgtgattagcctgagagtaatgcgttttctgatgcattatggttatgtctaaactttctgatttatgactgtctagcttacaggaactggtggctttgaagaatctcttaccttgctgggagtcaatagctcaattaaaatttttcaggcggggcgtggtggctcacgcctgtaatcccagcacttcgggaggccgaggcgggtggatcacaagatcaagagatggagaccatcctggccaacgtggtgaaaccccgtctctactaaaaatacaaaaaattagctgggcatggtggcaggtgcctctaatcccagatactcaggaggctgaggcaggagaattgcttgaacccgggaggcagaggttgcagtgagccgagattgtgccattgcactccagcctgggcgacagagcaagactctgcctcaaaaaaaaaaaaaagaaaaaaattttaaaaattcattaccctgaaattttgtttcaaagatttttagtgtaccatttcttgggtattatttaggttatatggggatttgagccaaccgtcttttaaggaaataaatatgatgtttggtagttcggagctatggtctagccatgtgaacagcggacactgccatccaccctctcccctcctgaatttcatttcactttttttttttgaactttattttactcttaagatgtcgcacgcggccacaagcgccttatgccgctccataaagctgcagtgtgagctgtacccctcgcggcagatcgccatctgcctcgacccctactgtggccttggttttgccctgtggtgtctgtgcaggtgagtgcagggcccctgctgcctgccaggtgggagcagctcgtgtggctcttaggaaccttggccttctaaggcaccttttctgggtgctcaggaagccgatgagatgtgtgtgagtgggtttgtttggggatgaagtgggttggagtctgagtctgaaattgagtgaaaatacatttttcattaaatacactgtccgttatcagtacttgggaagaatctgcttgattccttcaaacactagaaagtggcgatccgtctctagaagtgaatgcctctggagtggtgtccccggatcctctccaagtgttcggagcagagctcagaaccccgtgcctgccatcccccaaccttcaccctgtggcatgttttccaccaaacccccccacttggcgtcagaacagaaatcatgcccctgttgtggctggaaaagaagtgttcttgaggaagggaagagtggagtgcccagggtgctgggtgggcgggcggagcctcacgagccttccctctcgcagtgtctactcgggacaccaatcagtgctggtgcccccgctggagctggagagcaacgtgtccctgtggctgtcggccgtcagccagtacaaggcccgcgtcaccttctgctcctactctgtgatggagatgtgcaccaagggcctaggcgcacagacgggtgtcctcaggatgaagggggtgaacctgtcatgtgtgcgcacgtgcatggtggtcgccgaggagcggcccaggattgcgctgacccagtccttctccaagctcttcaaggacctgggcctgccggcccgcgccgtaagcaccacgttcgggtgcagggtcaacgtggccatctgcctccaggtgaggtgcctggggcctgcggttctcgaaagctggctgttggcagcatggagacccagtttcccagttgttaatgtgccgttttgtagccgcctgatctatttctccttctctgggcctttgatatctcatttccatgtaacattttagcttcaagggttttatttttaaagatgttctattctagttggagaaaggcttatttggaaaaaaaacacattgtttttgaacagtgactaataactgtaagactctctaagttagatataaaacacagctaagttcttaaagcaagattgaacttactgttttaagatatctagcaatattaaattgaaacattaataaatgtggtaatttgtgttgactcaaattcatttctgaaaccatgaaatgtcttattaaaaggaagcaccaagtttcaggccaggagtggtggctcatgcctataatcccagcactttgggaggctgaggcaggcggattacctgaggtcaggaattcgagaccagcctggacaatatgatgagaccccgtctctactaaaaatacaaaaattagctggctggtggtgcgcgcctgttgtcccggctacttgggaggttgaggcacaagaatcgcttgaacctggcaagaggaggttgcagcgagccaagatctcaccactgcactccagcctgggtgacagagcgagaccctgtctcaaaaaaaaaaaa

SEQ ID NO: 75375 - DNA, 3752 bp, Homo sapiens
tcacacaaccaggaagaataagagtggcccctgtgacatttggttctttagagggacagggacagagagaagacaagtaacccatctactggcaagaacgtttcttacccgatgacccatgtgacatttggttttagagggatagggacagatagaagacaagttatccatctactggcagaacgtttcttacctgatgctgtcataggatctgacttagtttcatcttgatgaacgatggtggtgcatacagtgtgtgcttgctggtctgtggtcagatgtgtatcagggcccctcccagctttgaagctcagatcccagtcctggattctcaagtatggccacactgtagcttgatgtaaacactaggtttagcttactgggtgccaggggcttgctgggttcagggaggacctaaacgaaatgtagagtgagctgctgtgagcacatggggtgggtggcgagtgcatgcgggtggcggcacttgggaccgcagcgtggttggggtgtccctgccattcatggcaggtgtgctgtggaaaggttgacatcctgactgttgtcaacagaccctcagagtgatcatttccaacgtcatgatctgccctttcagacattactacctgtgtagtaaattttgtactgaaattgttccctttatttttagggttcgtttggtagaacggggttctccgcacagcctgccattgatggagtctggaaagatcctccccggcgtgaaggtcatcatcgcacacaccgagaccaaaggacccttgggagactcacacctgggagagatctgggtaagcagcccccacaatgccaccgggtactacaccgtttacggggaggaggcgcttcatgccgaccacttcagtgcccggctgagttttggagacacacagaccatctgggcaaggaccggctaccttggcttccttcggcgaacagagctcactgatgccagtggagggcggcacgatgcactgtatgtggttgggtctctggatgaaactctggagctcagaggcatgcggtaccaccccatcgacattgagacctctgtcatccgagcacacaggagcatcgctgagtgtgccgtattcacctggaccaacctgctggtggtggtggtggagctggatgggctagagcaggatgccctggacctggtggccctggtgaccaacgtggtgctggaggagcactacctggtcgtgggagtggtggtcatcgtggacccaggggtgatccctatcaactctcggggtgagaagcagcgcatgcacctgcgggacggcttcctggctgaccagctggaccccatctatgtcgcctacaacatgtgagcgcagcacaccggcccaggtgccggagatgaatgagccccagcagtccaaggtgtgatgtgggaagacaccgcagagctcactcaccgggactcgcccttcctgtgctcttacagatccctctcaacaatccccgcatctccttttagaaagcacttcctgaattatttaaagaaatattttgaatctgccaagtacatttacaaaaacacggatgctggtattttaacagatggagagacaaggaaaggaaaggaaaggcctggcatgggcattgtgaggaatcacaggcaccgaggttgttctctgctgtactgcaagtttgcactttctttaggctaaaaatatagttcctgatttttaaaattcagttatttattcccacttcaaatgacaagttcatatatagaatttacgggagaaacttgagaccatttacggggagaaacttgattctgggaagatagcagagtacaaaccagctgcctcacttctgtttcacagggaggctgatggaaaaaggaagcaagctggacccatcctccctgctcacagagggcactgtggtcacacacagtgcctcctctgccagttcctttattgaaagaggtgtgctggctggccacggtggcttacacctgtaatcccagcactttgggaggccgaggcgagcagatcacgaggtcaggagaccgagaccatcctggctaacatggtgaaaccctgtctctactaaaaatacaaaaaattagccgggtgtggtggtgggcgcctgtagtcccagctacttgggaggctgaggcaggagaatggtatgaaccagggaggcggagcttgcagtgagccgagatcacgctactgcactccagcctgggtgacagcacgagatgccgtcttaaaaaaacaaaaaagaggtgtgctgcttgtcagcatgtattgtcacggacactcaataagtgccattttggactgtcaaatttagatgctttgtttcagaaagataagccagcatttagttttaaatcactttcctggtttgtaacttgatgctgtttagttaaattgctagttttcctaacactacaatattaattcttctcgtggaagtgtactgatttattatttttattccaagtcagcagatttggaagcattgtggtaaagtctaaggttttcatatccatagtgctgtttggtgagtaccggcagtacagttgaggggagcagggaacagcattgccccgtattgaaggtggagatggttacattcttcactgctttttgcattttgagttgtgtgcctataaaatttggccaaaccattttattattttgttcaaacttgactaagctgagtgatctaaaattatacagaacctaaatcaaagaagagaatgtaaagtcctttagttacttctaagaatttgaagtcaagcacgaatctaagacatagattatttttatatagctaatgaagagtatgttacgaaattgttgggtttttgaggtatctgagggtggcaaattttgtgaatcatgcatgcttcacagaaacaaccaggtttttccagaattagtctggatcagtgcctaacaaagctgttattaattctccacacatgagtctggctaactgggccagctctcatgttttactcctgtctggctacaaatagcactgtgcatagtagccctgtttccccatggtgttggactgtggtaaagtatgttgtgacatactggaattctaataatcctgttgtaagtatgtacagaatctatgtaacttattgttgacatacagaggtttgggaagtagtctaatggacattccttacaatagaatggctgggaagggaaagaaaaaaaaaaaaaaactacctaactccaatcttaatgttgtagttttatagcaaacaaaaattgtcagctttttgtattgaaaggtcagtggtggtaagacaaggtgtcttgtaaattaagattttaagaagtgcattaaaatgttttagaattactctgggaattctgtatatcacactaaaatttttatatcattatgttaataaaagttattgactttgtaattctgcattttgaaatgtgtgaaaagggtctttaaattaccccgaataggttgtatcttattttgctttttttctgactataaaagcagttatgcttatagcataaaatctagaaagcacattaaagtataaagaaaattaaaatttcttataattctacctctgagtaaacagcagcattcgtatgtaacataaaccctctcagggatttattttttctttttaaaaattttttacaaaattaggatcaagtgcttttttaaataatttgcttttgtacttaataaattatagactttaaaatctattacat

SEQ ID NO: 75376 - DNA, 5553 bp, Homo sapiens
ctgtgtccagttgcacccagggaggcagtggtgtctggctcatggggccacgagaacttgatgaagcacgcagaacccagagcccgtccacagctattcttgctgtggtcgggactcggctcatctgggctttgccataggctctgtgacttttggcaaatccctagtcctctaatctttcctactggtcagtgacgtgatgcctcccctcttcgccctgcctcgtcccccatccccacaggctcagtgtggtcttggtgggaccgggtagcgtttccatgaagaatgaaatacgctttcctgagcacgcacagcctgcatcgtcacggccccactcccgtctgagctcactctctgcaggactcccaaggacaaatcatgtgtcgcctcttgcctgtgaaagcccagagcgttcagaatacatgtgggaacactaatgttgctggtgtctcctgtttaacagatgacatcccaaaaaagaagatagcaagcgttttcaggcccccctcccccgatgtcctcgcatacttggacttcagcgtgtcaaccactgggatattagcgggagtgaaggtaggtcctctgaaatcttgtttgcttcagcccctagaaatcaggaggagtggacagaaaggatgtcagatgcagatttaaactgacaggtccttcttatgcaaagcacaaagcaacaattttgcttcttaagatttgtgttaaataccaataaatgctaagatgtgattagcctgagagtaatgcgttttctgatgcattatggttatgtctaaactttctgatttatgactgtctagcttacaggaactggtggctttgaagaatctcttaccttgctgggagtcaatagctcaattaaaatttttcaggcggggcgtggtggctcacgcctgtaatcccagcacttcgggaggccgaggcgggtggatcacaagatcaagagatggagaccatcctggccaacgtggtgaaaccccgtctctactaaaaatacaaaaaattagctgggcatggtggcaggtgcctctaatcccagatactcaggaggctgaggcaggagaattgcttgaacccgggaggcagaggttgcagtgagccgagattgtgccattgcactccagcctgggcgacagagcaagactctgcctcaaaaaaaaaaaaaagaaaaaaattttaaaaattcattaccctgaaattttgtttcaaagatttttagtgtaccatttcttgggtattatttaggttatatggggatttgagccaaccgtcttttaaggaaataaatatgatgtttggtagttcggagctatggtctagccatgtgaacagcggacactgccatccaccctctcccctcctgaatttcatttcactttttttttttgaactttattttactcttaagatgtcgcacgcggccacaagcgccttatgccgctccataaagctgcagtgtgagctgtacccctcgcggcagatcgccatctgcctcgacccctactgtggccttggttttgccctgtggtgtctgtgcaggtgagtgcagggcccctgctgcctgccaggtgggagcagctcgtgtggctcttaggaaccttggccttctaaggcaccttttctgggtgctcaggaagccgatgagatgtgtgtgagtgggtttgtttggggatgaagtgggttggagtctgagtctgaaattgagtgaaaatacatttttcattaaatacactgtccgttatcagtacttgggaagaatctgcttgattccttcaaacactagaaagtggcgatccgtctctagaagtgaatgcctctggagtggtgtccccggatcctctccaagtgttcggagcagagctcagaaccccgtgcctgccatcccccaaccttcaccctgtggcatgttttccaccaaacccccccacttggcgtcagaacagaaatcatgcccctgttgtggctggaaaagaagtgttcttgaggaagggaagagtggagtgcccagggtgctgggtgggcgggcggagcctcacgagccttccctctcgcagtgtctactcgggacaccaatcagtgctggtgcccccgctggagctggagagcaacgtgtccctgtggctgtcggccgtcagccagtacaaggcccgcgtcaccttctgctcctactctgtgatggagatgtgcaccaagggcctaggcgcacagacgggtgtcctcaggatgaagggggtgaacctgtcatgtgtgcgcacgtgcatggtggtcgccgaggagcggcccaggattgcgctgacccagtccttctccaagctcttcaaggacctgggcctgccggcccgcgccgtaagcaccacgttcgggtgcagggtcaacgtggccatctgcctccagggcacagctggcccggaccccacaaccgtctacgtggacatgcgggcactgcgccatgacagggttcgtttggtagaacggggttctccgcacagcctgccattgatggagtctggaaagatcctccccggcgtgaaggtcatcatcgcacacaccgagaccaaaggacccttgggagactcacacctgggagagatctgggtaagcagcccccacaatgccaccgggtactacaccgtttacggggaggaggcgcttcatgccgaccacttcagtgcccggctgagttttggagacacacagaccatctgggcaaggaccggctaccttggcttccttcggcgaacagagctcactgatgccagtggagggcggcacgatgcactgtatgtggttgggtctctggatgaaactctggagctcagaggcatgcggtaccaccccatcgacattgagacctctgtcatccgagcacacaggagcatcgctgagtgtgccgtattcacctggaccaacctgctggtggtggtggtggagctggatgggctagagcaggatgccctggacctggtggccctggtgaccaacgtggtgctggaggagcactacctggtcgtgggagtggtggtcatcgtggacccaggggtgatccctatcaactctcggggtgagaagcagcgcatgcacctgcgggacggcttcctggctgaccagctggaccccatctatgtcgcctacaacatgtgagcgcagcacaccggcccaggtgccggagatgaatgagccccagcagtccaaggtgtgatgtgggaagacaccgcagagctcactcaccgggactcgcccttcctgtgctcttacagatccctctcaacaatccccgcatctccttttagaaagcacttcctgaattatttaaagaaatattttgaatctgccaagtacatttacaaaaacacggatgctggtattttaacagatggagagacaaggaaaggaaaggaaaggcctggcatgggcattgtgaggaatcacaggcaccgaggttgttctctgctgtactgcaagtttgcactttctttaggctaaaaatatagttcctgatttttaaaattcagttatttattcccacttcaaatgacaagttcatatatagaatttacgggagaaacttgagaccatttacggggagaaacttgattctgggaagatagcagagtacaaaccagctgcctcacttctgtttcacagggaggctgatggaaaaaggaagcaagctggacccatcctccctgctcacagagggcactgtggtcacacacagtgcctcctctgccagttcctttattgaaagaggtgtgctggctggccacggtggcttacacctgtaatcccagcactttgggaggccgaggcgagcagatcacgaggtcaggagaccgagaccatcctggctaacatggtgaaaccctgtctctactaaaaatacaaaaaattagccgggtgtggtggtgggcgcctgtagtcccagctacttgggaggctgaggcaggagaatggtatgaaccagggaggcggagcttgcagtgagccgagatcacgctactgcactccagcctgggtgacagcacgagatgccgtcttaaaaaaacaaaaaagaggtgtgctgcttgtcagcatgtattgtcacggacactcaataagtgccattttggactgtcaaatttagatgctttgtttcagaaagataagccagcatttagttttaaatcactttcctggtttgtaacttgatgctgtttagttaaattgctagttttcctaacactacaatattaattcttctcgtggaagtgtactgatttattatttttattccaagtcagcagatttggaagcattgtggtaaagtctaaggttttcatatccatagtgctgtttggtgagtaccggcagtacagttgaggggagcagggaacagcattgccccgtattgaaggtggagatggttacattcttcactgctttttgcattttgagttgtgtgcctataaaatttggccaaaccattttattattttgttcaaacttgactaagctgagtgatctaaaattatacagaacctaaatcaaagaagagaatgtaaagtcctttagttacttctaagaatttgaagtcaagcacgaatctaagacatagattatttttatatagctaatgaagagtatgttacgaaattgttgggtttttgaggtatctgagggtggcaaattttgtgaatcatgcatgcttcacagaaacaaccaggtttttccagaattagtctggatcagtgcctaacaaagctgttattaattctccacacatgagtctggctaactgggccagctctcatgttttactcctgtctggctacaaatagcactgtgcatagtagccctgtttccccatggtgttggactgtggtaaagtatgttgtgacatactggaattctaataatcctgttgtaagtatgtacagaatctatgtaacttattgttgacatacagaggtttgggaagtagtctaatggacattccttacaatagaatggctgggaagggaaagaaaaaaaaaaaaaaactacctaactccaatcttaatgttgtagttttatagcaaacaaaaattgtcagctttttgtattgaaaggtcagtggtggtaagacaaggtgtcttgtaaattaagattttaagaagtgcattaaaatgttttagaattactctgggaattctgtatatcacactaaaatttttatatcattatgttaataaaagttattgactttgtaattctgcattttgaaatgtgtgaaaagggtctttaaattaccccgaataggttgtatcttattttgctttttttctgactataaaagcagttatgcttatagcataaaatctagaaagcacattaaagtataaagaaaattaaaatttcttataattctacctctgagtaaacagcagcattcgtatgtaacataaaccctctcagggatttattttttctttttaaaaattttttacaaaattaggatcaagtgcttttttaaataatttgcttttgtacttaataaattatagactttaaaatctattacat

SEQ ID NO: 75377 - DNA, 2801 bp, Homo sapiens
ctgtgtccagttgcacccagggaggcagtggtgtctggctcatggggccacgagaacttgatgaagcacgcagaacccagagcccgtccacagctattcttgctgtggtcgggactcggctcatctgggctttgccataggctctgtgacttttggcaaatccctagtcctctaatctttcctactggtcagtgacgtgatgcctcccctcttcgccctgcctcgtcccccatccccacaggctcagtgtggtcttggtgggaccgggtagcgtttccatgaagaatgaaatacgctttcctgagcacgcacagcctgcatcgtcacggccccactcccgtctgagctcactctctgcaggactcccaaggacaaatcatgtgtcgcctcttgcctgtgaaagcccagagcgttcagaatacatgtgggaacactaatgttgctggtgtctcctgtttaacagatgacatcccaaaaaagaagatagcaagcgttttcaggcccccctcccccgatgtcctcgcatacttggacttcagcgtgtcaaccactgggatattagcgggagtgaaggtaggtcctctgaaatcttgtttgcttcagcccctagaaatcaggaggagtggacagaaaggatgtcagatgcagatttaaactgacaggtccttcttatgcaaagcacaaagcaacaattttgcttcttaagatttgtgttaaataccaataaatgctaagatgtgattagcctgagagtaatgcgttttctgatgcattatggttatgtctaaactttctgatttatgactgtctagcttacaggaactggtggctttgaagaatctcttaccttgctgggagtcaatagctcaattaaaatttttcaggcggggcgtggtggctcacgcctgtaatcccagcacttcgggaggccgaggcgggtggatcacaagatcaagagatggagaccatcctggccaacgtggtgaaaccccgtctctactaaaaatacaaaaaattagctgggcatggtggcaggtgcctgtaatcccagcactttgggaggccgaggcgagcagatcacgaggtcaggagaccgagaccatcctggctaacatggtgaaaccctgtctctactaaaaatacaaaaaattagccgggtgtggtggtgggcgcctgtagtcccagctacttgggaggctgaggcaggagaatggtatgaaccagggaggcggagcttgcagtgagccgagatcacgctactgcactccagcctgggtgacagcacgagatgccgtcttaaaaaaacaaaaaagaggtgtgctgcttgtcagcatgtattgtcacggacactcaataagtgccattttggactgtcaaatttagatgctttgtttcagaaagataagccagcatttagttttaaatcactttcctggtttgtaacttgatgctgtttagttaaattgctagttttcctaacactacaatattaattcttctcgtggaagtgtactgatttattatttttattccaagtcagcagatttggaagcattgtggtaaagtctaaggttttcatatccatagtgctgtttggtgagtaccggcagtacagttgaggggagcagggaacagcattgccccgtattgaaggtggagatggttacattcttcactgctttttgcattttgagttgtgtgcctataaaatttggccaaaccattttattattttgttcaaacttgactaagctgagtgatctaaaattatacagaacctaaatcaaagaagagaatgtaaagtcctttagttacttctaagaatttgaagtcaagcacgaatctaagacatagattatttttatatagctaatgaagagtatgttacgaaattgttgggtttttgaggtatctgagggtggcaaattttgtgaatcatgcatgcttcacagaaacaaccaggtttttccagaattagtctggatcagtgcctaacaaagctgttattaattctccacacatgagtctggctaactgggccagctctcatgttttactcctgtctggctacaaatagcactgtgcatagtagccctgtttccccatggtgttggactgtggtaaagtatgttgtgacatactggaattctaataatcctgttgtaagtatgtacagaatctatgtaacttattgttgacatacagaggtttgggaagtagtctaatggacattccttacaatagaatggctgggaagggaaagaaaaaaaaaaaaaaactacctaactccaatcttaatgttgtagttttatagcaaacaaaaattgtcagctttttgtattgaaaggtcagtggtggtaagacaaggtgtcttgtaaattaagattttaagaagtgcattaaaatgttttagaattactctgggaattctgtatatcacactaaaatttttatatcattatgttaataaaagttattgactttgtaattctgcattttgaaatgtgtgaaaagggtctttaaattaccccgaataggttgtatcttattttgctttttttctgactataaaagcagttatgcttatagcataaaatctagaaagcacattaaagtataaagaaaattaaaatttcttataattctacctctgagtaaacagcagcattcgtatgtaacataaaccctctcagggatttattttttctttttaaaaattttttacaaaattaggatcaagtgcttttttaaataatttgcttttgtacttaataaattatagactttaaaatctattacat

SEQ ID NO: 75378 - DNA, 2923 bp, Homo sapiens
tcacacaaccaggaagaataagagtggcccctgtgacatttggttctttagagggacagggacagagagaagacaagtaacccatctactggcaagaacgtttcttacccgatgacccatgtgacatttggttttagagggatagggacagatagaagacaagttatccatctactggcagaacgtttcttacctgatgctgtcataggatctgacttagtttcatcttgatgaacgatggtggtgcatacagtgtgtgcttgctggtctgtggtcagatgtgtatcagggcccctcccagctttgaagctcagatcccagtcctggattctcaagtatggccacactgtagcttgatgtaaacactaggtttagcttactgggtgccaggggcttgctgggttcagggaggacctaaacgaaatgtagagtgagctgctgtgagcacatggggtgggtggcgagtgcatgcgggtggcggcacttgggaccgcagcgtggttggggtgtccctgccattcatggcaggtgtgctgtggaaaggttgacatcctgactgttgtcaacagaccctcagagtgatcatttccaacgtcatgatctgccctttcagacattactacctgtgtagtaaattttgtactgaaattgttccctttatttttagggttcgtttggtagaacggggttctccgcacagcctgccattgatggagtctggaaagatcctccccggcgtgaaggtcatcatcgcacacaccgagaccaaaggacccttgggagactcacacctgggagagatctgggtaagcagcccccacaatgccaccgggtactacaccgtttacggggaggaggcgcttcatgccgaccacttcagtgcccggctgagttttggagacacacagaccatctgggcaaggaccggctaccttggcttccttcggcgaacagagctcactgatgccagtggagggcggcacgatgcactgtatgtggttgggtctctggatgaaactctggagctcagaggcatgcggtaccaccccatcgacattgagacctctgtcatccgagcacacaggagcatcgctgagtgtgccgtattcacctggaccaacctgctggtggtggtggtggagctggatgggctagagcaggatgccctggacctggtggccctggtgaccaacgtggtgctggaggagcactacctggtcgtgggagtggtggtcatcgtggacccaggggtgatccctatcaactctcggggtgagaagcagcgcatgcacctgcgggacggcttcctggctgaccagctggaccccatctatgtcgcctacaacatgtgagcgcagcacaccggcccaggtgccggagatgaatgagccccagcagtccaaggtgtgatgtgggaagacaccgcagagctcactcaccgggactcgcccttcctgtgctcttacagatccctctcaacaatccccgcatctccttttagaaagcacttcctgaattatttaaagaaatattttgaatctgccaagtacatttacaaaaacacggatgctggtattttaacagatggagagacaaggaaaggaaaggaaaggcctggcatgggcattgtgaggaatcacaggcaccgaggttgttctctgctgtactgcaagtttgcactttctttaggctaaaaatatagttcctgatttttaaaattcagttatttattcccacttcaaatgacaagttcatatatagaatttacgggagaaacttgagaccatttacggggagaaacttgattctgggaagatagcagagtacaaaccagctgcctcacttctgtttcacagggaggctgatggaaaaaggaagcaagctggacccatcctccctgctcacagagggcactgtggtcacacacagtgcctcctctgccagttcctttattgaaagaggtgtgctggctggccacggtggcttacacctgtaatcccagcactttgggaggccgaggcgagcagatcacgaggtcaggagaccgagaccatcctggctaacatggtgaaaccctgtctctactaaaaatacaaaaaattagccgggtgtggtggtgggcgcctgtagtcccagctacttgggaggctgaggcaggagaatggtatgaaccagggaggcggagcttgcagtgagccgagatcacgctactgcactccagcctgggtgacagcacgagatgccgtcttaaaaaaacaaaaaagaggtgtgctgcttgtcagcatgtattgtcacggacactcaataagtgccattttggactgtcaaatttagatgctttgtttcagaaagataagccagcatttagttttaaatcactttcctggtttgtaacttgatgctgtttagttaaattgctagttttcctaacactacaatattaattcttctcgtggaagtgtactgatttattatttttattccaagtcagcagatttggaagcattgtggtaaagtctaaggttttcatatccatagtgctgtttggtgagtaccggcagtacagttgaggggagcagggaacagcattgccccgtattgaaggtggagatggttacattcttcactgctttttgcattttgagttgtgtgcctataaaatttggccaaaccattttattattttgttcaaacttgactaagctgagtgatctaaaattatacagaacctaaatcaaagaagagaatgtaaagtcctttagttacttctaagaatttgaagtcaagcacgaatctaagacatagattatttttatatagctaatgaagagtatgttacgaaatattatgcttgcggttattgtgatcattatacctgttccacactatttgacaaggacagtgatgcatgcacaccccgcgg

SEQ ID NO: 75379 - DNA, 512 bp, Homo sapiens
tgctttctgtgcctgtaatttaacttagttcataaaataagagacaatgaatattatccgccccgacttcgttcagtgttttctggagcattattcttggccagtggatgtctcgtgacagaatctgaactcggtggttggtaacacatcacattcttgtcctctgggcccaccagatctgggtaagcagcccccacaatgccaccgggtactacaccgtttacggggaggaggcgcttcatgccgaccacttcagtgcccggctgagttttggagacacacagaccatctgggcaaggaccggctaccttggcttccttcggcgaacagagctcactgatgccagtggaggtgaggggttgtggtgaagccctgcgtgagtgctgtgcggggaggacctgggctccccaagagcttagtcacctgctagcacacctcactccttgctgtggtctggtattgctccttgtggggggaagatgttctgacagcagttttctctgaaaatactg

SEQ ID NO: 75380 - DNA, 3102 bp, Homo sapiens
attttaatgtcactgaatcaagagagtctcgtgtcatgttttctttaacaagggacatagctctcctccttccagatcctccccggcgtgaaggtcatcatcgcacacaccgagaccaaaggacccttgggagactcacacctgggagagatctgggtaagcagcccccacaatgccaccgggtactacaccgtttacggggaggaggcgcttcatgccgaccacttcagtgcccggctgagttttggagacacacagaccatctgggcaaggaccggctaccttggcttccttcggcgaacagagctcactgatgccagtggagggcggcacgatgcactgtatgtggttgggtctctggatgaaactctggagctcagaggcatgcggtaccaccccatcgacattgagacctctgtcatccgagcacacaggagcatcgctgagtgtgccgtattcacctggaccaacctgctggtggtggtggtggagctggatgggctagagcaggatgccctggacctggtggccctggtgaccaacgtggtgctggaggagcactacctggtcgtgggagtggtggtcatcgtggacccaggggtgatccctatcaactctcggggtgagaagcagcgcatgcacctgcgggacggcttcctggctgaccagctggaccccatctatgtcgcctacaacatgtgagcgcagcacaccggcccaggtgccggagatgaatgagccccagcagtccaaggtgtgatgtgggaagacaccgcagagctcactcaccgggactcgcccttcctgtgctcttacagatccctctcaacaatccccgcatctccttttagaaagcacttcctgaattatttaaagaaatattttgaatctgccaagtacatttacaaaaacacggatgctggtattttaacagatggagagacaaggaaaggaaaggaaaggcctggcatgggcattgtgaggaatcacaggcaccgaggttgttctctgctgtactgcaagtttgcactttctttaggctaaaaatatagttcctgatttttaaaattcagttatttattcccacttcaaatgacaagttcatatatagaatttacgggagaaacttgagaccatttacggggagaaacttgattctgggaagatagcagagtacaaaccagctgcctcacttctgtttcacagggaggctgatggaaaaaggaagcaagctggacccatcctccctgctcacagagggcactgtggtcacacacagtgcctcctctgccagttcctttattgaaagaggtgtgctggctggccacggtggcttacacctgtaatcccagcactttgggaggccgaggcgagcagatcacgaggtcaggagaccgagaccatcctggctaacatggtgaaaccctgtctctactaaaaatacaaaaaattagccgggtgtggtggtgggcgcctgtagtcccagctacttgggaggctgaggcaggagaatggtatgaaccagggaggcggagcttgcagtgagccgagatcacgctactgcactccagcctgggtgacagcacgagatgccgtcttaaaaaaacaaaaaagaggtgtgctgcttgtcagcatgtattgtcacggacactcaataagtgccattttggactgtcaaatttagatgctttgtttcagaaagataagccagcatttagttttaaatcactttcctggtttgtaacttgatgctgtttagttaaattgctagttttcctaacactacaatattaattcttctcgtggaagtgtactgatttattatttttattccaagtcagcagatttggaagcattgtggtaaagtctaaggttttcatatccatagtgctgtttggtgagtaccggcagtacagttgaggggagcagggaacagcattgccccgtattgaaggtggagatggttacattcttcactgctttttgcattttgagttgtgtgcctataaaatttggccaaaccattttattattttgttcaaacttgactaagctgagtgatctaaaattatacagaacctaaatcaaagaagagaatgtaaagtcctttagttacttctaagaatttgaagtcaagcacgaatctaagacatagattatttttatatagctaatgaagagtatgttacgaaattgttgggtttttgaggtatctgagggtggcaaattttgtgaatcatgcatgcttcacagaaacaaccaggtttttccagaattagtctggatcagtgcctaacaaagctgttattaattctccacacatgagtctggctaactgggccagctctcatgttttactcctgtctggctacaaatagcactgtgcatagtagccctgtttccccatggtgttggactgtggtaaagtatgttgtgacatactggaattctaataatcctgttgtaagtatgtacagaatctatgtaacttattgttgacatacagaggtttgggaagtagtctaatggacattccttacaatagaatggctgggaagggaaagaaaaaaaaaaaaaaactacctaactccaatcttaatgttgtagttttatagcaaacaaaaattgtcagctttttgtattgaaaggtcagtggtggtaagacaaggtgtcttgtaaattaagattttaagaagtgcattaaaatgttttagaattactctgggaattctgtatatcacactaaaatttttatatcattatgttaataaaagttattgactttgtaattctgcattttgaaatgtgtgaaaagggtctttaaattaccccgaataggttgtatcttattttgctttttttctgactataaaagcagttatgcttatagcataaaatctagaaagcacattaaagtataaagaaaattaaaatttcttataattctacctctgagtaaacagcagcattcgtatgtaacataaaccctctcagggatttattttttctttttaaaaattttttacaaaattaggatcaagtgcttttttaaataatttgcttttgtacttaataaattatagactttaaaatctattacat

SEQ ID NO: 75381 - DNA, 1094 bp, Homo sapiens
cccacgcgtcgcggacgcgtgggctccggaaaggcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattg

SEQ ID NO: 75382 - DNA, 705 bp, Homo sapiens
  misc_feature (152)..(152): n is a, c, g, or t
tggctggaaggggtccctatgggggggcggaaaggcgccacatgaaaggggcggggccaatggccgcccacggggaaggagtcaaaaaagcccctctgcccagttgggcgcggggggggagcggatgagcgcttgaggagggagagagaganagacaccgagagcgagagagagagatagagagagaagaggagcccaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattg

SEQ ID NO: 75383 - DNA, 973 bp, Homo sapiens
  misc_feature (21)..(21): n is a, c, g, or t
  misc_feature (905)..(905): n is a, c, g, or t
  misc_feature (908)..(910): n is a, c, g, or t
  misc_feature (923)..(923): n is a, c, g, or t
  misc_feature (973)..(973): n is a, c, g, or t
cggcagtaactctaagcgggnaggtagcgaggctgggtggctccggaaaggcgttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgaggggggggtttggggcgggagaccanggnnnggggttggggggncccttctgtcccctaagggggaaaaaatgtctggccccttgttagagggn

SEQ ID NO: 75384 - DNA, 841 bp, Homo sapiens
  misc_feature (769)..(769): n is a, c, g, or t
  misc_feature (805)..(805): n is a, c, g, or t
  misc_feature (837)..(837): n is a, c, g, or t
cagtgcttatttccggctttcggatgctgacgctctcttcctgtctttgtggctccggaaaggcgttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggcaacgtgaaatcttcttcanggggtctaaggaaggggcattttttggaaaactggncttgaaaccaaccccttaatcccctgggcttncccc

SEQ ID NO: 75385 - DNA, 1019 bp, Homo sapiens
ggggcagaggtgattgacccccgcccccccgcccgtgggaccaagaaagatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctcctaaggctctgatccctgaggctgtgtaatgcgcacggattctccggcagaggctggaaggtgaccctcctgtcccttaaggggagacagggctggcaccttggagcgcggtataacgtacaaatgttggaggtcccggtacgcctcatccttaatatgat

SEQ ID NO: 75386 - DNA, 497 bp, Homo sapiens
cagtgcttatttccggctttcggatgctgacgctctcttcctgtctttgtggctccggaaaggcgttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtggtgtgatggcccaccatgcactgacaggaggtctgctcacggatttgcgtctccc

SEQ ID NO: 75387 - DNA, 169 bp, Homo sapiens
aaagaaattataaaaatttttttagaacccctatcccctgcctccccctctcagaagagggtggaagatgaaatgaaagctatgggactcttggaggatacccagtgtctattctgggttagagaagtgcttactaaggggttttctaataaaaacaaatgccacattg

SEQ ID NO: 75388 - DNA, 1105 bp, Homo sapiens
cgggctaggtaacgaggctgggttgtgctttgtggctccggaaaggcgttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattg

SEQ ID NO: 75389 - DNA, 1110 bp, Homo sapiens
  misc_feature (21)..(21): n is a, c, g, or t
cggcagtaactctaagcgggnaggtagcgaggctgggtggctccggaaaggcgttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattg

SEQ ID NO: 75390 - DNA, 1087 bp, Homo sapiens
tcggctaggtacgaggctgggtttaaattcggccgatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattg

SEQ ID NO: 75391 - DNA, 1086 bp, Homo sapiens
ccacgcgtcgcggacgcgtgggtcgacccacgcgtccgcaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattg

SEQ ID NO: 75392 - DNA, 1085 bp, Homo sapiens
gatctagaactagtctccggaaaggcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattg

SEQ ID NO: 75393 - DNA, 1373 bp, Homo sapiens
cccacgcgtcgcggacgcgtgggctccggaaaggcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattgaaaaaaaaaaaaaaaaaaaaaaaaaaaaaatgtttggggcgcggcctcgggccctgaaaaaaaggttttctaaaaccccctcctggtgggcggccgcggcggcccccaaggtggggtattggtgaacactgtgtggcaaaagaggggtgttcccaagggagaaccgtgtggccagagagacatggtgcgtgtgggtttctcttccccaaaattaaaaaagcggcgcgggggaaacccgggcggtttttgaccaactcccgagatggcggttcggaggga

SEQ ID NO: 75394 - DNA, 1125 bp, Homo sapiens
gcgtcagctgaggcctcagcccatgtccccgagactcacgcagccttctcatgtactgtagtggtgtcctcatgccgctggtccctcaaatcagccccaggaccgagtgatttccgcatcctgactcatgtgctgacacgtatacgggccggcgtgtggacgacgacatgacgcgttgacagacaccatatactgattgtagatcgtcgtgcagattaacatagaactatctaggaatgattccgtatccccatcacagaaagaccatatggcaattggtgtctcggaatgctcaagtgtcgaagtgggaccgggagttgctcgcccttgcgtacctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattg

SEQ ID NO: 75395 - DNA, 1114 bp, Homo sapiens
gatctagaactagtctccggaaaggcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgccccgtatcctcttggcacttggtgatgaagggtcggggggcagggagagccttgcctgcaaagcagcaggggtacttcaaataggctggatatgtgtggctgtcctcctgtcatctctctggataagatggagcaagagagattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattg

SEQ ID NO: 75396 - DNA, 719 bp, Homo sapiens
gatcaccccgccaaccaccgccccacccaaggctaaggtattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattg

SEQ ID NO: 75397 - DNA, 1020 bp, Homo sapiens
  misc_feature (895)..(895): n is a, c, g, or t
  misc_feature (923)..(923): n is a, c, g, or t
  misc_feature (925)..(925): n is a, c, g, or t
  misc_feature (957)..(958): n is a, c, g, or t
  misc_feature (965)..(965): n is a, c, g, or t
cccacgcgtcgcggacgcgtgggctccggaaaggcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgagtggggtggttttgcggcgggattcccaggcnaggagggtttgggagggggcacctttcngntcccccaaagggaggaaaaaggctgggacccnntgggagnaggttcacaccaaaaagctttgggggggcttcttcggcaggttgtgtacattctc

SEQ ID NO: 75398 - DNA, 1001 bp, Homo sapiens
  misc_feature (933)..(933): n is a, c, g, or t
cccacgcgtcgcggacgcgtgggctccggaaaggcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctaaaggccttggatgccatgaggtgtgtggttatgggacgggatctccggcagggggttgggaggggcacctntctggtccctaagggggggagagcgggcgggcccctctcgggtccggtttcccacaaggcgcttccgc

SEQ ID NO: 75399 - DNA, 753 bp, Homo sapiens
cctttctcagagtagatgaggtggaacttcatgaggtggacttcccttaatgtcgttcttttcttcttttcagattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattg

SEQ ID NO: 75400 - DNA, 568 bp, Homo sapiens
cggcgttatgaggatccccaaaaatgcggactcaagtcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattg

SEQ ID NO: 75401 - DNA, 1012 bp, Homo sapiens
  misc_feature (944)..(944): n is a, c, g, or t
cgggctaggtaacgaggctgggttgtgctttgtggctccggaaaggcgttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctaaaggccttggatgccatgaggtgtgtggttatgggacgggatctccggcagggggttgggaggggcacctntctggtccctaagggggggagagcgggcgggcccctctcgggtccggtttcccacaaggcgcttccgc

SEQ ID NO: 75402 - DNA, 871 bp, Homo sapiens
cagtgcttatttccggctttcggatgctgacgctctcttcctgtctttgtggctccggaaaggcgttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccagttaagtgtctgtccatggcccagtagtttcacctctgttgcccccagaatagctttgggatgtccaaggaacagctgtcctgatgtgggccatttaagagaaatggcatagactaatttttctttaggcttgatgttaccacacatctggggtgacagtgtcattctgggatcgcacagg

SEQ ID NO: 75403 - DNA, 425 bp, Homo sapiens
  misc_feature (37)..(37): n is a, c, g, or t
  misc_feature (41)..(41): n is a, c, g, or t
atttaagataccctttggagtctggaaagcacctggntttnttgggagaggaccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattg

SEQ ID NO: 75404 - DNA, 637 bp, Homo sapiens
cccacgcgtcgcggacgcgtgggctccggaaaggcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaacgcctttccggagccacaaagacaggaagagagccgtggggtaggaggt

SEQ ID NO: 75405 - DNA, 1122 bp, Homo sapiens
cagtgcttatttccggctttcggatgctgacgctctcttcctgtctttgtggctccggaaaggcgttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattg

SEQ ID NO: 75406 - DNA, 835 bp, Homo sapiens
cagtgcttatttccggctttcggatgctgacgctctcttcctgtctttgtggctccggaaaggcgttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttgggggcgcccgtctcgccaatgagaccacctgggttgaggacctggtctcttagcaaaggaggctggactcccaggcctccaccattt

SEQ ID NO: 75407 - DNA, 1017 bp, Homo sapiens
  misc_feature (21)..(21): n is a, c, g, or t
  misc_feature (949)..(949): n is a, c, g, or t
cggcagtaactctaagcgggnaggtagcgaggctgggtggctccggaaaggcgttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctaaaggccttggatgccatgaggtgtgtggttatgggacgggatctccggcagggggttgggaggggcacctntctggtccctaagggggggagagcgggcgggcccctctcgggtccggtttcccacaaggcgcttccgc

SEQ ID NO: 75408 - DNA, 1013 bp, Homo sapiens
  misc_feature (888)..(888): n is a, c, g, or t
  misc_feature (916)..(916): n is a, c, g, or t
  misc_feature (918)..(918): n is a, c, g, or t
  misc_feature (950)..(951): n is a, c, g, or t
  misc_feature (958)..(958): n is a, c, g, or t
tcggctaggtacgaggctgggtttaaattcggccgatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgagtggggtggttttgcggcgggattcccaggcnaggagggtttgggagggggcacctttcngntcccccaaagggaggaaaaaggctgggacccnntgggagnaggttcacaccaaaaagctttgggggggcttcttcggcaggttgtgtacattctc

SEQ ID NO: 75409 - DNA, 749 bp, Homo sapiens
cagtgcttatttccggctttcggatgctgacgctctcttcctgtctttgtggctccggaaaggcgttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttgtaagctttctagtgttctctctcatcagttccttggtatgagaatgcccttttggttctggaccctcttggcttccacagatttgttttgttggttggttcttgccctgtgtgttttttggtgtctgatatagatactcatcaaatagattgatttagccatgtccagagatttttggcaatgagatcacaattgccaaaaccataaaactgacttaagtagagtccc

SEQ ID NO: 75410 - DNA, 626 bp, Homo sapiens
cagtgcttatttccggctttcggatgctgacgctctcttcctgtctttgtggctccggaaaggcgttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgccccccactttctcctggatcctgccctgctctcagccatagtgaaggaccagccctaggagttgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattg

SEQ ID NO: 75411 - DNA, 1279 bp, Homo sapiens
cagtgcttatttccggctttcggatgctgacgctctcttcctgtctttgtggctccggaaaggcgttgggatgccaacggtaagtccggaggcttagggcgtccgaacgggagaggcgagagcctcgtgtccgcgcatcaccccgtggctgggggttagctaggggagggcgggaagggcagaggacgcggtggctggaggacgtgtaaccttgcaagaggcgggaggcggggggcatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattg

SEQ ID NO: 75412 - DNA, 1092 bp, Homo sapiens
ggggcagaggtgattgacccccgcccccccgcccgtgggaccaagaaagatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattg

SEQ ID NO: 75413 - DNA, 1067 bp, Homo sapiens
  misc_feature (10)..(10): n is a, c, g, or t
gtgctgcacnaaaggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattg

SEQ ID NO: 75414 - DNA, 988 bp, Homo sapiens
atgccaacgatgaggctgctgtcatttcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattg

SEQ ID NO: 75415 - DNA, 779 bp, Homo sapiens
ataacaggagatccgggaattccgggatctcaagctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattg

SEQ ID NO: 75416 - DNA, 877 bp, Homo sapiens
gatctagaactagtctccggaaaggcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattg

SEQ ID NO: 75417 - DNA, 1236 bp, Homo sapiens
cagtgcttatttccggctttcggatgctgacgctctcttcctgtctttgtggctccggaaaggcgttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcaatgtcacaatgggaccggattgcccctgctagcaatgtctcccacactgtggtcctgcgccctctcaaggctggttatttcaacttcacctcggcaacaattacttacctggcccaggaggatgggcccgttgtgattggctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattg

SEQ ID NO: 75418 - DNA, 1012 bp, Homo sapiens
  misc_feature (10)..(10): n is a, c, g, or t
gtgctgcacnaaaggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccagctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattg

SEQ ID NO: 75419 - DNA, 650 bp, Homo sapiens
  misc_feature (17)..(17): n is a, c, g, or t
aagatgtggtgcatgantttcacctcaatgactacaggtctgtaaaagatgtggtggaagctgccagccacattgagcagagaggaggaacagagacccggacggcatttggcattgaatttgcacgctcagaggctttccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattg

SEQ ID NO: 75420 - DNA, 790 bp, Homo sapiens
cccacgcgtcgcggacgcgtgggctccggaaaggcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcagcgggagtttgacaggcgattctcccctcattttctggactggcagcctttggggtcatgacccttccctccatcggcatccacctgctattgtgtacaccagcaagaggaaatatgacacttgcattaagagggccgagctca

SEQ ID NO: 75421 - DNA, 921 bp, Homo sapiens
cccacgcgtcgcggacgcgtgggctccggaaaggcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgaaccaacctcaggactctttggttctacctggtagttgatgggttaatagacataaaatcaaaggctttgctgccactttggaataaagttgtttgcagtgtgctccaaactcttggcttcctctccaagacaaaggaatgtggaccagactcaacccctcctctaataatgtacatttgggtagggctttatacttcattatatatttttgctatttcatttgagcctcacattaaccctgtgaagtagtggatttttgctggaggattaagtaaatgattaccaagggtaagtcattccacgcacaccttgccctgtagagggaccagtggtggtgagcaacttcactctttgcagagtctgaggctcagacagaagaatttggctttaatttcagttgcatgcctggcctaccttgtttaatatatgttctccatggggtatttctcaggtcttctggctcctaggtactcctctttataacacactaagagagaatcatccaa

SEQ ID NO: 75422 - DNA, 324 bp, Homo sapiens
caaaaagagagtggcaaggacttaaaagtggaaacgtgatttcaaatatgggagagataaaaagaatttgaaagagttagtggagtatagaaaggtgaatgccaagtgccaaaagggagcctgcctggcaatcccagatgggctcattacctgaatgtgccccttactacaaaggagagtggaaggggctcttgtgttcattcctgaaagcatgtatgttgcactccatattctctctacattctggaacaccatggtgccttccctagcctgttctagcagaagcagaaaatgctccagattcatggacaccagaaacatgga

SEQ ID NO: 75423 - DNA, 466 bp, Homo sapiens
aatactggttttggatcacctactattggtaacaaaagcagttctttctcaatatgtgggttacttttaaacatttagaaaattctcatccttaagtaaatttatttcaggacaaagttacaaatctgcaaaagccagtttatacttataaactaagattaagtaaaatagcatttattgatcacaatgtttcagtagatattaaatgatcagtttcagttattgtgtgtgcccattgatggtacttgaaatatgaaccagttatctaaggaacttatgagaaaactttggtttctcaaattatttaaaaaactgcacttgtgctatattagtgcagtcacttttgctttttgttttattgtctttactgttgcatgttttttacaaatcaagagtgtcatatttatgaattttaaagatatttaattcattattaaatctcagttcactccaaagaaaaatgttg

SEQ ID NO: 75424 - DNA, 2246 bp, Homo sapiens
cgtccggcgcggagacggtggagtctccgcactgtcggcggggagctttctcttgcataccctcgcttaggctggccggggtgtcacttctgcctccctgccctccagaccatggacggctccttcgtccagcacagtgtgagggttctgcaggagctcaacaagcagcgggagaagggccagtactgcgacgccactctggacgtggggggcctggtgtttaaggcacactggagtgtccttgcctgctgcagtcactttttccagagcctctacggggatggctcagggggcagtgtcgtcctccctgctggcttcgctgagatctttggcctcttgttggactttttctacactggtcacctcgctctcacctcagggaaccgggatcaggtgctcctggcagccagggagttgcgagtgccagaggccgtagagctgtgccagagcttcaagcccaaaacttcagtgggacaggcagcaggtggccagagtgggctggggccccctgcctcccagaatgtgaacagccacgtcaaggagccggcaggcttggaagaagaggaagtttcgaggactctgggtctagtccccagggatcaggagcccagaggcagtcatagtcctcagaggccccagctccattccccagctcagagtgagggcccctcctccctctgtgggaaactgaagcaggccttgaagccttgtccccttgaggacaagaaacccgaggactgcaaagtgcccccaaggcccttagaggctgaaggtgcccagctgcagggcggcagtaatgagtgggaagtggtggttcaagtggaggatgatggggatggcgattacatgtctgagcctgaggctgtgctgaccaggaggaagtcaaatgtaatccgaaagccctgtgcagctgagccagccctgagcgcgggctccctagcagctgagcctgctgagaacagaaaaggtacagcggtgccggtcgaatgccccacatgtcataaaaagttcctcagcaaatattatctaaaagtccacaacaggaaacatactggggagaaaccctttgagtgtcccaaatgtgggaagtgttactttcggaaggagaacctcctggagcatgaagcccggaattgcatgaaccgctcggaacaggtcttcacgtgctctgtgtgccaggagacattccgccgaaggatggagctgcgggtgcacatggtgtctcacacaggggagatgccctacaagtgttcctcctgctcccagcagttcatgcagaagaaggacttgcagagccacatgatcaaacttcatggagcccccaagccccatgcatgccccacctgtgccaagtgcttcctgtctcggacagagctgcagctgcatgaagctttcaagcaccgtggtgagaagctgtttgtgtgtgaggagtgtgggcaccgggcctcgagccggaatggcctgcagatgcacatcaaggccaagcacaggaatgagaggccacacgtatgtgagttctgcagccacgccttcacccaaaaggccaatctcaacatgcacctgcgcacacacacgggtgagaagcccttccagtgccacctctgtggcaagaccttccgaacccaagccagcctggacaagcacaaccgcacccacaccggggaaaggcccttcagttgcgagttctgtgaacagcgcttcactgagaaggggcccctcctgaggcacgtggccagccgccatcaggagggccggccccacttctgccagatatgcggcaagaccttcaaagccgtggagcaactgcgtgtgcacgtcagacggcacaagggggtgaggaagtttgagtgcaccgagtgtggctacaagtttacccgacaggcccacctgcggaggcacatggagatccacgaccgggtagagaactacaacccgcggcagcgcaagctccgcaacctgatcatcgaggacgagaagatggtggtggtggcgctgcagccgcctgcagagctggaggtgggctcggcggaggtcattgtggagtccctggcccagggcggcctggcctcccagctccccggccagagactgtgtgcagaggagagcttcaccggcccaggtgtcctggagccctccctcatcatcacagctgctgtccccgaggactgtgacacatagcccattctggccaccagagcccacttggccccacccctcaataaaccgtgtggctttggactctcgta

SEQ ID NO: 75425 - DNA, 1930 bp, Homo sapiens
  misc_feature (53)..(53): n is a, c, g, or t
  misc_feature (56)..(56): n is a, c, g, or t
tcctctagagcggacgcctactactactactactactaagctgcgagaagacnacngaatgggggaaccgggatcaggtgctcctggcagccagggagttgcgagtgccagaggccgtagagctgtgccagagcttcaagcccaaaacttcagtgggacaggcagcaggtggccagagtgggctggggccccctgcctcccagaatgtgaacagccacgtcaaggagccggcaggcttggaagaagaggaagtttcgaggactctgggtctagtccccagggatcaggagcccagaggcagtcatagtcctcagaggccccagctccattccccagctcagagtgagggcccctcctccctctgtgggaaactgaagcaggccttgaagccttgtccccttgaggacaagaaacccgaggactgcaaagtgcccccaaggcccttagaggctgaaggtgcccagctgcagggcggcagtaatgagtgggaagtggtggttcaagtggaggatgatggggatggcgattacatgtctgagcctgaggctgtgctgaccaggaggaagtcaaatgtaatccgaaagccctgtgcagctgagccagccctgagcgcgggctccctagcagctgagcctgctgagaacagaaaaggtacagcggtgccggtcgaatgccccacatgtcataaaaagttcctcagcaaatattatctaaaagtccacaacaggaaacatactggggagaaaccctttgagtgtcccaaatgtgggaagtgttactttcggaaggagaacctcctggagcatgaagcccggaattgcatgaaccgctcggaacaggtcttcacgtgctctgtgtgccaggagacattccgccgaaggatggagctgcgggtgcacatggtgtctcacacaggggagatgccctacaagtgttcctcctgctcccagcagttcatgcagaagaaggacttgcagagccacatgatcaaacttcatggagcccccaagccccatgcatgccccacctgtgccaagtgcttcctgtctcggacagagctgcagctgcatgaagctttcaagcaccgtggtgagaagctgtttgtgtgtgaggagtgtgggcaccgggcctcgagccggaatggcctgcagatgcacatcaaggccaagcacaggaatgagaggccacacgtatgtgagttctgcagccacgccttcacccaaaaggccaatctcaacatgcacctgcgcacacacacgggtgagaagcccttccagtgccacctctgtggcaagaccttccgaacccaagccagcctggacaagcacaaccgcacccacaccggggaaaggcccttcagttgcgagttctgtgaacagcgcttcactgagaaggggcccctcctgaggcacgtggccagccgccatcaggagggccggccccacttctgccagatatgcggcaagaccttcaaagccgtggagcaactgcgtgtgcacgtcagacggcacaagggggtgaggaagtttgagtgcaccgagtgtggctacaagtttacccgacaggcccacctgcggaggcacatggagatccacgaccgggtagagaactacaacccgcggcagcgcaagctccgcaacctgatcatcgaggacgagaagatggtggtggtggcgctgcagccgcctgcagagctggaggtgggctcggcggaggtcattgtggagtccctggcccagggcggcctggcctcccagctccccggccagagactgtgtgcagaggagagcttcaccggcccaggtgtcctggagccctccctcatcatcacagctgctgtccccgaggactgtgacacatagcccattctggccaccagagcccacttggccccacccctcaataaaccgtgtggctttggactctcgta

SEQ ID NO: 75426 - DNA, 1574 bp, Homo sapiens
cgtccggcgcggagacggtggagtctccgcactgtcggcggggtacgcatagccgggcactaggttcgtgggctgtggaggcgacggagcagggggccagtggggccagctcagggaggacctgcctggtgggaagtggtggttcaagtggaggatgatggggatggcgattacatgtctgagcctgaggctgtgctgaccaggaggaagtcaaatgtaatccgaaagccctgtgcagctgagccagccctgagcgcgggctccctagcagctgagcctgctgagaacagaaaaggtacagcggtgccggtcgaatgccccacatgtcataaaaagttcctcagcaaatattatctaaaagtccacaacaggaaacatactggggagaaaccctttgagtgtcccaaatgtgggaagtgttactttcggaaggagaacctcctggagcatgaagcccggaattgcatgaaccgctcggaacaggtcttcacgtgctctgtgtgccaggagacattccgccgaaggatggagctgcgggtgcacatggtgtctcacacaggggagatgccctacaagtgttcctcctgctcccagcagttcatgcagaagaaggacttgcagagccacatgatcaaacttcatggagcccccaagccccatgcatgccccacctgtgccaagtgcttcctgtctcggacagagctgcagctgcatgaagctttcaagcaccgtggtgagaagctgtttgtgtgtgaggagtgtgggcaccgggcctcgagccggaatggcctgcagatgcacatcaaggccaagcacaggaatgagaggccacacgtatgtgagttctgcagccacgccttcacccaaaaggccaatctcaacatgcacctgcgcacacacacgggtgagaagcccttccagtgccacctctgtggcaagaccttccgaacccaagccagcctggacaagcacaaccgcacccacaccggggaaaggcccttcagttgcgagttctgtgaacagcgcttcactgagaaggggcccctcctgaggcacgtggccagccgccatcaggagggccggccccacttctgccagatatgcggcaagaccttcaaagccgtggagcaactgcgtgtgcacgtcagacggcacaagggggtgaggaagtttgagtgcaccgagtgtggctacaagtttacccgacaggcccacctgcggaggcacatggagatccacgaccgggtagagaactacaacccgcggcagcgcaagctccgcaacctgatcatcgaggacgagaagatggtggtggtggcgctgcagccgcctgcagagctggaggtgggctcggcggaggtcattgtggagtccctggcccagggcggcctggcctcccagctccccggccagagactgtgtgcagaggagagcttcaccggcccaggtgtcctggagccctccctcatcatcacagctgctgtccccgaggactgtgacacatagcccattctggccaccagagcccacttggccccacccctcaataaaccgtgtggctttggactctcgta

SEQ ID NO: 75427 - DNA, 1281 bp, Homo sapiens
gtgtgcggtgggcttgcagcactcagtgatggtcaggccaggcaggttatgtgttgccctctcccaccctagcgtccccaccctccccaggcagactcttcccagcagcaagcggaagcccgggcagaggctgctgtcataggcagaggcccccgctgatgccggccctgcttgcccctcacactgccaggtcttcacgtgctctgtgtgccaggagacattccgccgaaggatggagctgcgggtgcacatggtgtctcacacaggggagatgccctacaagtgttcctcctgctcccagcagttcatgcagaagaaggacttgcagagccacatgatcaaacttcatggagcccccaagccccatgcatgccccacctgtgccaagtgcttcctgtctcggacagagctgcagctgcatgaagctttcaagcaccgtggtgagaagctgtttgtgtgtgaggagtgtgggcaccgggcctcgagccggaatggcctgcagatgcacatcaaggccaagcacaggaatgagaggccacacgtatgtgagttctgcagccacgccttcacccaaaaggccaatctcaacatgcacctgcgcacacacacgggtgagaagcccttccagtgccacctctgtggcaagaccttccgaacccaagccagcctggacaagcacaaccgcacccacaccggggaaaggcccttcagttgcgagttctgtgaacagcgcttcactgagaaggggcccctcctgaggcacgtggccagccgccatcaggagggccggccccacttctgccagatatgcggcaagaccttcaaagccgtggagcaactgcgtgtgcacgtcagacggcacaagggggtgaggaagtttgagtgcaccgagtgtggctacaagtttacccgacaggcccacctgcggaggcacatggagatccacgaccgggtagagaactacaacccgcggcagcgcaagctccgcaacctgatcatcgaggacgagaagatggtggtggtggcgctgcagccgcctgcagagctggaggtgggctcggcggaggtcattgtggagtccctggcccagggcggcctggcctcccagctccccggccagagactgtgtgcagaggagagcttcaccggcccaggtgtcctggagccctccctcatcatcacagctgctgtccccgaggactgtgacacatagcccattctggccaccagagcccacttggccccacccctcaataaaccgtgtggctttggactctcgta

SEQ ID NO: 75428 - DNA, 2755 bp, Homo sapiens
  misc_feature (2297)..(2297): n is a, c, g, or t
cgtccggcgcggagacggtggagtctccgcactgtcggcggggagctttctcttgcataccctcgcttaggctggccggggtgtcacttctgcctccctgccctccagaccatggacggctccttcgtccagcacagtgtgagggttctgcaggagctcaacaagcagcgggagaagggccagtactgcgacgccactctggacgtggggggcctggtgtttaaggcacactggagtgtccttgcctgctgcagtcactttttccagagcctctacggggatggctcagggggcagtgtcgtcctccctgctggcttcgctgagatctttggcctcttgttggactttttctacactggtcacctcgctctcacctcagggaaccgggatcaggtgctcctggcagccagggagttgcgagtgccagaggccgtagagctgtgccagagcttcaagcccaaaacttcagtgggacaggcagcaggtggccagagtgggctggggccccctgcctcccagaatgtgaacagccacgtcaaggagccggcaggcttggaagaagaggaagtttcgaggactctgggtctagtccccagggatcaggagcccagaggcagtcatagtcctcagaggccccagctccattccccagctcagagtgagggcccctcctccctctgtgggaaactgaagcaggccttgaagccttgtccccttgaggacaagaaacccgaggactgcaaagtgcccccaaggcccttagaggctgaaggtgcccagctgcagggcggcagtaatgagtgggaagtggtggttcaagtggaggatgatggggatggcgattacatgtctgagcctgaggctgtgctgaccaggaggaagtcaaatgtaatccgaaagccctgtgcagctgagccagccctgagcgcgggctccctagcagctgagcctgctgagaacagaaaaggtacagcggtgccggtcgaatgccccacatgtcataaaaagttcctcagcaaatattatctaaaagtccacaacaggaaacatactggggagaaaccctttgagtgtcccaaatgtgggaagtgttactttcggaaggagaacctcctggagcatgaagcccggaattgcatgaaccgctcggaacaggtcttcacgtgctctgtgtgccaggagacattccgccgaaggatggagctgcgggtgcacatggtgtctcacacaggggagatgccctacaagtgttcctcctgctcccagcagttcatgcagaagaaggacttgcagagccacatgatcaaacttcatggagcccccaagccccatgcatgccccacctgtgccaagtgcttcctgtctcggacagagctgcagctgcatgaagctttcaagcaccgtggtgagaagctgtttgtgtgtgaggagtgtgggcaccgggcctcgagccggaatggcctgcagatgcacatcaaggccaagcacaggaatgagaggccacacgtatgtgagttctgcagccacgccttcacccaaaaggccaatctcaacatgcacctgcgcacacacacgggtgagaagcccttccagtgccacctctgtggcaagaccttccgaacccaagccagcctggacaagcacaaccgcacccacaccggggaaaggcccttcagttgcgagttctgtgaacagcgcttcactgagaaggggcccctcctgaggcacgtggccagccgccatcaggagggccggccccacttctgccagatatgcggcaagaccttcaaagccgtggagcaactgcgtgtgcacgtcagacggcacaagggggtgaggaagtttgagtgcaccgagtgtggctacaagtttacccgacaggcccacctgcggaggcacatggagatccacgaccgggtagagaactacaacccgcggcagcgcaagctccgcaacctgatcatcgaggacgagaagatggtggtggtggcgctgcagccgcctgcagagctggaggtgggctcggcggaggtcattgtggagtccctggcccagggcggcctggcctcccagctccccggccagagactgtgtgcagaggagagcttcaccggcccaggtgtcctggagccctccctcatcatcacagctgctgtccccgaggactgtgacacatagcccattctggccaccagagcccacttggccccacccctcaataaaccgtgtggctttggactctcgtaaaaaaaaaaaaaaaaaaaaaaaaaaaaaaaaaaaaaaaaaaaaaaaaaaanacaaaaaacaaaaaaggggcggggcgcgcaacaaaaatctcaatccccggaagggcgccacaaacacggccagcccccaccagcagagcacgaacaacacagaggcgggcccaacagaaaggggcggcggtatactcaaaacgacacgcagcgcggcgcgcaccgacacaccaacgcaacagaccggagaaaaagccggcaccacgcaggcggacaacccacgcggcagcacagcgcccaccccctcccctccctcgcgagcggcgggccacgcacaccacactgaggtgagaccaacaccaacaccaccaccacaaccgcacagaccacgtgcacaaccccaccgcacggcgcgcccaaccactccacccccacccacccacacggatagacacaacggtcggagcaaccgcacacccgccccccactctacccgccgcaaccccgcgcaccaacct

SEQ ID NO: 75429 - DNA, 2333 bp, Homo sapiens
cgtccggcgcggagacggtggagtctccgcactgtcggcggggtacgcatagccgggcactaggttcgtgggctgtggaggcgacggagcagggggccagtggggccagctcagggaggacctgcctgggagctttctcttgcataccctcgcttaggctggccggggtgtcacttctgcctccctgccctccagaccatggacggctccttcgtccagcacagtgtgagggttctgcaggagctcaacaagcagcgggagaagggccagtactgcgacgccactctggacgtggggggcctggtgtttaaggcacactggagtgtccttgcctgctgcagtcactttttccagagcctctacggggatggctcagggggcagtgtcgtcctccctgctggcttcgctgagatctttggcctcttgttggactttttctacactggtcacctcgctctcacctcagggaaccgggatcaggtgctcctggcagccagggagttgcgagtgccagaggccgtagagctgtgccagagcttcaagcccaaaacttcagtgggacaggcagcaggtggccagagtgggctggggccccctgcctcccagaatgtgaacagccacgtcaaggagccggcaggcttggaagaagaggaagtttcgaggactctgggtctagtccccagggatcaggagcccagaggcagtcatagtcctcagaggccccagctccattccccagctcagagtgagggcccctcctccctctgtgggaaactgaagcaggccttgaagccttgtccccttgaggacaagaaacccgaggactgcaaagtgcccccaaggcccttagaggctgaaggtgcccagctgcagggcggcagtaatgagtgggaagtggtggttcaagtggaggatgatggggatggcgattacatgtctgagcctgaggctgtgctgaccaggaggaagtcaaatgtaatccgaaagccctgtgcagctgagccagccctgagcgcgggctccctagcagctgagcctgctgagaacagaaaaggtacagcggtgccggtcgaatgccccacatgtcataaaaagttcctcagcaaatattatctaaaagtccacaacaggaaacatactggggagaaaccctttgagtgtcccaaatgtgggaagtgttactttcggaaggagaacctcctggagcatgaagcccggaattgcatgaaccgctcggaacaggtcttcacgtgctctgtgtgccaggagacattccgccgaaggatggagctgcgggtgcacatggtgtctcacacaggggagatgccctacaagtgttcctcctgctcccagcagttcatgcagaagaaggacttgcagagccacatgatcaaacttcatggagcccccaagccccatgcatgccccacctgtgccaagtgcttcctgtctcggacagagctgcagctgcatgaagctttcaagcaccgtggtgagaagctgtttgtgtgtgaggagtgtgggcaccgggcctcgagccggaatggcctgcagatgcacatcaaggccaagcacaggaatgagaggccacacgtatgtgagttctgcagccacgccttcacccaaaaggccaatctcaacatgcacctgcgcacacacacgggtgagaagcccttccagtgccacctctgtggcaagaccttccgaacccaagccagcctggacaagcacaaccgcacccacaccggggaaaggcccttcagttgcgagttctgtgaacagcgcttcactgagaaggggcccctcctgaggcacgtggccagccgccatcaggagggccggccccacttctgccagatatgcggcaagaccttcaaagccgtggagcaactgcgtgtgcacgtcagacggcacaagggggtgaggaagtttgagtgcaccgagtgtggctacaagtttacccgacaggcccacctgcggaggcacatggagatccacgaccgggtagagaactacaacccgcggcagcgcaagctccgcaacctgatcatcgaggacgagaagatggtggtggtggcgctgcagccgcctgcagagctggaggtgggctcggcggaggtcattgtggagtccctggcccagggcggcctggcctcccagctccccggccagagactgtgtgcagaggagagcttcaccggcccaggtgtcctggagccctccctcatcatcacagctgctgtccccgaggactgtgacacatagcccattctggccaccagagcccacttggccccacccctcaataaaccgtgtggctttggactctcgta

SEQ ID NO: 75430 - DNA, 2267 bp, Homo sapiens
cgtccggcgcggagacggtggagtctccgcactgtcggcggggtacgcatagccgggcactaggagctttctcttgcataccctcgcttaggctggccggggtgtcacttctgcctccctgccctccagaccatggacggctccttcgtccagcacagtgtgagggttctgcaggagctcaacaagcagcgggagaagggccagtactgcgacgccactctggacgtggggggcctggtgtttaaggcacactggagtgtccttgcctgctgcagtcactttttccagagcctctacggggatggctcagggggcagtgtcgtcctccctgctggcttcgctgagatctttggcctcttgttggactttttctacactggtcacctcgctctcacctcagggaaccgggatcaggtgctcctggcagccagggagttgcgagtgccagaggccgtagagctgtgccagagcttcaagcccaaaacttcagtgggacaggcagcaggtggccagagtgggctggggccccctgcctcccagaatgtgaacagccacgtcaaggagccggcaggcttggaagaagaggaagtttcgaggactctgggtctagtccccagggatcaggagcccagaggcagtcatagtcctcagaggccccagctccattccccagctcagagtgagggcccctcctccctctgtgggaaactgaagcaggccttgaagccttgtccccttgaggacaagaaacccgaggactgcaaagtgcccccaaggcccttagaggctgaaggtgcccagctgcagggcggcagtaatgagtgggaagtggtggttcaagtggaggatgatggggatggcgattacatgtctgagcctgaggctgtgctgaccaggaggaagtcaaatgtaatccgaaagccctgtgcagctgagccagccctgagcgcgggctccctagcagctgagcctgctgagaacagaaaaggtacagcggtgccggtcgaatgccccacatgtcataaaaagttcctcagcaaatattatctaaaagtccacaacaggaaacatactggggagaaaccctttgagtgtcccaaatgtgggaagtgttactttcggaaggagaacctcctggagcatgaagcccggaattgcatgaaccgctcggaacaggtcttcacgtgctctgtgtgccaggagacattccgccgaaggatggagctgcgggtgcacatggtgtctcacacaggggagatgccctacaagtgttcctcctgctcccagcagttcatgcagaagaaggacttgcagagccacatgatcaaacttcatggagcccccaagccccatgcatgccccacctgtgccaagtgcttcctgtctcggacagagctgcagctgcatgaagctttcaagcaccgtggtgagaagctgtttgtgtgtgaggagtgtgggcaccgggcctcgagccggaatggcctgcagatgcacatcaaggccaagcacaggaatgagaggccacacgtatgtgagttctgcagccacgccttcacccaaaaggccaatctcaacatgcacctgcgcacacacacgggtgagaagcccttccagtgccacctctgtggcaagaccttccgaacccaagccagcctggacaagcacaaccgcacccacaccggggaaaggcccttcagttgcgagttctgtgaacagcgcttcactgagaaggggcccctcctgaggcacgtggccagccgccatcaggagggccggccccacttctgccagatatgcggcaagaccttcaaagccgtggagcaactgcgtgtgcacgtcagacggcacaagggggtgaggaagtttgagtgcaccgagtgtggctacaagtttacccgacaggcccacctgcggaggcacatggagatccacgaccgggtagagaactacaacccgcggcagcgcaagctccgcaacctgatcatcgaggacgagaagatggtggtggtggcgctgcagccgcctgcagagctggaggtgggctcggcggaggtcattgtggagtccctggcccagggcggcctggcctcccagctccccggccagagactgtgtgcagaggagagcttcaccggcccaggtgtcctggagccctccctcatcatcacagctgctgtccccgaggactgtgacacatagcccattctggccaccagagcccacttggccccacccctcaataaaccgtgtggctttggactctcgta

SEQ ID NO: 75431 - DNA, 1757 bp, Homo sapiens
cccgggccctttctctgaatggggaagcactggggatacgtgagccaagaggtactgaggtctgacttaaaggtccttctggctcctgaactgaaacctgtgggggaggcagtcacggagcggggagaccagatgggcagctcccctggctacctgggagaagctgttgccagccttggtgggccagtggagtcaggtgaggatctggccatgggtttgaagctctgggaagactgagttgcttctccaatagtcaggacccaagatctgtttctgccttcagacagaatgcggtcagctgggcctccctgtcggcctctgtgctggccagatccatggcagcctcttaggacctgtgtgagcttcttgccactgcactctcccttgcagagtctccatgctgggggaggcttctgggcttgtccctgcaccttaaccagccggtgtcacctgagaacacttgttccccttagaagggacccagagggggccctgggtgagggagagatgggaaaccctctcagcccccccacccctgtggcttctcctggcaggaaacatactggggagaaaccctttgagtgtcccaaatgtgggaagtgttactttcggaaggagaacctcctggagcatgaagcccggaattgcatgaaccgctcggaacaggtcttcacgtgctctgtgtgccaggagacattccgccgaaggatggagctgcgggtgcacatggtgtctcacacaggggagatgccctacaagtgttcctcctgctcccagcagttcatgcagaagaaggacttgcagagccacatgatcaaacttcatggagcccccaagccccatgcatgccccacctgtgccaagtgcttcctgtctcggacagagctgcagctgcatgaagctttcaagcaccgtggtgagaagctgtttgtgtgtgaggagtgtgggcaccgggcctcgagccggaatggcctgcagatgcacatcaaggccaagcacaggaatgagaggccacacgtatgtgagttctgcagccacgccttcacccaaaaggccaatctcaacatgcacctgcgcacacacacgggtgagaagcccttccagtgccacctctgtggcaagaccttccgaacccaagccagcctggacaagcacaaccgcacccacaccggggaaaggcccttcagttgcgagttctgtgaacagcgcttcactgagaaggggcccctcctgaggcacgtggccagccgccatcaggagggccggccccacttctgccagatatgcggcaagaccttcaaagccgtggagcaactgcgtgtgcacgtcagacggcacaagggggtgaggaagtttgagtgcaccgagtgtggctacaagtttacccgacaggcccacctgcggaggcacatggagatccacgaccgggtagagaactacaacccgcggcagcgcaagctccgcaacctgatcatcgaggacgagaagatggtggtggtggcgctgcagccgcctgcagagctggaggtgggctcggcggaggtcattgtggagtccctggcccagggcggcctggcctcccagctccccggccagagactgtgtgcagaggagagcttcaccggcccaggtgtcctggagccctccctcatcatcacagctgctgtccccgaggactgtgacacatagcccattctggccaccagagcccacttggccccacccctcaataaaccgtgtggctttggactctcgta

SEQ ID NO: 75432 - DNA, 2716 bp, Homo sapiens
  misc_feature (2258)..(2258): n is a, c, g, or t
cgtccggcgcggagacggtggagtctccgcactgtcggcggggagctttctcttgcataccctcgcttaggctggccggggtgtcacttctgcctccctgccctccagaccatggacggctccttcgtccagcacagtgtgagggttctgcaggagctcaacaagcagcgggagaagggccagtactgcgacgccactctggacgtggggggcctggtgtttaaggcacactggagtgtccttgcctgctgcagtcactttttccagagcctctacggggatggctcagggggcagtgtcgtcctccctgctggcttcgctgagatctttggcctcttgttggactttttctacactggtcacctcgctctcacctcagggaaccgggatcaggtgctcctggcagccagggagttgcgagtgccagaggccgtagagctgtgccagagcttcaagcccaaaacttcagtgggacaggcagcaggtggccagagtgggctggggccccctgcctcccagaatgtgaacagccacgtcaaggagccggcaggcttggaagaagaggaagtttcgaggactctgggtctagtccccagggatcaggagcccagaggcagtcatagtcctcagaggccccagctccattccccagctcagagtgagggcccctcctccctctgtgggaaactgaagcaggccttgaagccttgtccccttgaggacaagaaacccgaggactgcaaagtgcccccaaggcccttagaggctgaaggtgcccagctgcagggcggcagtaatgagtgggaagtggtggttcaagtggaggatgatggggatggcgattacatgtctgagcctgaggctgtgctgaccaggaggaagtcaaatgtaatccgaaagccctgtgcagctgagccagccctgagcgcgggctccctagcagctgagcctgctgagaacagaaaaggtacagcggtgccggtcgaatgccccacatgtcataaaaagttcctcagcaaatattatctaaaagtccacaacaggaaacatactggggagaaaccctttgagtgtcccaaatgtgggaagtgttactttcggaaggagaacctcctggagcatgaagcccggaattgcatgaaccgctcggaacaggtcttcacgtgctctgtgtgccaggagacattccgccgaaggatggagctgcgggtgcacatggtgtctcacacaggggagatgccctacaagtgttcctcctgctcccagcagttcatgcagaagaaggacttgcagagccacatgatcaaacttcatggagcccccaagccccatgcatgccccacctgtgccaagtgcttcctgtctcggacagagctgcagctgcatgaagctttcaagcaccgtggtgagaagctgtttgtgtgtgaggagtgtgggcaccgggcctcgagccggaatggcctgcagatgcacatcaaggccaagcacaggaatgagaggccacacgtatgtgagttctgcagccacgccttcacccaaaaggccaatctcaacatgcacctgcgcacacacacgggtgagaagcccttccagtgccacctctgtggcaagaccttccgaacccaagccagcctggacaagcacaaccgcacccacaccggggaaaggcccttcagttgcgagttctgtgaacagcgcttcactgagaaggggcccctcctgaggcacgtggccagccgccatcaggagggccggccccacttctgccagatatgcggcaagaccttcaaagccgtggagcaactgcgtgtgcacgtcagacggcacaagggggtgaggaagtttgagtgcaccgagtgtggctacaagtttacccgacaggcccacctgcggaggcacatggagatccacgaccgggtagagaactacaacccgcggcagcgcaagctccgcaacctgatcatcgaggacgagaagatggtggtggtggcgctgcagccgcctgcagagctggaggtgggctcggcggaggtcattgtggagtccctggcccagggcggcctggcctcccagctccccggccagagactgtgtgcagaggagagcttcaccggcccaggtgtcctggagccctccctcatcatcacagctgctgtccccgaggactgtgacacatagcccattctggccaccagagcccacttggccccacccctcaataaaccgtgtggctttggactctcgtaaaaaaaaaaaanacaaaaaacaaaaaaggggcggggcgcgcaacaaaaatctcaatccccggaagggcgccacaaacacggccagcccccaccagcagagcacgaacaacacagaggcgggcccaacagaaaggggcggcggtatactcaaaacgacacgcagcgcggcgcgcaccgacacaccaacgcaacagaccggagaaaaagccggcaccacgcaggcggacaacccacgcggcagcacagcgcccaccccctcccctccctcgcgagcggcgggccacgcacaccacactgaggtgagaccaacaccaacaccaccaccacaaccgcacagaccacgtgcacaaccccaccgcacggcgcgcccaaccactccacccccacccacccacacggatagacacaacggtcggagcaaccgcacacccgccccccactctacccgccgcaaccccgcgcaccaacct

SEQ ID NO: 75433 - DNA, 737 bp, Homo sapiens
ggtggggacacaggtcctgagggcggaagggacaggcataggagggactctgtgggaggcatttggggttggctttcctaggcccctggcccacctccaccttggctttggagaaggggagccgctacaggggatggcagctgggaaaggccccctggccacccccagcaaccccactgctggcttctgtgtcagggcccgccgaaacccaggcccactcttcctagaggcctgtcagcagccactagggccagggactgtgggtgaggccactcggaccctgcccccagtctgtctgggcctgagaagggcctggtgtgcggtgggcttgcagcactcagtgatggtcaggccaggcaggttatgtgttgccctctcccaccctagcgtccccaccctccccaggcagactcttcccagcagcaagcggaagcccgggcagaggctgctgtcataggcagaggcccccgctgatgccggccctgcttgcccctcacactgccaggtcttcacgtgctctgtgtgccaggagacattccgccgaaggatggagctgcgggtgcacatggtgtctcacacaggggagatgccctacaaggtcaggcttggcctgtctccagggccagggttgggtggccccaggatccttcctgctgagccctttacgtggggtgctgtcaggcacctccctcacagtagctgtcagggagcctgccttccctgccttccctgccttt

SEQ ID NO: 75434 - DNA, 4638 bp, Homo sapiens
agggttcacaggtcagagttgactccctgaaaagtgcagccggtttgaaatgcaagatggcggcggcgtggcgctgagaggcgcggcggcccctgcaggagaagacagactgctgctttggacctgttggtaatgatggcctgagctaaacatctaactagaagggatacccttccatttcaaagaacagaatgctaaggaagctgtggcaagtgattggagttgtgcttcaaaaatttcagaaattcagcagtattttatctgccaacaataagctctttacttgattgcaccatgagaaagctgctaatgagacttgttgagcacaaaaatggacttgaagaaccaaaagccattgttttcaaatgaagaacactgaacagttttaagcctcgatgctttttaatcaccactgagcttttcctcataacatcagaatggcaagcaggcgaaaatcaacaacaccttgcatggtccttgccagtgaacaagatccagaccttgagttgatatcagatttggatgaaggtcctcctgtgcttacacctgtagaaaacaccagagcagagagtatctcaagtgatgaagaggttcatgaatctgtggattcagacaatcagcaaaataaaaaagttgaaggtggatatgaatgtaaatattgtacttttcaaactccagatctaaatatgtttacttttcatgtggattcggaacatcccaatgtagtgctaaattcatcctatgtttgtgtcgaatgcaattttcttaccaaaaggtatgatgcactttctgagcataatctgaaatatcacccaggagaagagaattttaagttgactatggtgaaacgtaataaccagacaatctttgaacaaacaataaatgatctgacttttgatggtagttttgttaaagaggagaatgcagagcaagcagaatctacagaagtttcttcttcgggaatatctatcagtaaaactcctatcatgaaaatgatgaaaaataaagtggaaaataaacggattgcagttcatcataactcagttgaggacgttcctgaagagaaagagaatgaaatcaaaccagaccgtgaagaaattgtagaaaatccaagttcttcagcttctgaatctaatacaagtacttccattgtaaacagaatacatccaagtactgccagcacggtagtgacaccagcagcagttcttcctggattggcacaggtgataactgctgtatctgctcagcagaattctaatttgattcccaaagtcttaatccctgttaatagcattcccacctacaatgctgcattggataacaatccccttttacttaacacctacaacaagttcccttacccaacaatgtcagaaattacagttctttctgctcaagcaaaatatacagaggaacagatcaagatatggttttcagcccaacgtttaaaacatggtgttagttggactcccgaggaagtagaggaggcaagaaggaaacaattcaatggaacagtgcatactgtacctcagaccataactgttattcctacacacatttccacagggagtaatggtttaccatctattttacagacatgccaaatagttggtcagcctggtctggtccttactcaagtggctggaacaaacaccttgccagttacagcacctatagccttgacagtggcaggcgttccaagtcaaaataatatacagaaaagtcaggtacctgctgctcagcctactgcagaaacaaagccagcaacagcagcagttccaacttctcaaagtgtcaaacatgaaactgcattggtaaaccctgattcatttggcattcgggcaaaaaagacaaaagagcaactggcagaattaaaagttagctaccttaaaaatcagtttccccatgattcagaaattatcagacttatgaaaataacaggcctgacgaaaggagagattaaaaaatggtttagtgacacaaggtacaaccagagaaattcaaagagtaatcagtgcttacatctcaacaatgattcctctaccaccattattatagactccagtgatgaaaccacggaatccccaactgttggtactgcacagcctaagcaatcctggaatccttttcctgactttactccccaaaagtttaaagagaaaactgcagagcagcttcgtgtccttcaggcaagttttctcaacagctctgtacttacagatgaagaattaaataggttaagggcacaaaccaaacttaccagaagagaaatcgatgcttggtttacagagaagaagaaatcaaaagctttaaaggaagagaaaatggaaatagatgaaagtaatgcaggtagttccaaagaagaagctggagaaacttctcctgcagatgaatctggtgcacctaagtcagggagtacaggcaagatatgtaaaaaaacacctgagcagctgcacatgcttaagagtgcatttgtccggacacagtggccatcaccagaagagtatgacaagttggccaaagaaagcgggcttgctagaacagacatagttagttggtttggggacacccgttatgcttggaagaatggaaacttgaaatggtactactactatcagagcgccaattcaagtagtatgaatggtctgtcttcccttaggaaaagagggagagggagacccaaaggacggggaagaggaagaccgcgtgggcggcctagaggaagcaaaagaattaacaactgggacaggggaccatcactcataaaatttaaaactggaactgcaatacttaaggattattacctgaagcacaagtttcttaatgagcaagaccttgatgaacttgttaacaaatcacatatgggctatgagcaggtcagagagtggtttgcagaaagacagagaagatcagaattaggtatagaattatttgaggaaaatgaggaggaagatgaagttattgatgaccaggaagaggatgaagaagaaacagatgatagtgacacttgggaacctccacgacatgtgaaacggaagctgtctaaatcagatgactgaaatctgcctaaaacgttgaaggagaatcaattcttcaactcaagatgtctgatttactgtgaatttgcccaatctttgatgacattgaaaacgttttggggcatacacactcaaaaagcaggatccaatacccaaaagaaatggaacttaatgttgtgccaaagttaaactactgcagttggtggaagttctgcaatgtaaatagaacactaattaaaaaacaacttgtaaaaatgcaatttaaattttaatacagtacatttttcttctaatatgatggagacattctgaatcttagactttctgagggggtttaatgaccactagagcttgtcctcatattcagtccagtttaatactgtatgtctagtaagatgggctatatattgcctctattctttgagatgtgattaagcttagaactttgaccaaaaattttacagtaaaaattgttagaaatgggtaaaaaaaaaaaaaaaaaaaaaccctgatttattactatgtcttatttatcagaccctgcactaagattaaaagttgtgcatgggcttatacaatttcaaatgtaaaaacagcctatttatatatgttgaaacaataagattttatggtttcactggcccttaataattggatccttcattaaacacatccatgaataccactgtttctactgttacttgttccattagaagctgatttgctttttattaaactgcaggaaattaattctgaagaaggaaaagaaactgacatggtaatttggatagggtgaagctttgaaataaatactgcaccaaaaatgtgaaaaagaatcacgtagtaaatgtatacttagtgttttcttacaatcgtggaaatcagaaatgtttatacaggtgtcagatcagaatttttaagagttatctttcagtgaaattttataacagtttcagtgaatagagaaaaaattctgaactgatcataatgagttaaaagttagcttttcacttatgaatcatgggagtgttaactgttaactcttgccgtatcaggagactgaaagttcatactaatttacaaactttgtaaagactggtgctgttcattcatattgggaagaaccctttcttttgtgaccataggaccatttttcaaaatgcgctttcttcgtagaagaaatgttcagtttaattagctttggattttaacatgtttttctgaatgaccagatgtaggcttagccagtttattttctctaatttaatggataataaatattaagctcttggttaaatgtttttcagccattgaaaatgttatgaaaaagccttgaatatgcatgctgctttcatttttataaactttttattttttaactatagctttattagtaattccaaaatgctgcaatgtagctgatttcctcactcagacagctggctttgtgggtggcttttttcatactactgttaacttttttaaaaaagaagcaatgtaaagaccgtaatgcactaagctttttttttttcttttacacgtttaaaaacttcttaaagcactctgtaatataatgattaaattgctcccttttataaac

SEQ ID NO: 75435 - DNA, 1291 bp, Homo sapiens
cgcttcctcgttgcccccgccgcgggcgcgagatggattccgggtgctggttgttcggcggcgagttcgaggactcggtgttcgaggagaggccggagcggcggtcaggaccgcccgcgtcctactgcgccaagctctgcgagccgcagtggttttatgaagaaacagaaagcagtgatgatgttgaagtgctgactctcaagaaattcaaaggagacctggcctacagacgacaagagtatcagaaagcactgcaggagtattccagtatctctgaaaaattgtcatcaaccaattttgccatgaaaagggatgtccaggaaggtcaggctcggtgtctggctcacctgggtaggcatatggaggcgctggagattgctgcaaacttggaaaataaagcaaccaacacagaccatttaaccacggtactctacctccagcttgctatttgttcaagtttgcagaacttggagaaaacaattttctgcctgcagaaactgatttctttgcatccttttaatccttggaactggggcaaattggcagaggcttacctgaatctggggccagctctttcagcagcacttgcgtcatctcagaaacagcacagtttcacctcaagtgacaaaactatcaaatccttctttccacactcaggaaaagactgtcttttgtgttttcctgaaaccttgcctgagagctctttattttctgtggaagcgaatagcagtaatagccagaaaaatgagaaagctctgacaaatatccaaaactgtatggcagaaaagagagaaacagtgttgatagagactcagctgaaagcatgtgcctcttttatacgaaccaggcttctgcttcagtttacccaacctcagcaaacatcgtttgctttggagaggaacttaaggactcagcaggaaattgaagataaaatgaaagggttcagcttcaaagaagacactttgctgttgatagctgaggttatgggagaagatatcccagaaaaaataaaagatgaagttcacccagaggtgaagtgtgttggctccgtagccctgactgccttggtgactgtatcctcagaagaatttgaagacaagtggttcagaaagatcaaagaccatttctgtccatttgaaaatcagttccatacagagatacaaatcttggcttagtgggttataaaaaacaaaaccacaaatatcttgtactgtattaattgtccttgtttacttcagacaggatccattgctaatcatggagtataaatgattatttatgttttataaaa

SEQ ID NO: 75436 - DNA, 1701 bp, Homo sapiens
  misc_feature (751)..(751): n is a, c, g, or t
  misc_feature (753)..(753): n is a, c, g, or t
  misc_feature (778)..(780): n is a, c, g, or t
  misc_feature (809)..(809): n is a, c, g, or t
  misc_feature (817)..(817): n is a, c, g, or t
  misc_feature (829)..(829): n is a, c, g, or t
  misc_feature (833)..(833): n is a, c, g, or t
  misc_feature (839)..(840): n is a, c, g, or t
  misc_feature (847)..(847): n is a, c, g, or t
  misc_feature (849)..(850): n is a, c, g, or t
  misc_feature (872)..(872): n is a, c, g, or t
  misc_feature (881)..(881): n is a, c, g, or t
  misc_feature (888)..(889): n is a, c, g, or t
  misc_feature (893)..(894): n is a, c, g, or t
  misc_feature (901)..(901): n is a, c, g, or t
  misc_feature (903)..(903): n is a, c, g, or t
  misc_feature (948)..(948): n is a, c, g, or t
  misc_feature (951)..(951): n is a, c, g, or t
  misc_feature (954)..(954): n is a, c, g, or t
  misc_feature (964)..(964): n is a, c, g, or t
  misc_feature (985)..(985): n is a, c, g, or t
  misc_feature (987)..(988): n is a, c, g, or t
  misc_feature (993)..(993): n is a, c, g, or t
  misc_feature (1005)..(1005): n is a, c, g, or t
  misc_feature (1017)..(1017): n is a, c, g, or t
ttcagtgtgtgcgtgtgttttaaatatgttctactttgatcatttcattttgttctatgagttctgcagtgactcagaagttccatgatactataactggagtaattttgctgtatttttagccatgtcctccaagcctcccagtatatgctgtgatctttgccaaacagaatctgatcagtgttacaggggaaatgatgtgtgaggctctacaaggagagggtctccagggcccacacctgagtcatgccttgaagcaacctcagcacacttagcctcccagtgattctgtgcaagtctgtctcaatcttttgagcttatgttagttctttgggggaaaaaaaatagaaacaacttctgaatagggcagtatgtttggggcagctttgtgaatacatatctaaaattacctccatttgccattttttaaatcaattttttttcaagcaatcagattcttttctcctagaggagctgtgggcaagaaaactaatgaattctacatccttctcatcacctggtttaaattgttttctgctctgagtaaacagtaattactgtttaagtacatctcagcagaattttatcccaattgcaacagttcatgttcctcctaatgtaatctctgcggaggaaatgatcgtcaagggaagcaggctgacctgctcacgggatggcgttcttacaatctgcatcttatgtaatggtgattctgtgtgcctgtgtcataattattggaatattattttangnttttttttttttgagacggagtctnnntctgtcgcccaggctggagtgcagtggcncgatctcngctcactgcaanctcncctccnnggttcangnnattctgcctcagtctcccaagnagctgggantacaggnncccnncaccacncncagctaatttttttttgtatttttagtagagacggggtttcactnttngcnaggatggttnatctcctgaccttgtgatccncnngcctnggcctcccaaantgctgggattanaggcgtgagccactgcacccagcctattctatgcattttttaacattacaatttattttgtgccatgttctgacttttaagtcattaaatcgtcttgaaaatgaggaggaagatgaagttattgatgaccaggaagaggatgaagaagaaacagatgatagtgacacttgggaacctccacgacatgtgaaacggaagctgtctaaatcagatgactgaaatctgcctaaaacgttgaaggagaatcaattcttcaactcaagatgtctgatttactgtgaatttgcccaatctttgatgacattgaaaacgttttggggcatacacactcaaaaagcaggatccaatacccaaaagaaatggaacttaatgttgtgccaaagttaaactactgcagttggtggaagttctgcaatgtaaatagaacactaattaaaaaacaacttgtaaaaatgcaatttaaattttaatacagtacatttttcttctaatatgatggagacattctgaatcttagactttctgagggggtttaatgaccactagagcttgtcctcatattcagtccagtttaatactgtatgtctagtaagatgggctatatattgcctctattctttgagatgtgattaagcttagaactttgaccaaaaattttacagtaaaaattgttagaaatgggta

SEQ ID NO: 75437 - DNA, 433 bp, Homo sapiens
cgcttcctcgttgcccccgccgcgggcgcgagatggattccgggtgctggttgttcggcggcgagttcgaggactcggtgttcgaggagaggccggagcggcggtcaggaccgcccgcgtcctactgcgccaagctctgcgagccgcagtggttttatgaagaaacagaaagcagtgatgatgttgaagtgctgactctcaagaaattcaaaggagacctggcctacagacgacaagagtatcagaaagcactgcaggagtattccagtatctctgaaaaattgtcatcaaccaattttgccatgaaaagggatgtccaggaaggtcaggctcggtgtctggctcacctgggtaggcatatggaggcgctggagattgctgcaaacttggaaaataaagcaactcgaaagccccaagcggggtaccgagctcg

SEQ ID NO: 75438 - DNA, 509 bp, Homo sapiens
aagatcgggcacagtcagggtggtatggccatagacggataactacttctgaacaaacatcttttcaatgtgttgggaatgtcccctggctgctcaagtattttctgcctttgaatgaaagccttcgcagttgataactagcattccatgtctctgcctcttttattgggacagtttttttttttcctcctgttataggttatgggagaagatatcccagaaaaaataaaagatgaagttcacccagaggtgaagtgtgttggctccgtagccctgactgccttggtgactgtatcctcagaagaatttgaagacaagtggttcagaaagatcaaagaccatttctgtccatttgaaaatcagttccatacagagatacaaatcttggcttagtgggttataaaaaacaaaaccacaaatatcttgtactgtattaattgtccttgtttacttcagacaggatccattgctaatcatggagtataaatgattatttatgttttataaaa

SEQ ID NO: 75439 - DNA, 461 bp, Homo sapiens
  misc_feature (24)..(24): n is a, c, g, or t
  misc_feature (26)..(28): n is a, c, g, or t
  misc_feature (420)..(420): n is a, c, g, or t
ttaaggccaacgaggccacttttnannntgtaatttcctttagggattcattttaaaacattttaaaatttattttaatgtaggtgattggagttgtgcttcaaaaatttcagaaattcagcagtattttatctgccaacaataagctctttacttgattgcaccatgagaaagctgctaatgagacttgttgagcacaaaaatggacttgaagaaccaaaagccattgttttcaaatgaagaacactgaacagttttaagcctcgatgctttttaatcaccactgagcttttcctcataacatcagaatggcaagcaggcgaaaatcaacaacaccttgcatggtccttgccagtgaacaagatccagaccttgagttgatatcagatttggatgaaggtcctcctgtgcttacacctncacgggtcggttcttttgtaaaagtatgtaacctataacgt

SEQ ID NO: 75440 - DNA, 388 bp, Homo sapiens
  misc_feature (39)..(39): n is a, c, g, or t
cagataccctcaattatttacaacatacctaatatttcntcccccgtaggtgttgcgcagagatttctcaaaaaataaaagatgaagttcacccagaggtgaagtgtgttggctccgtagccctgactgccttggtgactgtatcctcagaagaatttgaagacaagtggttcagaaagatcaaagaccatttctgtccatttgaaaatcagttccatacagagatacaaatcttggcttagtgggttataaaaaacaaaaccacaaatatcttgtactgtattaattgtccttgtttacttcagacaggatccattgctaatcatggagtataaatgattatttatgttttataaaactggcttctgtctcaaatgatttctactgc

SEQ ID NO: 75441 - DNA, 539 bp, Homo sapiens
aagatcgggcacagtcagggtggtatggccatagacggataactacttctgaacaaacatcttttcaatgtgttgggaatgtcccctggctgctcaagtattttctgcctttgaatgaaagccttcgcagttgataactagcattccatgtctctgcctcttttattgggacagtttttttttttcctcctgttataggttatgggagaagatatcccagaaaaaataaaagatgaagttcacccagaggtgaagtgtgttggctccgtagccctgactgccttggtgactgtatcctcagaagaatttgaagacaagtggttcagaaagatcaaagaccatttctgtccatttgaaaatcagttccatacagagatacaaatcttggcttagtgggttataaaaaacaaaaccacaaatatcttgtactgtattaattgtccttgtttacttcagacaggatccattgctaatcatggagtataaatgattatttatgttttataaaactggcttctgtctcaaatgatttctactgc

SEQ ID NO: 75442 - DNA, 4733 bp, Homo sapiens
agggttcacaggtcagagttgactccctgaaaagtgcagccggtttgaaatgcaagatggcggcggcgtggcgctgagaggcgcggcggcccctgcaggtagtggcgcgagccggctccgcgaccagcgggcccggagactctgggctgcgggtgggaactggagcgcagagtccgcggccggcacgggaaaggagaagacagactgctgctttggacctgttggtaatgatggcctgagctaaacatctaactagaagggatacccttccatttcaaagaacagaatgctaaggaagctgtggcaagtgattggagttgtgcttcaaaaatttcagaaattcagcagtattttatctgccaacaataagctctttacttgattgcaccatgagaaagctgctaatgagacttgttgagcacaaaaatggacttgaagaaccaaaagccattgttttcaaatgaagaacactgaacagttttaagcctcgatgctttttaatcaccactgagcttttcctcataacatcagaatggcaagcaggcgaaaatcaacaacaccttgcatggtccttgccagtgaacaagatccagaccttgagttgatatcagatttggatgaaggtcctcctgtgcttacacctgtagaaaacaccagagcagagagtatctcaagtgatgaagaggttcatgaatctgtggattcagacaatcagcaaaataaaaaagttgaaggtggatatgaatgtaaatattgtacttttcaaactccagatctaaatatgtttacttttcatgtggattcggaacatcccaatgtagtgctaaattcatcctatgtttgtgtcgaatgcaattttcttaccaaaaggtatgatgcactttctgagcataatctgaaatatcacccaggagaagagaattttaagttgactatggtgaaacgtaataaccagacaatctttgaacaaacaataaatgatctgacttttgatggtagttttgttaaagaggagaatgcagagcaagcagaatctacagaagtttcttcttcgggaatatctatcagtaaaactcctatcatgaaaatgatgaaaaataaagtggaaaataaacggattgcagttcatcataactcagttgaggacgttcctgaagagaaagagaatgaaatcaaaccagaccgtgaagaaattgtagaaaatccaagttcttcagcttctgaatctaatacaagtacttccattgtaaacagaatacatccaagtactgccagcacggtagtgacaccagcagcagttcttcctggattggcacaggtgataactgctgtatctgctcagcagaattctaatttgattcccaaagtcttaatccctgttaatagcattcccacctacaatgctgcattggataacaatccccttttacttaacacctacaacaagttcccttacccaacaatgtcagaaattacagttctttctgctcaagcaaaatatacagaggaacagatcaagatatggttttcagcccaacgtttaaaacatggtgttagttggactcccgaggaagtagaggaggcaagaaggaaacaattcaatggaacagtgcatactgtacctcagaccataactgttattcctacacacatttccacagggagtaatggtttaccatctattttacagacatgccaaatagttggtcagcctggtctggtccttactcaagtggctggaacaaacaccttgccagttacagcacctatagccttgacagtggcaggcgttccaagtcaaaataatatacagaaaagtcaggtacctgctgctcagcctactgcagaaacaaagccagcaacagcagcagttccaacttctcaaagtgtcaaacatgaaactgcattggtaaaccctgattcatttggcattcgggcaaaaaagacaaaagagcaactggcagaattaaaagttagctaccttaaaaatcagtttccccatgattcagaaattatcagacttatgaaaataacaggcctgacgaaaggagagattaaaaaatggtttagtgacacaaggtacaaccagagaaattcaaagagtaatcagtgcttacatctcaacaatgattcctctaccaccattattatagactccagtgatgaaaccacggaatccccaactgttggtactgcacagcctaagcaatcctggaatccttttcctgactttactccccaaaagtttaaagagaaaactgcagagcagcttcgtgtccttcaggcaagttttctcaacagctctgtacttacagatgaagaattaaataggttaagggcacaaaccaaacttaccagaagagaaatcgatgcttggtttacagagaagaagaaatcaaaagctttaaaggaagagaaaatggaaatagatgaaagtaatgcaggtagttccaaagaagaagctggagaaacttctcctgcagatgaatctggtgcacctaagtcagggagtacaggcaagatatgtaaaaaaacacctgagcagctgcacatgcttaagagtgcatttgtccggacacagtggccatcaccagaagagtatgacaagttggccaaagaaagcgggcttgctagaacagacatagttagttggtttggggacacccgttatgcttggaagaatggaaacttgaaatggtactactactatcagagcgccaattcaagtagtatgaatggtctgtcttcccttaggaaaagagggagagggagacccaaaggacggggaagaggaagaccgcgtgggcggcctagaggaagcaaaagaattaacaactgggacaggggaccatcactcataaaatttaaaactggaactgcaatacttaaggattattacctgaagcacaagtttcttaatgagcaagaccttgatgaacttgttaacaaatcacatatgggctatgagcaggtcagagagtggtttgcagaaagacagagaagatcagaattaggtatagaattatttgaggaaaatgaggaggaagatgaagttattgatgaccaggaagaggatgaagaagaaacagatgatagtgacacttgggaacctccacgacatgtgaaacggaagctgtctaaatcagatgactgaaatctgcctaaaacgttgaaggagaatcaattcttcaactcaagatgtctgatttactgtgaatttgcccaatctttgatgacattgaaaacgttttggggcatacacactcaaaaagcaggatccaatacccaaaagaaatggaacttaatgttgtgccaaagttaaactactgcagttggtggaagttctgcaatgtaaatagaacactaattaaaaaacaacttgtaaaaatgcaatttaaattttaatacagtacatttttcttctaatatgatggagacattctgaatcttagactttctgagggggtttaatgaccactagagcttgtcctcatattcagtccagtttaatactgtatgtctagtaagatgggctatatattgcctctattctttgagatgtgattaagcttagaactttgaccaaaaattttacagtaaaaattgttagaaatgggtaaaaaaaaaaaaaaaaaaaaaccctgatttattactatgtcttatttatcagaccctgcactaagattaaaagttgtgcatgggcttatacaatttcaaatgtaaaaacagcctatttatatatgttgaaacaataagattttatggtttcactggcccttaataattggatccttcattaaacacatccatgaataccactgtttctactgttacttgttccattagaagctgatttgctttttattaaactgcaggaaattaattctgaagaaggaaaagaaactgacatggtaatttggatagggtgaagctttgaaataaatactgcaccaaaaatgtgaaaaagaatcacgtagtaaatgtatacttagtgttttcttacaatcgtggaaatcagaaatgtttatacaggtgtcagatcagaatttttaagagttatctttcagtgaaattttataacagtttcagtgaatagagaaaaaattctgaactgatcataatgagttaaaagttagcttttcacttatgaatcatgggagtgttaactgttaactcttgccgtatcaggagactgaaagttcatactaatttacaaactttgtaaagactggtgctgttcattcatattgggaagaaccctttcttttgtgaccataggaccatttttcaaaatgcgctttcttcgtagaagaaatgttcagtttaattagctttggattttaacatgtttttctgaatgaccagatgtaggcttagccagtttattttctctaatttaatggataataaatattaagctcttggttaaatgtttttcagccattgaaaatgttatgaaaaagccttgaatatgcatgctgctttcatttttataaactttttattttttaactatagctttattagtaattccaaaatgctgcaatgtagctgatttcctcactcagacagctggctttgtgggtggcttttttcatactactgttaacttttttaaaaaagaagcaatgtaaagaccgtaatgcactaagctttttttttttcttttacacgtttaaaaacttcttaaagcactctgtaatataatgattaaattgctcccttttataaac

SEQ ID NO: 75443 - DNA, 4931 bp, Homo sapiens
agggttcacaggtcagagttgactccctgaaaagtgcagccggtttgaaatgcaagatggcggcggcgtggcgctgagaggcgcggcggcccctgcaggagaagacagactgctgctttggacctgttggtaatgatggcctgagctaaacatctaactagaagggatacccttccatttcaaagaacagaatgctaaggaagctgtggcaagtgattggagttgtgcttcaaaaatttcagaaattcagcagtattttatctgccaacaataagctctttacttgattgcaccatgagaaagctgctaatgagacttgttgagcacaaaaatggacttgaagaaccaaaagccattgttttcaaatgaagaacactgaacagttttaagcctcgatgctttttaatcaccactgagcttttcctcataacatcagaatggcaagcaggcgaaaatcaacaacaccttgcatggtccttgccagtgaacaagatccagaccttgagttgatatcagatttggatgaaggtcctcctgtgcttacacctgtagaaaacaccagagcagagagtatctcaagtgatgaagaggttcatgaatctgtggattcagacaatcagcaaaataaaaaagttgaaggtggatatgaatgtaaatattgtacttttcaaactccagatctaaatatgtttacttttcatgtggattcggaacatcccaatgtagtgctaaattcatcctatgtttgtgtcgaatgcaattttcttaccaaaaggtatgatgcactttctgagcataatctgaaatatcacccaggagaagagaattttaagttgactatggtgaaacgtaataaccagacaatctttgaacaaacaataaatgatctgacttttgatggtagttttgttaaagaggagaatgcagagcaagcagaatctacagaagtttcttcttcgggaatatctatcagtaaaactcctatcatgaaaatgatgaaaaataaagtggaaaataaacggattgcagttcatcataactcagttgaggacgttcctgaagagaaagagaatgaaatcaaaccagaccgtgaagaaattgtagaaaatccaagttcttcagcttctgaatctaatacaagtacttccattgtaaacagaatacatccaagtactgccagcacggtagtgacaccagcagcagttcttcctggattggcacaggtgataactgctgtatctgctcagcagaattctaatttgattcccaaagtcttaatccctgttaatagcattcccacctacaatgctgcattggataacaatccccttttacttaacacctacaacaagttcccttacccaacaatgtcagaaattacagttctttctgctcaagcaaaatatacagaggaacagatcaagatatggttttcagcccaacgtttaaaacatggtgttagttggactcccgaggaagtagaggaggcaagaaggaaacaattcaatggaacagtgcatactgtacctcagaccataactgttattcctacacacatttccacagggagtaatggtttaccatctattttacagacatgccaaatagttggtcagcctggtctggtccttactcaagtggctggaacaaacaccttgccagttacagcacctatagccttgacagtggcaggcgttccaagtcaaaataatatacagaaaagtcaggtacctgctgctcagcctactgcagaaacaaagccagcaacagcagcagttccaacttctcaaagtgtcaaacatgaaactgcattggtaaaccctgattcatttggcattcgggcaaaaaagacaaaagagcaactggcagaattaaaagttagctaccttaaaaatcagtttccccatgattcagaaattatcagacttatgaaaataacaggcctgacgaaaggagagattaaaaaatggtttagtgacacaaggtacaaccagagaaattcaaagagtaatcagtgcttacatctcaacaatgattcctctaccaccattattatagactccagtgatgaaaccacggaatccccaactgttggtactgcacagcctaagcaatcctggaatccttttcctgactttactccccaaaagtttaaagagaaaactgcagagcagcttcgtgtccttcaggcaagttttctcaacagctctgtacttacagatgaagaattaaataggttaagggcacaaaccaaacttaccagaagagaaatcgatgcttggtttacagagaagaagaaatcaaaagctttaaaggaagagaaaatggaaatagatgaaagtaatgcaggtagttccaaagaagaagctggagaaacttctcctgcagatgaatctggtgcacctaagtcagggagtacaggcaagatatgtaaaaaaacacctgagcagctgcacatgcttaagagtgcatttgtccggacacagtggccatcaccagaagagtatgacaagttggccaaagaaagcgggcttgctagaacagacatagttagttggtttggggacacccgttatgcttggaagaatggaaacttgaaatggtactactactatcagagcgccaattcaagtagtatgaatggtctgtcttcccttaggaaaagagggagagggagacccaaaggacggggaagaggaagaccgcgtgggcggcctagaggaagcaaaagaattaacaactgggacaggggaccatcactcataaaatttaaaactggaactgcaatacttaaggattattacctgaagcacaagtttcttaatgagcaagaccttgatgaacttgttaacaaatcacatatgggctatgagcaggtcagagagtggtttgcagaaagacagagaagatcagaattaggtatagaattatttgaggaaaatgaggaggaagatgaagttattgatgaccaggaagaggatgaagaagaaacagatgatagtgacacttgggaacctccacgacatgtgaaacggaagctgtctaaatcagatgactgaaatctgcctaaaacgttgaaggagaatcaattcttcaactcaagatgtctgatttactgtgaatttgcccaatctttgatgacattgaaaacgttttggggcatacacactcaaaaagcaggatccaatacccaaaagaaatggaacttaatgttgtgccaaagttaaactactgcagttggtggaagttctgcaatgtaaatagaacactaattaaaaaacaacttgtaaaaatgcaatttaaattttaatacagtacatttttcttctaatatgatggagacattctgaatcttagactttctgagggggtttaatgaccactagagcttgtcctcatattcagtccagtttaatactgtatgtctagtaagatgggctatatattgcctctattctttgagatgtgattaagcttagaactttgaccaaaaattttacagtaaaaattgttagaaatgggtaaaaaaaaaaaaaaaaaaaaaccctgatttattactatgtcttatttatcagaccctgcactaagattaaaagttgtgcatgggcttatacaatttcaaatgtaaaaacagcctatttatatatgttgaaacaataagattttatggtttcactggcccttaataattggatccttcattaaacacatccatgaataccactgtttctactgttacttgttccattagaagctgatttgctttttattaaactgcaggaaattaattctgaagaaggaaaagaaactgacatggtaatttggatagggtgaagctttgaaataaatactgcaccaaaaatgtgaaaaagaatcacgtagtaaatgtatacttagtgttttcttacaatcgtggaaatcagaaatgtttatacaggtgtcagatcagaatttttaagagttatctttcagtgaaattttataacagtttcagtgaatagagaaaaaattctgaactgatcataatgagttaaaagttagcttttcacttatgaatcatgggagtgttaactgttaactcttgccgtatcaggagactgaaagttcatactaatttacaaactttgtaaagactggtgctgttcattcatattgggaagaaccctttcttttgtgaccataggaccatttttcaaaatgcgctttcttcgtagaagaaatgttcagtttaattagctttggattttaacatgtttttctgaatgaccagatgtaggcttagccagtttattttctctaatttaatggataataaatattaagctcttggttaaatgtttttcagccattgaaaatgttatgaaaaagccttgaatatgcatgctgctttcatttttataaactttttattttttaactatagctttattagtaattccaaaatgctgcaatgtagctgatttcctcactcagacagctggctttgtgggtggcttttttcatactactgttaacttttttaaaaaagaagcaatgtaaagaccgtaatgcactaagctttttttttttcttttacacgtttaaaaacttcttaaagcactctgtaatataatgattaaattgctcccttttataaacattgctaatgtggtctgagttttgtttgacaataattttaatgttctcaaaatttgaaatgtcaagtattagaaatgaagcctttgaatatagttgtttcccttgcaatatgttaactctgtgtagctgtatataactattaatttccctcatctcttttataggcctgataaaactcttctctgacgtttgctagcttttaaatatatttatttgacagagcaaaagaaccctcttctggttgattgtgaccttgaatacaaaataaaagtagtgattagtagtttacagtg

SEQ ID NO: 75444 - DNA, 2669 bp, Homo sapiens
cacgcgtcgcggacgcgtgggtcgacccacgcgtcaaatcaaaagctttaaaggaagagaaaatggaaatagatgaaagtaatgcaggtagttccaaagaagaagctggagaaacttctcctgcagatgaatctggtgcacctaagtcagggagtacaggcaagatatgtaaaaaaacacctgagcagctgcacatgcttaagagtgcatttgtccggacacagtggccatcaccagaagagtatgacaagttggccaaagaaagcgggcttgctagaacagacatagttagttggtttggggacacccgttatgcttggaagaatggaaacttgaaatggtactactactatcagagcgccaattcaagtagtatgaatggtctgtcttcccttaggaaaagagggagagggagacccaaaggacggggaagaggaagaccgcgtgggcggcctagaggaagcaaaagaattaacaactgggacaggggaccatcactcataaaatttaaaactggaactgcaatacttaaggattattacctgaagcacaagtttcttaatgagcaagaccttgatgaacttgttaacaaatcacatatgggctatgagcaggtcagagagtggtttgcagaaagacagagaagatcagaattaggtatagaattatttgaggaaaatgaggaggaagatgaagttattgatgaccaggaagaggatgaagaagaaacagatgatagtgacacttgggaacctccacgacatgtgaaacggaagctgtctaaatcagatgactgaaatctgcctaaaacgttgaaggagaatcaattcttcaactcaagatgtctgatttactgtgaatttgcccaatctttgatgacattgaaaacgttttggggcatacacactcaaaaagcaggatccaatacccaaaagaaatggaacttaatgttgtgccaaagttaaactactgcagttggtggaagttctgcaatgtaaatagaacactaattaaaaaacaacttgtaaaaatgcaatttaaattttaatacagtacatttttcttctaatatgatggagacattctgaatcttagactttctgagggggtttaatgaccactagagcttgtcctcatattcagtccagtttaatactgtatgtctagtaagatgggctatatattgcctctattctttgagatgtgattaagcttagaactttgaccaaaaattttacagtaaaaattgttagaaatgggtaaaaaaaaaaaaaaaaaaaaaccctgatttattactatgtcttatttatcagaccctgcactaagattaaaagttgtgcatgggcttatacaatttcaaatgtaaaaacagcctatttatatatgttgaaacaataagattttatggtttcactggcccttaataattggatccttcattaaacacatccatgaataccactgtttctactgttacttgttccattagaagctgatttgctttttattaaactgcaggaaattaattctgaagaaggaaaagaaactgacatggtaatttggatagggtgaagctttgaaataaatactgcaccaaaaatgtgaaaaagaatcacgtagtaaatgtatacttagtgttttcttacaatcgtggaaatcagaaatgtttatacaggtgtcagatcagaatttttaagagttatctttcagtgaaattttataacagtttcagtgaatagagaaaaaattctgaactgatcataatgagttaaaagttagcttttcacttatgaatcatgggagtgttaactgttaactcttgccgtatcaggagactgaaagttcatactaatttacaaactttgtaaagactggtgctgttcattcatattgggaagaaccctttcttttgtgaccataggaccatttttcaaaatgcgctttcttcgtagaagaaatgttcagtttaattagctttggattttaacatgtttttctgaatgaccagatgtaggcttagccagtttattttctctaatttaatggataataaatattaagctcttggttaaatgtttttcagccattgaaaatgttatgaaaaagccttgaatatgcatgctgctttcatttttataaactttttattttttaactatagctttattagtaattccaaaatgctgcaatgtagctgatttcctcactcagacagctggctttgtgggtggcttttttcatactactgttaacttttttaaaaaagaagcaatgtaaagaccgtaatgcactaagctttttttttttcttttacacgtttaaaaacttcttaaagcactctgtaatataatgattaaattgctcccttttataaacattgctaatgtggtctgagttttgtttgacaataattttaatgttctcaaaatttgaaatgtcaagtattagaaatgaagcctttgaatatagttgtttcccttgcaatatgttaactctgtgtagctgtatataactattaatttccctcatctcttttataggcctgataaaactcttctctgacgtttgctagcttttaaatatatttatttgacagagcaaaagaaccctcttctggttgattgtgaccttgaatacaaaataaaagtagtgattagtagtttacagtg

SEQ ID NO: 75445 - DNA, 1354 bp, Homo sapiens
agggttcacaggtcagagttgactccctgaaaagtgcagccggtttgaaatgcaagatggcggcggcgtggcgctgagaggcgcggcggcccctgcaggagaagacagactgctgctttggacctgttggtaatgatggcctgagctaaacatctaactagaagggatacccttccatttcaaagaacagaatgctaaggaagctgtggcaatggttttatgaagaaacagaaagcagtgatgatgttgaagtgctgactctcaagaaattcaaaggagacctggcctacagacgacaagagtatcagaaagcactgcaggagtattccagtatctctgaaaaattgtcatcaaccaattttgccatgaaaagggatgtccaggaaggtcaggctcggtgtctggctcacctgggtaggcatatggaggcgctggagattgctgcaaacttggaaaataaagcaaccaacacagaccatttaaccacggtactctacctccagcttgctatttgttcaagtttgcagaacttggagaaaacaattttctgcctgcagaaactgatttctttgcatccttttaatccttggaactggggcaaattggcagaggcttacctgaatctggggccagctctttcagcagcacttgcgtcatctcagaaacagcacagtttcacctcaagtgacaaaactatcaaatccttctttccacactcaggaaaagactgtcttttgtgttttcctgaaaccttgcctgagagctctttattttctgtggaagcgaatagcagtaatagccagaaaaatgagaaagctctgacaaatatccaaaactgtatggcagaaaagagagaaacagtgttgatagagactcagctgaaagcatgtgcctcttttatacgaaccaggcttctgcttcagtttacccaacctcagcaaacatcgtttgctttggagaggaacttaaggactcagcaggaaattgaagataaaatgaaagggttcagcttcaaagaagacactttgctgttgatagctgaggttatgggagaagatatcccagaaaaaataaaagatgaagttcacccagaggtgaagtgtgttggctccgtagccctgactgccttggtgactgtatcctcagaagaatttgaagacaagtggttcagaaagatcaaagaccatttctgtccatttgaaaatcagttccatacagagatacaaatcttggcttagtgggttataaaaaacaaaaccacaaatatcttgtactgtattaattgtccttgtttacttcagacaggatccattgctaatcatggagtataaatgattatttatgttttataaaa

SEQ ID NO: 75446 - DNA, 1103 bp, Homo sapiens
ccctgtagagatgctaccgcagggataccctgagcctacagactacaagagtatcagaaagcactgcaggagtattccagtatctctgaaaaattgtcatcaaccaattttgccatgaaaagggatgtccaggaaggtcaggctcggtgtctggctcacctgggtaggcatatggaggcgctggagattgctgcaaacttggaaaataaagcaaccaacacagaccatttaaccacggtactctacctccagcttgctatttgttcaagtttgcagaacttggagaaaacaattttctgcctgcagaaactgatttctttgcatccttttaatccttggaactggggcaaattggcagaggcttacctgaatctggggccagctctttcagcagcacttgcgtcatctcagaaacagcacagtttcacctcaagtgacaaaactatcaaatccttctttccacactcaggaaaagactgtcttttgtgttttcctgaaaccttgcctgagagctctttattttctgtggaagcgaatagcagtaatagccagaaaaatgagaaagctctgacaaatatccaaaactgtatggcagaaaagagagaaacagtgttgatagagactcagctgaaagcatgtgcctcttttatacgaaccaggcttctgcttcagtttacccaacctcagcaaacatcgtttgctttggagaggaacttaaggactcagcaggaaattgaagataaaatgaaagggttcagcttcaaagaagacactttgctgttgatagctgaggttatgggagaagatatcccagaaaaaataaaagatgaagttcacccagaggtgaagtgtgttggctccgtagccctgactgccttggtgactgtatcctcagaagaatttgaagacaagtggttcagaaagatcaaagaccatttctgtccatttgaaaatcagttccatacagagatacaaatcttggcttagtgggttataaaaaacaaaaccacaaatatcttgtactgtattaattgtccttgtttacttcagacaggatccattgctaatcatggagtataaatgattatttatgttttataaaa

SEQ ID NO: 75447 - DNA, 2081 bp, Homo sapiens
agggttcacaggtcagagttgactccctgaaaagtgcagccggtttgaaatgcaagatggcggcggcgtggcgctgagaggcgcggcggcccctgcaggagaagacagactgctgctttggacctgttggtaatgatggcctgagctaaacatctaactagaagggatacccttccatttcaaagaacagaatgctaaggaagctgtggcaactgcctaaaacgttgaaggagaatcaattcttcaactcaagatgtctgatttactgtgaatttgcccaatctttgatgacattgaaaacgttttggggcatacacactcaaaaagcaggatccaatacccaaaagaaatggaacttaatgttgtgccaaagttaaactactgcagttggtggaagttctgcaatgtaaatagaacactaattaaaaaacaacttgtaaaaatgcaatttaaattttaatacagtacatttttcttctaatatgatggagacattctgaatcttagactttctgagggggtttaatgaccactagagcttgtcctcatattcagtccagtttaatactgtatgtctagtaagatgggctatatattgcctctattctttgagatgtgattaagcttagaactttgaccaaaaattttacagtaaaaattgttagaaatgggtaaaaaaaaaaaaaaaaaaaaaccctgatttattactatgtcttatttatcagaccctgcactaagattaaaagttgtgcatgggcttatacaatttcaaatgtaaaaacagcctatttatatatgttgaaacaataagattttatggtttcactggcccttaataattggatccttcattaaacacatccatgaataccactgtttctactgttacttgttccattagaagctgatttgctttttattaaactgcaggaaattaattctgaagaaggaaaagaaactgacatggtaatttggatagggtgaagctttgaaataaatactgcaccaaaaatgtgaaaaagaatcacgtagtaaatgtatacttagtgttttcttacaatcgtggaaatcagaaatgtttatacaggtgtcagatcagaatttttaagagttatctttcagtgaaattttataacagtttcagtgaatagagaaaaaattctgaactgatcataatgagttaaaagttagcttttcacttatgaatcatgggagtgttaactgttaactcttgccgtatcaggagactgaaagttcatactaatttacaaactttgtaaagactggtgctgttcattcatattgggaagaaccctttcttttgtgaccataggaccatttttcaaaatgcgctttcttcgtagaagaaatgttcagtttaattagctttggattttaacatgtttttctgaatgaccagatgtaggcttagccagtttattttctctaatttaatggataataaatattaagctcttggttaaatgtttttcagccattgaaaatgttatgaaaaagccttgaatatgcatgctgctttcatttttataaactttttattttttaactatagctttattagtaattccaaaatgctgcaatgtagctgatttcctcactcagacagctggctttgtgggtggcttttttcatactactgttaacttttttaaaaaagaagcaatgtaaagaccgtaatgcactaagctttttttttttcttttacacgtttaaaaacttcttaaagcactctgtaatataatgattaaattgctcccttttataaacattgctaatgtggtctgagttttgtttgacaataattttaatgttctcaaaatttgaaatgtcaagtattagaaatgaagcctttgaatatagttgtttcccttgcaatatgttaactctgtgtagctgtatataactattaatttccctcatctcttttataggcctgataaaactcttctctgacgtttgctagcttttaaatatatttatttgacagagcaaaagaaccctcttctggttgattgtgaccttgaatacaaaataaaagtagtgattagtagtttacagtg

SEQ ID NO: 75448 - DNA, 1293 bp, Homo sapiens
cgcttcctcgttgcccccgccgcgggcgcgagatggattccgggtgctggttgttcggcggcgagttcgaggactcggtgttcgaggagaggccggagcggcggtcaggaccgcccgcgtcctactgcgccaagctctgcgagccgcagtggttttatgaagaaacagaaagcagtgatgatgttgaagtgctgactctcaagaaattcaaaggagacctggcctacagacgacaagagtatcagaaagcactgcaggagtattccagtatctctgaaaaattgtcatcaaccaattttgccatgaaaagggatgtccaggaaggtcaggctcggtgtctggctcacctgggtaggcatatggaggcgctggagattgctgcaaacttggaaaataaagcaaccaacacagaccatttaaccacggtactctacctccagcttgctatttgttcaagtttgcagaacttggagaaaacaattttctgcctgcagaaactgatttctttgcatccttttaatccttggaactggggcaaattggcagaggcttacctgaatctggggccagctctttcagcagcacttgcgtcatctcagaaacagcacagtttcacctcaagtgacaaaactatcaaatccttctttccacactcaggaaaagactgtcttttgtgttttcctgaaaccttgcctgagagctctttattttctgtggaagcgaatagcagtaatagccagaaaaatgagaaagctctgacaaatatccaaaactgtatggcagaaaagagagaaacagtgttgatagagactcagctgaaagcatgtgcctcttttatacgaaccaggcttctgcttcagtttacccaacctcagcaaacatcgtttgctttggagaggaacttaaggactcagcaggaaattgaagataaaatgaaagggttcagcttcaaagaagacactttgctgttgatagctgaggtgagtgtatccctcgggtttatgtgaaacgaagcatcatagatattttccctggctctgatagcattttttataaagcagggccaaatttaatctactgaaggacttgtctccctcctctgtgtgccttttgatcactcagcaatcaccaaggcggcctcttgatcggcattcccctgcagcgtgcgggaccgcaggggctgtgtttcatgtacttgtcagtgcttgttagcacctgcctgcctgaacatcatcaatgcccaataattgtttgtttcagtgctgaataaatgaatgaatgaatgcttaatat

SEQ ID NO: 75449 - DNA, 3955 bp, Homo sapiens
agggttcacaggtcagagttgactccctgaaaagtgcagccggtttgaaatgcaagatggcggcggcgtggcgctgagaggcgcggcggcccctgcaggagaagacagactgctgctttggacctgttggtaatgatggcctgagctaaacatctaactagaagggatacccttccatttcaaagaacagaatgctaaggaagctgtggcaagtgattggagttgtgcttcaaaaatttcagaaattcagcagtattttatctgccaacaataagctctttacttgattgcaccatgagaaagctgctaatgagacttgttgagcacaaaaatggacttgaagaaccaaaagccattgttttcaaatgaagaacactgaacagttttaagcctcgatgctttttaatcaccactgagcttttcctcataacatcagaatggcaagcaggcgaaaatcaacaacaccttgcatggtccttgccagtgaacaagatccagaccttgagttgatatcagatttggatgaaggtcctcctgtgcttacacctgtagaaaacaccagagcagagagtatctcaagtgatgaagaggttcatgaatctgtggattcagacaatcagcaaaataaaaaagttgaaggtggatatgaatgtaaatattgtacttttcaaactccagatctaaatatgtttacttttcatgtggattcggaacatcccaatgtagtgctaaattcatcctatgtttgtgtcgaatgcaattttcttaccaaaaggtatgatgcactttctgagcataatctgaaatatcacccaggagaagagaattttaagttgactatggtgaaacgtaataaccagacaatctttgaacaaacaataaatgatctgacttttgatggtagttttgttaaagaggagaatgcagagcaagcagaatctacagaagtttcttcttcgggaatatctatcagtaaaactcctatcatgaaaatgatgaaaaataaagtggaaaataaacggattgcagttcatcataactcagttgaggacgttcctgaagagaaagagaatgaaatcaaaccagaccgtgaagaaattgtagaaaatccaagttcttcagcttctgaatctaatacaagtacttccattgtaaacagaatacatccaagtactgccagcacggtagtgacaccagcagcagttcttcctggattggcacaggtgataactgctgtatctgctcagcagaattctaatttgattcccaaagtcttaatccctgttaatagcattcccacctacaatgctgcattggataacaatccccttttacttaacacctacaacaagttcccttacccaacaatgtcagaaattacagttctttctgctcaagcaaaatatacagaggaacagatcaagatatggttttcagcccaacgtttaaaacatggtgttagttggactcccgaggaagtagaggaggcaagaaggaaacaattcaatggaacagtgcatactgtacctcagaccataactgttattcctacacacatttccacagggagtaatggtttaccatctattttacagacatgccaaatagttggtcagcctggtctggtccttactcaagtggctggaacaaacaccttgccagttacagcacctatagccttgacagtggcaggcgttccaagtcaaaataatatacagaaaagtcaggtacctgctgctcagcctactgcagaaacaaagccagcaacagcagcagttccaacttctcaaagtgtcaaacatgaaactgcattggtaaaccctgattcatttggcattcgggcaaaaaagacaaaagagcaactggcagaattaaaagttagctaccttaaaaatcagtttccccatgattcagaaattatcagacttatgaaaataacaggcctgacgaaaggagagattaaaaaatggtttagtgacacaaggtacaaccagagaaattcaaagagtaatcagtgcttacatctcaacaatgattcctctaccaccattattatagactccagtgatgaaaccacggaatccccaactgttggtactgcacagcctaagcaatcctggaatccttttcctgactttactccccaaaagtttaaagagaaaactgcagagcagcttcgtgtccttcaggcaagttttctcaacagctctgtacttacagatgaagaattaaataggttaagggcacaaaccaaacttaccagaagagaaatcgatgcttggtttacagagaagaagaaatcaaaagctttaaaggaagagaaaatggaaatagatgaaagtaatgcaggtagttccaaagaagaagctggagaaacttctcctgcagatgaatctggtgcacctaagtcagggagtacaggcaagatatgtaaaaaaacacctgagcagctgcacatgcttaagagtgcatttgtccggacacagtggccatcaccagaagagtatgacaagttggccaaagaaagcgggcttgctagaacagacatagttagttggtttggggacacccgttatgcttggaagaatggaaacttgaaatggtactactactatcagagcgccaattcaagtagtatgaatggtctgtcttcccttaggaaaagagggagagggagacccaaaggacggggaagaggaagaccgcgtgggcggcctagaggaagcaaaagaattaacaactgggacaggggaccatcactcataaaatttaaaactggaactgcaatacttaaggattattacctgaagcacaagtttcttaatgagcaagaccttgatgaacttgttaacaaatcacatatgggctatgagcaggtcagagagtggtttgcagaaagacagagaagatcagaattaggtatagaattatttgaggaaaatgaggaggaagatgaagttattgatgaccaggaagaggatgaagaagaaacagatgatagtgacacttgggaacctccacgacatgtgaaacggaagctgtctaaatcagatgactgaaatgtaagttaagaaaatttttaatctgcgtatatgttcatcaaccacatacattttgaacagtcaccttgttgtatcagtcatcttcatttttgatattttctgaagtagtttttcttttccctaataagactaggtaccactagtatagctaagagataaatgattatcatgtgtagttttattattattatgtagagtttaatgtcttaattattatttttcatatgaattgggttttttttactttgttttgaaggaaagttacccaatctctatgaagggagactggcaggcaggttgaggggattcacaaacaaatactaaagataactaaaatgtattttattgcaatgcccccttcactaaagcttcattttttgcctatttaaggaaataattcaaaaatgaaaactaaaaagaaggggaaaagtacaccaaaggaaagacttaccacagggttgaggattgtgcagttttaggaaactaggtgaaaatgggtatcttttcatcttcattgcattgctcccaaaactttactagacttttaactagagtttaaaatgctttatgtatttatgaaattactcagtatctttttagtaatttataaaattactcaatatctttttctgttaaaagtcaaaggtctgttttaggccatatataaattcatgtttgcttaggcggcatctgtctttgaaaactgtgatataaattatttctgttttagagatcaaaaggcaaataacagatttgatataaacccaattgcttaaaatatcttttcattctttggtataaaacaaacctgctaccagcactaacattgtatttgatttaaagtatatctctgtagtcttaaaaatgcaaataaatatggcttaaatttgaaa

SEQ ID NO: 75450 - DNA, 1034 bp, Homo sapiens
cgcttcctcgttgcccccgccgcgggcgcgagatggattccgggtgctggttgttcggcggcgagttcgaggactcggtgttcgaggagaggccggagcggcggtcaggaccgcccgcgtcctactgcgccaagctctgcgagccgcagtggttttatgaagaaacagaaagcagtgatgatgttgaagtgctgactctcaagaaattcaaaggagacctggcctacagacgacaagagtatcagaaagcactgcaggagtattccagtatctctgaaaaattgtcatcaaccaattttgccatgaaaagggatgtccaggaaggtcaggctcggtgtctggctcacctgggtaggcatatggaggcgctggagattgctgcaaacttggaaaataaagcaaccaacacagaccatttaaccacggtactctacctccagcttgctatttgttcaagtttgcagaacttggagaaaacaattttctgcctgcagaaactgatttctttgcatccttttaatccttggaactggggcaaattggcagaggcttacctgaatctggggccagctctttcagcagcacttgcgtcatctcagaaacagcacagtttcacctcaagtgacaaaactatcaaatccttctttccacactcaggaaaagactgtcttttgtgttttcctgaaaccttgcctgagagctctttattttctgtggaagcgaatagcagtaatagccagaaaaatgagaaagctctgacaaatatccaaaactgtatggcagaaaagagagaaacagtgttgatagagactcagctgaaagcatgtgcctcttttatacgaaccaggcttctgcttcagtttacccaacctcagcaaacatcgtttgctttggagaggaacttaaggactcagcaggaaattgaagataaaatgaaagggttcagcttcaaagaagacactatagcgtaggtgatacgtcgcaggttatggacatgacatatcccagtagatcatagtaacagtgacatatgc

SEQ ID NO: 75451 - DNA, 3978 bp, Homo sapiens
agggttcacaggtcagagttgactccctgaaaagtgcagccggtttgaaatgcaagatggcggcggcgtggcgctgagaggcgcggcggcccctgcaggagaagacagactgctgctttggacctgttggtaatgatggcctgagctaaacatctaactagaagggatacccttccatttcaaagaacagaatgctaaggaagctgtggcaagtgattggagttgtgcttcaaaaatttcagaaattcagcagtattttatctgccaacaataagctctttacttgattgcaccatgagaaagctgctaatgagacttgttgagcacaaaaatggacttgaagaaccaaaagccattgttttcaaatgaagaacactgaacagttttaagcctcgatgctttttaatcaccactgagcttttcctcataacatcagaatggcaagcaggcgaaaatcaacaacaccttgcatggtccttgccagtgaacaagatccagaccttgagttgatatcagatttggatgaaggtcctcctgtgcttacacctgtagaaaacaccagagcagagagtatctcaagtgatgaagaggttcatgaatctgtggattcagacaatcagcaaaataaaaaagttgaaggtggatatgaatgtaaatattgtacttttcaaactccagatctaaatatgtttacttttcatgtggattcggaacatcccaatgtagtgctaaattcatcctatgtttgtgtcgaatgcaattttcttaccaaaaggtatgatgcactttctgagcataatctgaaatatcacccaggagaagagaattttaagttgactatggtgaaacgtaataaccagacaatctttgaacaaacaataaatgatctgacttttgatggtagttttgttaaagaggagaatgcagagcaagcagaatctacagaagtttcttcttcgggaatatctatcagtaaaactcctatcatgaaaatgatgaaaaataaagtggaaaataaacggattgcagttcatcataactcagttgaggacgttcctgaagagaaagagaatgaaatcaaaccagaccgtgaagaaattgtagaaaatccaagttcttcagcttctgaatctaatacaagtacttccattgtaaacagaatacatccaagtactgccagcacggtagtgacaccagcagcagttcttcctggattggcacaggtgataactgctgtatctgctcagcagaattctaatttgattcccaaagtcttaatccctgttaatagcattcccacctacaatgctgcattggataacaatccccttttacttaacacctacaacaagttcccttacccaacaatgtcagaaattacagttctttctgctcaagcaaaatatacagaggaacagatcaagatatggttttcagcccaacgtttaaaacatggtgttagttggactcccgaggaagtagaggaggcaagaaggaaacaattcaatggaacagtgcatactgtacctcagaccataactgttattcctacacacatttccacagggagtaatggtttaccatctattttacagacatgccaaatagttggtcagcctggtctggtccttactcaagtggctggaacaaacaccttgccagttacagcacctatagccttgacagtggcaggcgttccaagtcaaaataatatacagaaaagtcaggtacctgctgctcagcctactgcagaaacaaagccagcaacagcagcagttccaacttctcaaagtgtcaaacatgaaactgcattggtaaaccctgattcatttggcattcgggcaaaaaagacaaaagagcaactggcagaattaaaagttagctaccttaaaaatcagtttccccatgattcagaaattatcagacttatgaaaataacaggcctgacgaaaggagagattaaaaaatggtttagtgacacaaggtacaaccagagaaattcaaagagtaatcagtgcttacatctcaacaatgattcctctaccaccattattatagactccagtgatgaaaccacggaatccccaactgttggtactgcacagcctaagcaatcctggaatccttttcctgactttactccccaaaagtttaaagagaaaactgcagagcagcttcgtgtccttcaggcaagttttctcaacagctctgtacttacagatgaagaattaaataggttaagggcacaaaccaaacttaccagaagagaaatcgatgcttggtttacagagaagaagaaatcaaaagctttaaaggaagagaaaatggaaatagatgaaagtaatgcaggtagttccaaagaagaagctggagaaacttctcctgcagatgaatctggtgcacctaagtcagggagtacaggcaagatatgtaaaaaaacacctgagcagctgcacatgcttaagagtgcatttgtccggacacagtggccatcaccagaagagtatgacaagttggccaaagaaagcgggcttgctagaacagacatagttagttggtttggggacacccgttatgcttggaagaatggaaacttgaaatggtactactactatcagagcgccaattcaagtagtatgaatggtctgtcttcccttaggaaaagagggagagggagacccaaaggacggggaagaggaagaccgcgtgggcggcctagaggaagcaaaagaattaacaactgggacaggggaccatcactcataaaatttaaaactggaactgcaatacttaaggattattacctgaagcacaagtttcttaatgagcaagaccttgatgaacttgttaacaaatcacatatgggctatgagcaggtcagagagtggtttgcagaaagacagagaagatcagaattaggtatagaattatttgaggaaaatgaggaggaagatgaagttattgatgaccaggaagaggatgaagaagaaacagatgatagtgacacttgggaacctccacgacatgtgaaacggaagctgtctaaatcagatgactgaaatgtaagttaagaaaatttttaatctgcgtatatgttcatcaaccacatacattttgaacagtcaccttgttgtatcagtcatcttcatttttgatattttctgaagtagtttttcttttccctaataagactaggtaccactagtatagctaagagataaatgattatcatgtgtagttttattattattatgtagagtttaatgtcttaattattatttttcatatgaattgggttttttttactttgttttgaaggaaagttacccaatctctatgaagggagactggcaggcaggttgaggggattcacaaacaaatactaaagataactaaaatgtattttattgcaatgcccccttcactaaagcttcattttttgcctatttaaggaaataattcaaaaatgaaaactaaaaagaaggggaaaagtacaccaaaggaaagacttaccacagggttgaggattgtgcagttttaggaaactaggtgaaaatgggtatcttttcatcttcattgcattgctcccaaaactttactagacttttaactagagtttaaaatgctttatgtatttatgaaattactcagtatctttttagtaatttataaaattactcaatatctttttctgttaaaagtcaaaggtctgttttaggccatatataaattcatgtttgcttaggcggcatctgtctttgaaaactgtgatataaattatttctgttttagagatcaaaaggcaaataacagatttgatataaacccaattgcttaaaatatcttttcattctttggtataaaacaaacctgctaccagcactaacattgtatttgatttaaagtatatctctgtagtcttaaaaatgcaaataaatatggcttaaatttgaaaaaaaaaataaataaaaactcgaa

SEQ ID NO: 75452 - DNA, 412 bp, Homo sapiens
gtttaatcaattatattatgggaaattgcttctgaatatgaggtggaaaagcatagctcactctgtaataggctattttcatgatttcaagtggttttatgaagaaacagaaagcagtgatgatgttgaagtgctgactctcaagaaattcaaaggagacctggcctacagacgacaagagtatcaggtagaattcaacatatggtgcttgaagtgggctcttgttttatcagttatggcatatgtaaataacagtgtaccaagttagtgtggtgtttatgaagatgagtttaatcttttgtgatgtgtgtttataatctgaggctcccaagtttccgttcttttctgcttggctctgtatgatttgtttgttttctgtaactccaacaaaaggatctctttggggtccttg

SEQ ID NO: 75453 - DNA, 596 bp, Homo sapiens
tccaagtcggaagctttagggattgaaatgatagttctagtgagggtgggtacctgctttttaacctggtgggacttgcagccgactcaatacctgggctttctgaacatttcctcgcggctttcctttatctggaagcgttgggacttttcgccacgcattgagacttttcggtttttcaggcttctgcttcagtttacccaacctcagcaaacatcgtttgctttggagaggaacttaaggactcagcaggaaattgaagataaaatgaaagggttcagcttcaaagaagacactttgctgttgatagctgaggtgagtgtatccctcgggtttatgtgaaacgaagcatcatagatattttccctggctctgatagcattttttataaagcagggccaaatttaatctactgaaggacttgtctccctcctctgtgtgccttttgatcactcagcaatcaccaaggcggcctcttgatcggcattcccctgcagcgtgcgggaccgcaggggctgtgtttcatgtacttgtcagtgcttgttagcacctgcctgcctgaacatcatcaatgcccaataattgtttgtttcagt

SEQ ID NO: 75454 - DNA, 1356 bp, Homo sapiens
agggttcacaggtcagagttgactccctgaaaagtgcagccggtttgaaatgcaagatggcggcggcgtggcgctgagaggcgcggcggcccctgcaggagaagacagactgctgctttggacctgttggtaatgatggcctgagctaaacatctaactagaagggatacccttccatttcaaagaacagaatgctaaggaagctgtggcaatggttttatgaagaaacagaaagcagtgatgatgttgaagtgctgactctcaagaaattcaaaggagacctggcctacagacgacaagagtatcagaaagcactgcaggagtattccagtatctctgaaaaattgtcatcaaccaattttgccatgaaaagggatgtccaggaaggtcaggctcggtgtctggctcacctgggtaggcatatggaggcgctggagattgctgcaaacttggaaaataaagcaaccaacacagaccatttaaccacggtactctacctccagcttgctatttgttcaagtttgcagaacttggagaaaacaattttctgcctgcagaaactgatttctttgcatccttttaatccttggaactggggcaaattggcagaggcttacctgaatctggggccagctctttcagcagcacttgcgtcatctcagaaacagcacagtttcacctcaagtgacaaaactatcaaatccttctttccacactcaggaaaagactgtcttttgtgttttcctgaaaccttgcctgagagctctttattttctgtggaagcgaatagcagtaatagccagaaaaatgagaaagctctgacaaatatccaaaactgtatggcagaaaagagagaaacagtgttgatagagactcagctgaaagcatgtgcctcttttatacgaaccaggcttctgcttcagtttacccaacctcagcaaacatcgtttgctttggagaggaacttaaggactcagcaggaaattgaagataaaatgaaagggttcagcttcaaagaagacactttgctgttgatagctgaggtgagtgtatccctcgggtttatgtgaaacgaagcatcatagatattttccctggctctgatagcattttttataaagcagggccaaatttaatctactgaaggacttgtctccctcctctgtgtgccttttgatcactcagcaatcaccaaggcggcctcttgatcggcattcccctgcagcgtgcgggaccgcaggggctgtgtttcatgtacttgtcagtgcttgttagcacctgcctgcctgaacatcatcaatgcccaataattgtttgtttcagtgctgaataaatgaatgaatgaatgcttaatat

SEQ ID NO: 75455 - DNA, 4781 bp, Homo sapiens
gcctaagcgacaacgcgagactccgtctcaaaaaaaaaaaaaaaatcagacttccacttgaagcaattgcatcttttaggattaatgtggctcagcggagctctgctgtgcttttaggattactgtggctcagcggagctctgcacaaagggtccgcgactgggatgggggtggggagtgaacgtcaaggggcccaggagcgctcgagcgtccaaggcccggcgtgtggagcagctggagggagaagacagactgctgctttggacctgttggtaatgatggcctgagctaaacatctaactagaagggatacccttccatttcaaagaacagaatgctaaggaagctgtggcaagtgattggagttgtgcttcaaaaatttcagaaattcagcagtattttatctgccaacaataagctctttacttgattgcaccatgagaaagctgctaatgagacttgttgagcacaaaaatggacttgaagaaccaaaagccattgttttcaaatgaagaacactgaacagttttaagcctcgatgctttttaatcaccactgagcttttcctcataacatcagaatggcaagcaggcgaaaatcaacaacaccttgcatggtccttgccagtgaacaagatccagaccttgagttgatatcagatttggatgaaggtcctcctgtgcttacacctgtagaaaacaccagagcagagagtatctcaagtgatgaagaggttcatgaatctgtggattcagacaatcagcaaaataaaaaagttgaaggtggatatgaatgtaaatattgtacttttcaaactccagatctaaatatgtttacttttcatgtggattcggaacatcccaatgtagtgctaaattcatcctatgtttgtgtcgaatgcaattttcttaccaaaaggtatgatgcactttctgagcataatctgaaatatcacccaggagaagagaattttaagttgactatggtgaaacgtaataaccagacaatctttgaacaaacaataaatgatctgacttttgatggtagttttgttaaagaggagaatgcagagcaagcagaatctacagaagtttcttcttcgggaatatctatcagtaaaactcctatcatgaaaatgatgaaaaataaagtggaaaataaacggattgcagttcatcataactcagttgaggacgttcctgaagagaaagagaatgaaatcaaaccagaccgtgaagaaattgtagaaaatccaagttcttcagcttctgaatctaatacaagtacttccattgtaaacagaatacatccaagtactgccagcacggtagtgacaccagcagcagttcttcctggattggcacaggtgataactgctgtatctgctcagcagaattctaatttgattcccaaagtcttaatccctgttaatagcattcccacctacaatgctgcattggataacaatccccttttacttaacacctacaacaagttcccttacccaacaatgtcagaaattacagttctttctgctcaagcaaaatatacagaggaacagatcaagatatggttttcagcccaacgtttaaaacatggtgttagttggactcccgaggaagtagaggaggcaagaaggaaacaattcaatggaacagtgcatactgtacctcagaccataactgttattcctacacacatttccacagggagtaatggtttaccatctattttacagacatgccaaatagttggtcagcctggtctggtccttactcaagtggctggaacaaacaccttgccagttacagcacctatagccttgacagtggcaggcgttccaagtcaaaataatatacagaaaagtcaggtacctgctgctcagcctactgcagaaacaaagccagcaacagcagcagttccaacttctcaaagtgtcaaacatgaaactgcattggtaaaccctgattcatttggcattcgggcaaaaaagacaaaagagcaactggcagaattaaaagttagctaccttaaaaatcagtttccccatgattcagaaattatcagacttatgaaaataacaggcctgacgaaaggagagattaaaaaatggtttagtgacacaaggtacaaccagagaaattcaaagagtaatcagtgcttacatctcaacaatgattcctctaccaccattattatagactccagtgatgaaaccacggaatccccaactgttggtactgcacagcctaagcaatcctggaatccttttcctgactttactccccaaaagtttaaagagaaaactgcagagcagcttcgtgtccttcaggcaagttttctcaacagctctgtacttacagatgaagaattaaataggttaagggcacaaaccaaacttaccagaagagaaatcgatgcttggtttacagagaagaagaaatcaaaagctttaaaggaagagaaaatggaaatagatgaaagtaatgcaggtagttccaaagaagaagctggagaaacttctcctgcagatgaatctggtgcacctaagtcagggagtacaggcaagatatgtaaaaaaacacctgagcagctgcacatgcttaagagtgcatttgtccggacacagtggccatcaccagaagagtatgacaagttggccaaagaaagcgggcttgctagaacagacatagttagttggtttggggacacccgttatgcttggaagaatggaaacttgaaatggtactactactatcagagcgccaattcaagtagtatgaatggtctgtcttcccttaggaaaagagggagagggagacccaaaggacggggaagaggaagaccgcgtgggcggcctagaggaagcaaaagaattaacaactgggacaggggaccatcactcataaaatttaaaactggaactgcaatacttaaggattattacctgaagcacaagtttcttaatgagcaagaccttgatgaacttgttaacaaatcacatatgggctatgagcaggtcagagagtggtttgcagaaagacagagaagatcagaattaggtatagaattatttgaggaaaatgaggaggaagatgaagttattgatgaccaggaagaggatgaagaagaaacagatgatagtgacacttgggaacctccacgacatgtgaaacggaagctgtctaaatcagatgactgaaatctgcctaaaacgttgaaggagaatcaattcttcaactcaagatgtctgatttactgtgaatttgcccaatctttgatgacattgaaaacgttttggggcatacacactcaaaaagcaggatccaatacccaaaagaaatggaacttaatgttgtgccaaagttaaactactgcagttggtggaagttctgcaatgtaaatagaacactaattaaaaaacaacttgtaaaaatgcaatttaaattttaatacagtacatttttcttctaatatgatggagacattctgaatcttagactttctgagggggtttaatgaccactagagcttgtcctcatattcagtccagtttaatactgtatgtctagtaagatgggctatatattgcctctattctttgagatgtgattaagcttagaactttgaccaaaaattttacagtaaaaattgttagaaatgggtaaaaaaaaaaaaaaaaaaaaaccctgatttattactatgtcttatttatcagaccctgcactaagattaaaagttgtgcatgggcttatacaatttcaaatgtaaaaacagcctatttatatatgttgaaacaataagattttatggtttcactggcccttaataattggatccttcattaaacacatccatgaataccactgtttctactgttacttgttccattagaagctgatttgctttttattaaactgcaggaaattaattctgaagaaggaaaagaaactgacatggtaatttggatagggtgaagctttgaaataaatactgcaccaaaaatgtgaaaaagaatcacgtagtaaatgtatacttagtgttttcttacaatcgtggaaatcagaaatgtttatacaggtgtcagatcagaatttttaagagttatctttcagtgaaattttataacagtttcagtgaatagagaaaaaattctgaactgatcataatgagttaaaagttagcttttcacttatgaatcatgggagtgttaactgttaactcttgccgtatcaggagactgaaagttcatactaatttacaaactttgtaaagactggtgctgttcattcatattgggaagaaccctttcttttgtgaccataggaccatttttcaaaatgcgctttcttcgtagaagaaatgttcagtttaattagctttggattttaacatgtttttctgaatgaccagatgtaggcttagccagtttattttctctaatttaatggataataaatattaagctcttggttaaatgtttttcagccattgaaaatgttatgaaaaagccttgaatatgcatgctgctttcatttttataaactttttattttttaactatagctttattagtaattccaaaatgctgcaatgtagctgatttcctcactcagacagctggctttgtgggtggcttttttcatactactgttaacttttttaaaaaagaagcaatgtaaagaccgtaatgcactaagctttttttttttcttttacacgtttaaaaacttcttaaagcactctgtaatataatgattaaattgctcccttttataaac

SEQ ID NO: 75456 - DNA, 4509 bp, Homo sapiens
  misc_feature (24)..(24): n is a, c, g, or t
  misc_feature (26)..(28): n is a, c, g, or t
ttaaggccaacgaggccacttttnannntgtaatttcctttagggattcattttaaaacattttaaaatttattttaatgtaggtgattggagttgtgcttcaaaaatttcagaaattcagcagtattttatctgccaacaataagctctttacttgattgcaccatgagaaagctgctaatgagacttgttgagcacaaaaatggacttgaagaaccaaaagccattgttttcaaatgaagaacactgaacagttttaagcctcgatgctttttaatcaccactgagcttttcctcataacatcagaatggcaagcaggcgaaaatcaacaacaccttgcatggtccttgccagtgaacaagatccagaccttgagttgatatcagatttggatgaaggtcctcctgtgcttacacctgtagaaaacaccagagcagagagtatctcaagtgatgaagaggttcatgaatctgtggattcagacaatcagcaaaataaaaaagttgaaggtggatatgaatgtaaatattgtacttttcaaactccagatctaaatatgtttacttttcatgtggattcggaacatcccaatgtagtgctaaattcatcctatgtttgtgtcgaatgcaattttcttaccaaaaggtatgatgcactttctgagcataatctgaaatatcacccaggagaagagaattttaagttgactatggtgaaacgtaataaccagacaatctttgaacaaacaataaatgatctgacttttgatggtagttttgttaaagaggagaatgcagagcaagcagaatctacagaagtttcttcttcgggaatatctatcagtaaaactcctatcatgaaaatgatgaaaaataaagtggaaaataaacggattgcagttcatcataactcagttgaggacgttcctgaagagaaagagaatgaaatcaaaccagaccgtgaagaaattgtagaaaatccaagttcttcagcttctgaatctaatacaagtacttccattgtaaacagaatacatccaagtactgccagcacggtagtgacaccagcagcagttcttcctggattggcacaggtgataactgctgtatctgctcagcagaattctaatttgattcccaaagtcttaatccctgttaatagcattcccacctacaatgctgcattggataacaatccccttttacttaacacctacaacaagttcccttacccaacaatgtcagaaattacagttctttctgctcaagcaaaatatacagaggaacagatcaagatatggttttcagcccaacgtttaaaacatggtgttagttggactcccgaggaagtagaggaggcaagaaggaaacaattcaatggaacagtgcatactgtacctcagaccataactgttattcctacacacatttccacagggagtaatggtttaccatctattttacagacatgccaaatagttggtcagcctggtctggtccttactcaagtggctggaacaaacaccttgccagttacagcacctatagccttgacagtggcaggcgttccaagtcaaaataatatacagaaaagtcaggtacctgctgctcagcctactgcagaaacaaagccagcaacagcagcagttccaacttctcaaagtgtcaaacatgaaactgcattggtaaaccctgattcatttggcattcgggcaaaaaagacaaaagagcaactggcagaattaaaagttagctaccttaaaaatcagtttccccatgattcagaaattatcagacttatgaaaataacaggcctgacgaaaggagagattaaaaaatggtttagtgacacaaggtacaaccagagaaattcaaagagtaatcagtgcttacatctcaacaatgattcctctaccaccattattatagactccagtgatgaaaccacggaatccccaactgttggtactgcacagcctaagcaatcctggaatccttttcctgactttactccccaaaagtttaaagagaaaactgcagagcagcttcgtgtccttcaggcaagttttctcaacagctctgtacttacagatgaagaattaaataggttaagggcacaaaccaaacttaccagaagagaaatcgatgcttggtttacagagaagaagaaatcaaaagctttaaaggaagagaaaatggaaatagatgaaagtaatgcaggtagttccaaagaagaagctggagaaacttctcctgcagatgaatctggtgcacctaagtcagggagtacaggcaagatatgtaaaaaaacacctgagcagctgcacatgcttaagagtgcatttgtccggacacagtggccatcaccagaagagtatgacaagttggccaaagaaagcgggcttgctagaacagacatagttagttggtttggggacacccgttatgcttggaagaatggaaacttgaaatggtactactactatcagagcgccaattcaagtagtatgaatggtctgtcttcccttaggaaaagagggagagggagacccaaaggacggggaagaggaagaccgcgtgggcggcctagaggaagcaaaagaattaacaactgggacaggggaccatcactcataaaatttaaaactggaactgcaatacttaaggattattacctgaagcacaagtttcttaatgagcaagaccttgatgaacttgttaacaaatcacatatgggctatgagcaggtcagagagtggtttgcagaaagacagagaagatcagaattaggtatagaattatttgaggaaaatgaggaggaagatgaagttattgatgaccaggaagaggatgaagaagaaacagatgatagtgacacttgggaacctccacgacatgtgaaacggaagctgtctaaatcagatgactgaaatctgcctaaaacgttgaaggagaatcaattcttcaactcaagatgtctgatttactgtgaatttgcccaatctttgatgacattgaaaacgttttggggcatacacactcaaaaagcaggatccaatacccaaaagaaatggaacttaatgttgtgccaaagttaaactactgcagttggtggaagttctgcaatgtaaatagaacactaattaaaaaacaacttgtaaaaatgcaatttaaattttaatacagtacatttttcttctaatatgatggagacattctgaatcttagactttctgagggggtttaatgaccactagagcttgtcctcatattcagtccagtttaatactgtatgtctagtaagatgggctatatattgcctctattctttgagatgtgattaagcttagaactttgaccaaaaattttacagtaaaaattgttagaaatgggtaaaaaaaaaaaaaaaaaaaaaccctgatttattactatgtcttatttatcagaccctgcactaagattaaaagttgtgcatgggcttatacaatttcaaatgtaaaaacagcctatttatatatgttgaaacaataagattttatggtttcactggcccttaataattggatccttcattaaacacatccatgaataccactgtttctactgttacttgttccattagaagctgatttgctttttattaaactgcaggaaattaattctgaagaaggaaaagaaactgacatggtaatttggatagggtgaagctttgaaataaatactgcaccaaaaatgtgaaaaagaatcacgtagtaaatgtatacttagtgttttcttacaatcgtggaaatcagaaatgtttatacaggtgtcagatcagaatttttaagagttatctttcagtgaaattttataacagtttcagtgaatagagaaaaaattctgaactgatcataatgagttaaaagttagcttttcacttatgaatcatgggagtgttaactgttaactcttgccgtatcaggagactgaaagttcatactaatttacaaactttgtaaagactggtgctgttcattcatattgggaagaaccctttcttttgtgaccataggaccatttttcaaaatgcgctttcttcgtagaagaaatgttcagtttaattagctttggattttaacatgtttttctgaatgaccagatgtaggcttagccagtttattttctctaatttaatggataataaatattaagctcttggttaaatgtttttcagccattgaaaatgttatgaaaaagccttgaatatgcatgctgctttcatttttataaactttttattttttaactatagctttattagtaattccaaaatgctgcaatgtagctgatttcctcactcagacagctggctttgtgggtggcttttttcatactactgttaacttttttaaaaaagaagcaatgtaaagaccgtaatgcactaagctttttttttttcttttacacgtttaaaaacttcttaaagcactctgtaatataatgattaaattgctcccttttataaac

SEQ ID NO: 75457 - DNA, 3524 bp, Homo sapiens
agggttcacaggtcagagttgactccctgaaaagtgcagccggtttgaaatgcaagatggcggcggcgtggcgctgagaggcgcggcggcccctgcaggagaagacagactgctgctttggacctgttggtaatgatggcctgagctaaacatctaactagaagggatacccttccatttcaaagaacagaatgctaaggaagctgtggcaagtgattggagttgtgcttcaaaaatttcagaaattcagcagtattttatctgccaacaataagctctttacttgattgcaccatgagaaagctgctaatgagacttgttgagcacaaaaatggacttgaagaaccaaaagccattgttttcaaatgaagaacactgaacagttttaagcctcgatgctttttaatcaccactgagcttttcctcataacatcagaatggcaagcaggcgaaaatcaacaacaccttgcatggtccttgccagtgaacaagatccagaccttgagttgatatcagatttggatgaaggtcctcctgtgcttacacctgtagaaaacaccagagcagagagtatctcaagtgatgaagaggttcatgaatctgtggattcagacaatcagcaaaataaaaaagttgaaggtggatatgaatgtaaatattgtacttttcaaactccagatctaaatatgtttacttttcatgtggattcggaacatcccaatgtagtgctaaattcatcctatgtttgtgtcgaatgcaattttcttaccaaaaggtatgatgcactttctgagcataatctgaaatatcacccaggagaagagaattttaagttgactatggtgaaacgtaataaccagacaatctttgaacaaacaataaatgatctgacttttgatggtagttttgttaaagaggagaatgcagagcaagcagaatctacagaagtttcttcttcgggaatatctatcagtaaaactcctatcatgaaaatgatgaaaaataaagtggaaaataaacggattgcagttcatcataactcagttgaggacgttcctgaagagaaagagaatgaaatcaaaccagaccgtgaagaaattgtagaaaatccaagttcttcagcttctgaatctaatacaagtacttccattgtaaacagaatacatccaagtactgccagcacggtagtgacaccagcagcagttcttcctggattggcacaggtgataactgctgtatctgctcagcagaattctaatttgattcccaaagtcttaatccctgttaatagcattcccacctacaatgctgcattggataacaatccccttttacttaacacctacaacaagttcccttacccaacaatgtcagaaattacagttctttctgctcaagcaaaatatacagaggaacagatcaagatatggttttcagcccaacgtttaaaacatggtgttagttggactcccgaggaagtagaggaggcaagaaggaaacaattcaatggaacagtgcatactgtacctcagaccataactgttattcctacacacatttccacagggagtaatggtttaccatctattttacagacatgccaaatagttggtcagcctggtctggtccttactcaagtggctggaacaaacaccttgccagttacagcacctatagccttgacagtggcaggcgttccaagtcaaaataatatacagaaaagtcaggtacctgctgctcagcctactgcagaaacaaagccagcaacagcagcagttccaacttctcaaagtgtcaaacatgaaactgcattggtaaaccctgattcatttggcattcgggcaaaaaagacaaaagagcaactggcagaattaaaagttagctaccttaaaaatcagtttccccatgattcagaaattatcagacttatgaaaataacaggcctgacgaaaggagagattaaaaaatggtttagtgacacaaggtacaaccagagaaattcaaagagtaatcagtgcttacatctcaacaatgattcctctaccaccattattatagactccagtgatgaaaccacggaatccccaactgttggtactgcacagcctaagcaatcctggaatccttttcctgactttactccccaaaagtttaaagagaaaactgcagagcagcttcgtgtccttcaggcaagttttctcaacagctctgtacttacagatgaagaattaaataggttaagggcacaaaccaaacttaccagaagagaaatcgatgcttggtttacagagaagaagaaatcaaaagctttaaaggaagagaaaatggaaatagatgaaagtaatgcaggtagttccaaagaagaagctggagaaacttctcctgcagatgaatctggtgcacctaagtcagggagtacaggcaagatatgtaaaaaaacacctgagcagctgcacatgcttaagagtgcatttgtccggacacagtggccatcaccagaagagtatgacaagttggccaaagaaagcgggcttgctagaacagacatagttagttggtttggggacacccgttatgcttggaagaatggaaacttgaaatggtactactactatcagagcgccaattcaagtagtatgaatggtctgtcttcccttaggaaaagagggagagggagacccaaaggacggggaagaggaagaccgcgtgggcggcctagaggaagcaaaagaattaacaactgggacaggggaccatcactcataaaatttaaaactggaactgcaatacttaaggattattacctgaagcacaagtttcttaatgagcaagaccttgatgaacttgttaacaaatcacatatgggctatgagcaggtcagagagtggtttgcagaaagacagagaagatcagaattaggtatagaattatttgaggaaaatgaggaggaagatgaagttattgatgaccaggaagaggatgaagaagaaacagatgatagtgacacttgggaacctccacgacatgtgaaacggaagctgtctaaatcagatgactgaaatctgcctaaaacgttgaaggagaatcaattcttcaactcaagatgtctgatttactgtgaatttgcccaatctttgatgacattgaaaacgttttggggcatacacactcaaaaagcaggatccaatacccaaaagaaatggaacttaatgttgtgccaaagttaaactactgcagttggtggaagttctgcaatgtaaatagaacactaattaaaaaacaacttgtaaaaatgcaatttaaattttaatacagtacatttttcttctaatatgatggagacattctgaatcttagactttctgagggggtttaatgaccactagagcttgtcctcatattcagtccagtttaatactgtatgtctagtaagatgggctatatattgcctctattctttgagatgtgattaagcttagaactttgaccaaaaattttacagtaaaaattgttagaaatgggta

SEQ ID NO: 75458 - DNA, 1692 bp, Homo sapiens
cgcttcctcgttgcccccgccgcgggcgcgagatggattccgggtgctggttgttcggcggcgagttcgaggactcggtgttcgaggagaggccggagcggcggtcaggaccgcccgcgtcctactgcgccaagctctgcgagccgcagtggttttatgaagaaacagaaagcagtgatgatgttgaagtgctgactctcaagaaattcaaaggagacctggcctacagacgacaagagtatcagaaagcactgcaggagtattccagtatctctgaaaaattgtcatcaaccaattttgccatgaaaagggatgtccaggaaggtcaggctcggtgtctggctcacctgggtaggcatatggaggcgctggagattgctgcaaacttggaaaataaagcaaccaacacagaccatttaaccacggtactctacctccagcttgctatttgttcaagtttgcagaacttggagaaaacaattttctgcctgcagaaactgatttctttgcatccttttaatccttggaactggggcaaattggcagaggcttacctgaatctggggccagctctttcagcagcacttgcgtcatctcagaaacagcacagtttcacctcaagtgacaaaactatcaaatccttctttccacactcaggaaaagactgtcttttgtgttttcctgaaaccttgcctgagagctctttattttctgtggaagcgaatagcagtaatagccagaaaaatgagaaagctctgacaaatatccaaaactgtatggcagaaaagagagaaacagtgttgatagagactcagctgaaagcatgtgcctcttttatacgaaccaggcttctgcttcagtttacccaacctcagcaaacatcgtttgctttggagaggaacttaaggactcagcaggaaattgaagataaaatgaaagggttcagcttcaaagaagacactttgctgttgatagctgaggttatgggagaagatatcccagaaaaaataaaagatgaagttcacccagaggtgaagtgtgttggctccgtagccctgactgccttggtgactgtatcctcagaagaatttgaagacaagtggttcagaaagatcaaagaccatttctgtccatttgaaaatcagttccatacagagatacaaatcttggcttagtgggttataaaaaacaaaaccacaaatatcttgtactgtattaattgtccttgtttacttcagacaggatccattgctaatcatggagtataaatgattatttatgttttataaaaaaaaaaaaaaaaaaaaaaaaaaaaaaaaaaaaaaaaagggggggggcgccaaaaaaatcccccgggggggcccaatgggggccccgtttttggaaaccaggggggccccataataagaggggcggcctatataaaagcccagacgacagtggccgcggttggttaaaaccaaaccggtcgcgggacgtgagcaacaccgtgcgagcggggggacaactccggaggagagacgaccccctacatttgcgggggggggaacactgcgtgccaccaaaaccccctcacagaaaattaagacgccccgcggcgaaactaacaacgctcgcgcgtcaaggccgtgcaacccacgggaaaatgccgcgggcgtgaaatggcctacggaaatgatcggaacattttcc

SEQ ID NO: 75459 - DNA, 1321 bp, Homo sapiens
cgcttcctcgttgcccccgccgcgggcgcgagatggattccgggtgctggttgttcggcggcgagttcgaggactcggtgttcgaggagaggccggagcggcggtcaggaccgcccgcgtcctactgcgccaagctctgcgagccgcagtggttttatgaagaaacagaaagcagtgatgatgttgaagtgctgactctcaagaaattcaaaggagacctggcctacagacgacaagagtatcagaaagcactgcaggagtattccagtatctctgaaaaattgtcatcaaccaattttgccatgaaaagggatgtccaggaaggtcaggctcggtgtctggctcacctgggtaggcatatggaggcgctggagattgctgcaaacttggaaaataaagcaaccaacacagaccatttaaccacggtactctacctccagcttgctatttgttcaagtttgcagaacttggagaaaacaattttctgcctgcagaaactgatttctttgcatccttttaatccttggaactggggcaaattggcagaggcttacctgaatctggggccagctctttcagcagcacttgcgtcatctcagaaacagcacagtttcacctcaagtgacaaaactatcaaatccttctttccacactcaggaaaagactgtcttttgtgttttcctgaaaccttgcctgagagctctttattttctgtggaagcgaatagcagtaatagccagaaaaatgagaaagctctgacaaatatccaaaactgtatggcagaaaagagagaaacagtgttgatagagactcagctgaaagcatgtgcctcttttatacgaaccaggcttctgcttcagtttacccaacctcagcaaacatcgtttgctttggagaggaacttaaggactcagcaggaaattgaagataaaatgaaagggttcagcttcaaagaagacactttgctgttgatagctgaggttatgggagaagatatcccagaaaaaataaaagatgaagttcacccagaggtgaagtgtgttggctccgtagccctgactgccttggtgactgtatcctcagaagaatttgaagacaagtggttcagaaagatcaaagaccatttctgtccatttgaaaatcagttccatacagagatacaaatcttggcttagtgggttataaaaaacaaaaccacaaatatcttgtactgtattaattgtccttgtttacttcagacaggatccattgctaatcatggagtataaatgattatttatgttttataaaactggcttctgtctcaaatgatttctactgc

SEQ ID NO: 75460 - DNA, 1386 bp, Homo sapiens
  misc_feature (1111)..(1111): n is a, c, g, or t
  misc_feature (1118)..(1118): n is a, c, g, or t
cgcttcctcgttgcccccgccgcgggcgcgagatggattccgggtgctggttgttcggcggcgagttcgaggactcggtgttcgaggagaggccggagcggcggtcaggaccgcccgcgtcctactgcgccaagctctgcgagccgcagtggttttatgaagaaacagaaagcagtgatgatgttgaagtgctgactctcaagaaattcaaaggagacctggcctacagacgacaagagtatcagaaagcactgcaggagtattccagtatctctgaaaaattgtcatcaaccaattttgccatgaaaagggatgtccaggaaggtcaggctcggtgtctggctcacctgggtaggcatatggaggcgctggagattgctgcaaacttggaaaataaagcaaccaacacagaccatttaaccacggtactctacctccagcttgctatttgttcaagtttgcagaacttggagaaaacaattttctgcctgcagaaactgatttctttgcatccttttaatccttggaactggggcaaattggcagaggcttacctgaatctggggccagctctttcagcagcacttgcgtcatctcagaaacagcacagtttcacctcaagtgacaaaactatcaaatccttctttccacactcaggaaaagactgtcttttgtgttttcctgaaaccttgcctgagagctctttattttctgtggaagcgaatagcagtaatagccagaaaaatgagaaagctctgacaaatatccaaaactgtatggcagaaaagagagaaacagtgttgatagagactcagctgaaagcatgtgcctcttttatacgaaccaggcttctgcttcagtttacccaacctcagcaaacatcgtttgctttggagaggaacttaaggactcagcaggaaattgaagataaaatgaaagggttcagcttcaaagaagacactttgctgttgatagctgagtatggaaagatatccaaaaaaaaaaaaaaaaaattttttcaaaaaaaaaaaaaaaaaaaggggggaaaaattttggggaaaaaaaaggggttttttttccccaaacccccccccccccaagaggaaagggnggtttgnaaaaaggtttgggttgtgttggctccgtagccctgactgccttggtgactgtatcctcagaagaatttgaagacaagtggttcagaaagatcaaagaccatttctgtccatttgaaaatcagttccatacagagatacaaatcttggcttagtgggttataaaaaacaaaaccacaaatatcttgtactgtattaattgtccttgtttacttcagacaggatccattgctaatcatggagtataaatgattatttatgttttataaaa

SEQ ID NO: 75461 - DNA, 1212 bp, Homo sapiens
cgcttcctcgttgcccccgccgcgggcgcgagatggattccgggtgctggttgttcggcggcgagttcgaggactcggtgttcgaggagaggccggagcggcggtcaggaccgcccgcgtcctactgcgccaagctctgcgagccgcagtggttttatgaagaaacagaaagcagtgatgatgttgaagtgctgactctcaagaaattcaaaggagacctggcctacagacgacaagagtatcagaaagcactgcaggagtattccagtatctctgaaaaattgtcatcaaccaattttgccatgaaaagggatgtccaggaaggtcaggctcggtgtctggctcacctgggtaggcatatggaggcgctggagattgctgcaaacttggaaaataaagcaaccaacacagaccatttaaccacggtactctacctccagcttgctatttgttcaagtttgcagaacttggagaaaacaattttctgcctgcagaaactgatttctttgcatccttttaatccttggaactggggcaaattggcagaggcttacctgaatctggggccagctctttcagcagcacttgcgtcatctcagaaacagcacagtttcacctcaagtgacaaaactatcaaatccttctttccacactcaggaaaagactgtcttttgtgttttcctgaaaccttgcctgagagctctttattttctgtggaagcgaatagcagtaatagccagaaaaatgagaaagctctgacaaatatccaaaactgtatggcagaaaagagagaaacagtgttgatagagactcagctgaaagcatgtgcctcttttatacgaaccaggcttctgcttcagtttacccaacctcagcaaacatcgtttgctttggagaggaacttaaggactcagcaggaaattgaagataaaatgaaagggttcagcttcaaagaagacactttgctgttgatagctgagggccaaatttaatctactgaaggacttgtctccctcctctgtgtgccttttgatcactcagcaatcaccaaggcggcctcttgatcggcattcccctgcagcgtgcgggaccgcaggggctgtgtttcatgtacttgtcagtgcttgttagcacctgcctgcctgaacatcatcaatgcccaataattgtttgtttcagtgctgaataaatgaatgaatgaatgcttaatat

SEQ ID NO: 75462 - DNA, 848 bp, Homo sapiens
cgcttcctcgttgcccccgccgcgggcgcgagatggattccgggtgctggttgttcggcggcgagttcgaggactcggtgttcgaggagaggccggagcggcggtcaggaccgcccgcgtcctactgcgccaagctctgcgagccgcagtggttttatgaagaaacagaaagcagtgatgatgttgaagtgctgactctcaagaaattcaaaggagacctggcctacagacgacaagagtatcagaaagcactgcaggagtattccagtatctctgaaaaattgtcatcaaccaattttgccatgaaaagggatgtccaggaaggtcaggctcggtgtctggctcacctgggtaggcatatggaggcgctggagattgctgcaaacttggaaaataaagcaaccaacacagaccatttaaccacggtactctacctccagcttgctatttgttcaagtttgcagaacttggagaaaagagagaaacagtgttgatagagactcagctgaaagcatgtgcctcttttatacgaaccaggttatgggagaagatatcccagaaaaaataaaagatgaagttcacccagaggtgaagtgtgttggctccgtagccctgactgccttggtgactgtatcctcagaagaatttgaagacaagtggttcagaaagatcaaagaccatttctgtccatttgaaaatcagttccatacagagatacaaatcttggcttagtgggttataaaaaacaaaaccacaaatatcttgtactgtattaattgtccttgtttacttcagacaggatccattgctaatcatggagtataaatgattatttatgttttataaaa

SEQ ID NO: 75463 - DNA, 675 bp, Homo sapiens
accaaatgcaacctcactgtattttcatggacttactggttccaaggctttcttggtggcttgactaagtccataactaatttctacttctgtagaaactagaaattttaagttcccaggattcataggaaggagggcactgcatttggtgaggccagggaataacaggccaggaaaagagactcagttgttccagaaacaaaaatgtatatatttacaaattgtaaatgtcacaactacaggcaagcatcttgagggttttacactatttttaattttttttattattgccaaagaaaaatatatgcactatagggcaatcagaacctacagatttgcaaaagaaagaaaataaaaaccatgcatattttcatcacttagttaataatttggagtatatccttcctgaccttttgctatgcctatttaattaaaaaatggaatgatgtgatttctatagcctggttctcctcactcaaaaacatatcatggttatgtctgtgttgttacttacatttctacaatatcattcttaacagttgcataatatttccttgtattaaagtattaccattttccaccaagtgattcccctattgttggacatggagattgcttttaatttattgttttggataaatttgttgctttggtcaacattcttgcatccacatt

SEQ ID NO: 75464 - DNA, 665 bp, Homo sapiens
ctttgatgtcacaatctgacctgtgggtattaatctggtcacagctgctcacagactagatggcaaggtccaggggactagcacaggaagatgtggaagagaagtgaccatcaacccaagatcaaagcagaggatggacctctggtgggccagttcgaggttctgggttcagttccagaacctgccatgccacatcctctagagctgtcagaatttgagagcttcccagtgtttcaggacattaggcttcacatcagggaagtgggagctcaattggtcaagaaagtcaatgccgtctttcagctggacatcaccaaaaatgggaagaccattttgcggtggaccattgatctgaagaatggttctggggacatgtatccgggacctgccaggctcccagcagacactgtctttacaatcccggagtctgtctttatggagctggttttgggcaaaatgaacccgcagaaggctttccttgccggaaagttcaaagtgagtggcaaggttctgcttagctggaagctggaaagggttttcaaagactgggctaaattttaagcatgcaaaaataccaaggaagaacttctcttcgatgataatgtcgagtggaaatcatgcttaatctgaagattaaagtaaaaagtatccaatatttttactca

SEQ ID NO: 75465 - DNA, 758 bp, Homo sapiens
ctttgatgtcacaatctgacctgtgggtattaatctggtcacagctgctcacagactagatggcaaggtccaggggactagcacaggaagatgtggaagagaagtgaccatcaacccaagatcaaagcagaggatggacctctggtgggccagttcgaggttctgggttcagttccagaacctgccatgccacatcctctagagctgtcagaatttgagagcttcccagtgtttcaggacattaggcttcacatcagggaagtgggagctcaattggtcaagaaagtcaatgccgtctttcagctggacatcaccaaaaatgggaagaccattttgcggtggaccattgatctgaagaatggttctggggacatgtatccgggacctgccaggctcccagcagacactgtctttacaatcccggagtctgtctttatggagctggttttgggcaaaatgaacccgcagaaggctttccttgccggaaagttcaaagtgagtggcaaggttctgcttagctggaagctggaaagggttttcaaagactgggctaaattttaagcatgcaaaaataccaaggaagaacttctcttcgatgataatgtcgagtggaaatcatgcttaatctgaagattaaagtaaaaagtatccaatatttttactcaaattcttcctattcaagtttaattgattttcctgttgatgggtaaattttcagggagggttctgaagcagtaaaaagcgttgtagtgcatcaa

SEQ ID NO: 75466 - DNA, 893 bp, Homo sapiens
agcctcgcctcgccccgcgccgcgcgcgttgccagggtgatcaggtgactcccggttcgcggcgctgggagcggccgtgacgtcaggcgcccggctgctcctcacttgctctgagacaggtgcggcaagtctactgcgggctggtccgggctcctcaggttcagacccgaccgttatccagtcggttcgtggagaggagaggtgcactttacaggtccccgatgaaccaagagaaccctccaccatatccaggccctggtccaacggccccatacccaccttatccaccacaaccaatgggtccaggacctatggggggaccctacccacctcctcaagggtacccctaccaaggatacccacagtacggctggcagggtggacctcaggagcctcctaaaaccacagtgtatgtggtagaagaccaaagaagagatgagctaggaccatccacctgcctcacagcctgctggacggctctctgttgctgctgtctctgggacatgctcacctgaccagaccagcccagccgtcctgtcctgccagctctgctgccacctctgacaggtgtgcctgcccccatctcttctgattgctgttaacaaatgactagctttgcacagacacctctaccttcagcactatgggattctagattaatgggggttgctactgtttaattcagtgacttgatctttttaatgtccaaaatccatttcttattgatctttaaagatgtgctaaatgacttttttggccaaaggcttagttgtgaaaaatataatttttaaattatacattcaaggtagtggccaaatgtaacacatcaatcatggaatgatttctctgctaacagccgcctgtatgtttcaataaatttgtccaaagctcaa

SEQ ID NO: 75467 - DNA, 953 bp, Homo sapiens
agcctcgcctcgccccgcgccgcgcgcgttgccagggtgatcaggtgactcccggttcgcggcgctgggagcggccgtgacgtcaggcgcccggctgctcctcacttgctctgagacaggtgcggcaagtctactgcgggctggtccgggctcctcaggttcagacccgaccgttatccagtcggttcgtggagaggagaggtgcactttacaggtccccgatgaaccaagagaaccctccaccatatccaggccctggtccaacggccccatacccaccttatccaccacaaccaatgggtccaggacctatggggggaccctacccacctcctcaagggtacccctaccaaggatacccacagtacggctggcagggtggacctcaggagcctcctaaaaccacagtgtatgtggtagaagaccaaagaagagatgagctaggaccatccacctgcctcacagcctgctggacggctctctgttgctgctgtctctgggacatgctcacctgaccagaccagcccagccgtcctgtcctgccagctctgctgccacctctgacaggtgtgcctgcccccatctcttctgattgctgttaacaaatgactagctttgcacagacacctctaccttcagcactatgggattctagattaatgggggttgctactgtttaattcagtgacttgatctttttaatgtccaaaatccatttcttattgatctttaaagatgtgctaaatgacttttttggccaaaggcttagttgtgaaaaatataatttttaaattatacattcaaggtagtggccaaatgtaacacatcaatcatggaatgatttctctgctaacagccgcctgtatgtttcaataaatttgtccaaagctcaaaaaaaacaacagactccccaggctggatcccgccaaaggggccaaaccttccaggggaac

SEQ ID NO: 75468 - DNA, 686 bp, Homo sapiens
agcctcgcctcgccccgcgccgcgcgcgttgccagggtgatcaggtgactcccggttcgcggcgctgggagcggccgtgacgtcaggcgcccggctgctcctcacttgctctgagacaggtgcggcaagtctactgcgggctggtccgggctcctcaggttcagacccgaccgttatccagtcggttcgtggagaggagagtgtatgtggtagaagaccaaagaagagatgagctaggaccatccacctgcctcacagcctgctggacggctctctgttgctgctgtctctgggacatgctcacctgaccagaccagcccagccgtcctgtcctgccagctctgctgccacctctgacaggtgtgcctgcccccatctcttctgattgctgttaacaaatgactagctttgcacagacacctctaccttcagcactatgggattctagattaatgggggttgctactgtttaattcagtgacttgatctttttaatgtccaaaatccatttcttattgatctttaaagatgtgctaaatgacttttttggccaaaggcttagttgtgaaaaatataatttttaaattatacattcaaggtagtggccaaatgtaacacatcaatcatggaatgatttctctgctaacagccgcctgtatgtttcaataaatttgtccaaagctcaa

SEQ ID NO: 75469 - DNA, 717 bp, Homo sapiens
agcctcgcctcgccccgcgccgcgcgcgttgccagggtgatcaggtgactcccggttcgcggcgctgggagcggccgtgacgtcaggcgcccggctgctcctcacttgctctgagacaggtgcggcaagtctactgcgggctggtccgggctcctcaggttcagacccgaccgttatccagtcggttcgtggagaggagagtgtatgtggtagaagaccaaagaagagatgagctaggaccatccacctgcctcacagcctgctggacggctctctgttgctgctgtctctgggacatgctcacctgaccagaccagcccagccgtcctgtcctgccagctctgctgccacctctgacaggtgtgcctgcccccatctcttctgattgctgttaacaaatgactagctttgcacagacacctctaccttcagcactatgggattctagattaatgggggttgctactgtttaattcagtgacttgatctttttaatgtccaaaatccatttcttattgatctttaaagatgtgctaaatgacttttttggccaaaggcttagttgtgaaaaatataatttttaaattatacattcaaggtagtggccaaatgtaacacatcaatcatggaatgatttctctgctaacagccgcctgtatgtttcaataaatttgtccaaagctcaacaacaaaaaaaaaatggcctcgctggcccta

SEQ ID NO: 75470 - DNA, 588 bp, Homo sapiens
agcctcgcctcgccccgcgccgcgcgcgttgccagggtgatcaggtgactcccggttcgcggcgctgggagcggccgtgacgtcaggcgcccggctgctcctcacttgctctgagacaggtgcggcaagtctactgcgggctggtccgggctcctcaggttcagacccgaccgttatccagtcggttcgtggagaggagaggtgcactttacaggtccccgatgaaccaagagaaccctccaccatatccaggccctggtccaacggccccatacccaccttatccaccacaaccaatgggtccaggacctatggggggaccctacccacctcctcaagggtacccctaccaaggatacccacagtacggctggcagggtggacctcaggagcctcctaaaaccacagtgtacgtgatagaacgggaaaggaagatggacagcgggtgtcaggcagtcctggctgcttgctgggctgctctctgctgctgctgcctcctggacaacttgaactgagcagctaagatccgagtatttccctacagccctgctacctcctgttacaggaataaacaactactgttgcaca

SEQ ID NO: 75471 - DNA, 754 bp, Homo sapiens
ttagcaggtgtgtacacaagccatgacaatagacagcggacaagaagacaagcatggttagagtgcactttacaggtccccgatgaaccaagagaaccctccaccatatccaggccctggtccaacggccccatacccaccttatccaccacaaccaatgggtccaggacctatggggggaccctacccacctcctcaagggtacccctaccaaggatacccacagtacggctggcagggtggacctcaggagcctcctaaaaccacagtgtatgtggtagaagaccaaagaagagatgagctaggaccatccacctgcctcacagcctgctggacggctctctgttgctgctgtctctgggacatgctcacctgaccagaccagcccagccgtcctgtcctgccagctctgctgccacctctgacaggtgtgcctgcccccatctcttctgattgctgttaacaaatgactagctttgcacagacacctctaccttcagcactatgggattctagattaatgggggttgctactgtttaattcagtgacttgatctttttaatgtccaaaatccatttcttattgatctttaaagatgtgctaaatgacttttttggccaaaggcttagttgtgaaaaatataatttttaaattatacattcaaggtagtggccaaatgtaacacatcaatcatggaatgatttctctgctaacagccgcctgtatgtttcaataaatttgtccaaagctcaa

SEQ ID NO: 75472 - DNA, 1207 bp, Homo sapiens
  misc_feature (1073)..(1073): n is a, c, g, or t
  misc_feature (1207)..(1207): n is a, c, g, or t
agcctcgcctcgccccgcgccgcgcgcgttgccagggtgatcaggtgactcccggttcgcggcgctgggagcggccgtgacgtcaggcgcccggctgctcctcacttgctctgagacaggtgcggcaagtctactgcgggctggtccgggctcctcaggttcagacccgaccgttatccagtcggttcgtggagaggagaggtgcactttacaggtccccgatgaaccaagagaaccctccaccatatccaggccctggtccaacggccccatacccaccttatccaccacaaccaatgggtccaggacctatggggggaccctacccacctcctcaagggtacccctaccaaggatacccacagtacggctggcagggtggacctcaggagcctcctaaaaccacagtgtatgtggtagaagaccaaagaagagatgagctaggaccatccacctgcctcacagcctgctggacggctctctgttgctgctgtctctgggacatgctcacctgaccagaccagcccagccgtcctgtcctgccagctctgctgccacctctgacaggtgtgcctgcccccatctcttctgattgctgttaacaaatgactagctttgcacagacacctctaccttcagcactatgggattctagattaatgggggttgctactgtttaattcagtgacttgatctttttaatgtccaaaatccatttcttattgatctttaaagatgtgctaaatgacttttttggccaaaggcttagttgtgaaaaatataatttttaaattatacattcaaggtagtggccaaatgtaacacatcaatcatggaatgatttctctgctaacagccgcctgtatgtttcaataaatttgtccaaagctcaaaacacaaaaataccccagaaaaatactatatacaaaatccctcccataccaacctatatgtaacccccccgtttccatccttttctttcccccgctgaaccccttgtcacgtttcctcacctttcgtcccccccccccctattaccccccctccgccccctcccccctgtcttgtctgtnttttttccccactatccagttccaccgcccgccggatactaattcgcgacacttgtctccattttgcgttgttatccccccaacaagatggtccccgctgccccacggcgccctccggcgacgtcacgcccccn

SEQ ID NO: 75473 - DNA, 530 bp, Homo sapiens
ccctcacctcgttcttgtgtaatagatgctaatatattaaattcgtgtatgtggtagaagaccaaagaagagatgagctaggaccatccacctgcctcacagcctgctggacggctctctgttgctgctgtctctgggacatgctcacctgaccagaccagcccagccgtcctgtcctgccagctctgctgccacctctgacaggtgtgcctgcccccatctcttctgattgctgttaacaaatgactagctttgcacagacacctctaccttcagcactatgggattctagattaatgggggttgctactgtttaattcagtgacttgatctttttaatgtccaaaatccatttcttattgatctttaaagatgtgctaaatgacttttttggccaaaggcttagttgtgaaaaatataatttttaaattatacattcaaggtagtggccaaatgtaacacatcaatcatggaatgatttctctgctaacagccgcctgtatgtttcaataaatttgtccaaagctcaa

SEQ ID NO: 75474 - DNA, 538 bp, Homo sapiens
tgcgacttgcgtcagtcactcctctggacccacgtctaaactccatcacctagtgtatgtggtagaagaccaaagaagagatgagctaggaccatccacctgcctcacagcctgctggacggctctctgttgctgctgtctctgggacatgctcacctgaccagaccagcccagccgtcctgtcctgccagctctgctgccacctctgacaggtgtgcctgcccccatctcttctgattgctgttaacaaatgactagctttgcacagacacctctaccttcagcactatgggattctagattaatgggggttgctactgtttaattcagtgacttgatctttttaatgtccaaaatccatttcttattgatctttaaagatgtgctaaatgacttttttggccaaaggcttagttgtgaaaaatataatttttaaattatacattcaaggtagtggccaaatgtaacacatcaatcatggaatgatttctctgctaacagccgcctgtatgtttcaataaatttgtccaaagctcaa

SEQ ID NO: 75475 - DNA, 544 bp, Homo sapiens
atctagcggatctactgagcaagctggaggttggactcagtagcctcctaaaaccacagtgtatgtggtagaagaccaaagaagagatgagctaggaccatccacctgcctcacagcctgctggacggctctctgttgctgctgtctctgggacatgctcacctgaccagaccagcccagccgtcctgtcctgccagctctgctgccacctctgacaggtgtgcctgcccccatctcttctgattgctgttaacaaatgactagctttgcacagacacctctaccttcagcactatgggattctagattaatgggggttgctactgtttaattcagtgacttgatctttttaatgtccaaaatccatttcttattgatctttaaagatgtgctaaatgacttttttggccaaaggcttagttgtgaaaaatataatttttaaattatacattcaaggtagtggccaaatgtaacacatcaatcatggaatgatttctctgctaacagccgcctgtatgtttcaataaatttgtccaaagctcaa

SEQ ID NO: 75476 - DNA, 860 bp, Homo sapiens
agcctcgcctcgccccgcgccgcgcgcgttgccagggtgatcaggtgactcccggttcgcggcgctgggagcggccgtgacgtcaggcgcccggctgctcctcacttgctctgagacaggtgcggcaagtctactgcgggctggtccgggctcctcaggttcagacccgaccgttatccagtcggttcgtggagaggagaggtgcactttacaggtccccgatgaaccaagagaaccctccaccatatccaggccctggtccaacggccccatacccaccttatccaccacaaccaatgggtccaggacctatggggggaccctacccacctcctcaagggtacccctaccaaggatacccacagtacggctggcagggtggacctcaggagcctcctaaaaccacagtaggaccatccacctgcctcacagcctgctggacggctctctgttgctgctgtctctgggacatgctcacctgaccagaccagcccagccgtcctgtcctgccagctctgctgccacctctgacaggtgtgcctgcccccatctcttctgattgctgttaacaaatgactagctttgcacagacacctctaccttcagcactatgggattctagattaatgggggttgctactgtttaattcagtgacttgatctttttaatgtccaaaatccatttcttattgatctttaaagatgtgctaaatgacttttttggccaaaggcttagttgtgaaaaatataatttttaaattatacattcaaggtagtggccaaatgtaacacatcaatcatggaatgatttctctgctaacagccgcctgtatgtttcaataaatttgtccaaagctcaa

SEQ ID NO: 75477 - DNA, 516 bp, Homo sapiens
cgcccgaatcaacgcgcgaaaaggtagcagggccccacccttgtgttgcggcagagacaacagataggaccatccacctgcctcacagcctgctggacggctctctgttgctgctgtctctgggacatgctcacctgaccagaccagcccagccgtcctgtcctgccagctctgctgccacctctgacaggtgtgcctgcccccatctcttctgattgctgttaacaaatgactagctttgcacagacacctctaccttcagcactatgggattctagattaatgggggttgctactgtttaattcagtgacttgatctttttaatgtccaaaatccatttcttattgatctttaaagatgtgctaaatgacttttttggccaaaggcttagttgtgaaaaatataatttttaaattatacattcaaggtagtggccaaatgtaacacatcaatcatggaatgatttctctgctaacagccgcctgtatgtttcaataaatttgtccaaagctcaa

SEQ ID NO: 75478 - DNA, 707 bp, Homo sapiens
ggcgcttggaggccgagcagttgggggcggggctcgtgctgtgacgcaagcctcgcctcgccccgcgccgcgcgcgttgccagggtgatcaggtgactcccggttcgcggcgctgggagcggccgtgacgtcaggcgcccggctgctcctcacttgctctgagacaggtgcggcaagtctactgcgggctggtccgggctcctcaggttcagacccgaccgttatccagtcggttcgtggagaggagaggtgaggtgcagcggacctggcccgacccagctgggaccagggcggggatcaggcacggacagggcgcgtccccgggctccctggggagcgccctgagaactggggggcacccgggctggcctggctcaggcaggggttcgcgcagcccctggggaggggcagggaggcagggaagctgctgccgccagctggatccctcccggcgccccgcggctactctggggctcctggtcgccgcgccgcgcgtctcggcggtggactcacagggtctccgcgtcgctgcggttctcgtctcacgaggagtcggcgggctcggagcggggctcgccacaccccgtcccgggggacgtccgcgggaggcttctggatttcttcgccttgggctgcgatttctgaggcgctgctctgcctattccgagctgggccagccgggggcagggggcaggtcgcgagtcccg

SEQ ID NO: 75479 - DNA, 744 bp, Homo sapiens
agtgatgaaggacaacacaatatattcctctagtccaatccccaccgtttcagtgcactttacaggtccccgatgaaccaagagaaccctccaccatatccaggccctggtccaacggccccatacccaccttatccaccacaaccaatgggtccaggacctatggggggaccctacccacctcctcaagggtacccctaccaaggatacccacagtacggctggcagggtggacctcaggagcctcctaaaaccacagtgtatgtggtagaagaccaaagaagagatgagctaggaccatccacctgcctcacagcctgctggacggctctctgttgctgctgtctctgggacatgctcacctgaccagaccagcccagccgtcctgtcctgccagctctgctgccacctctgacaggtgtgcctgcccccatctcttctgattgctgttaacaaatgactagctttgcacagacacctctaccttcagcactatgggattctagattaatgggggttgctactgtttaattcagtgacttgatctttttaatgtccaaaatccatttcttattgatctttaaagatgtgctaaatgacttttttggccaaaggcttagttgtgaaaaatataatttttaaattatacattcaaggtagtggccaaatgtaacacatcaatcatggaatgatttctctgctaacagccgcctgtatgtttcaataaatttgtccaaagctcaa

SEQ ID NO: 75480 - DNA, 924 bp, Homo sapiens
agcctcgcctcgccccgcgccgcgcgcgttgccagggtgatcaggtgactcccggttcgcggcgctgggagcggccgtgacgtcaggcgcccggctgctcctcacttgctctgagacaggtgcggcaagtctactgcgggctggtccgggctcctcaggttcagacccgaccgttatccagtcggttcgtggagaggagaggtgcactttacaggtccccgatgaaccaagagaaccctccaccatatccaggccctggtccaacggccccatacccaccttatccaccacaaccaatgggtccaggacctatggggggaccctacccacctcctcaagggtacccctaccaaggatacccacagtacggctggcagggtggacctcaggagcctcctaaaaccacagtgtatgtggtagaagaccaaagaagagatgagctaggaccatccacctgcctcacagcctgctggacggctctctgttgctgctgtctctgggacatgctcacctgaccagaccagcccagccgtcctgtcctgccagctctgctgccacctctgacaggtgtgcctgcccccatctcttctgattgctgttaacaaatgactagctttgcacagacacctctaccttcagcactatgggattctagattaatgggggttgctactgtttaattcagtgacttgatctttttaatgtccaaaatccatttcttattgatctttaaagatgtgctaaatgacttttttggccaaaggcttagttgtgaaaaatataatttttaaattatacattcaaggtagtggccaaatgtaacacatcaatcatggaatgatttctctgctaacagccgcctgtatgtttcaataaatttgtccaaagctcaacaacaaaaaaaaaatggcctcgctggcccta

SEQ ID NO: 75481 - DNA, 1094 bp, Homo sapiens
agcctcgcctcgccccgcgccgcgcgcgttgccagggtgatcaggtgactcccggttcgcggcgctgggagcggccgtgacgtcaggcgcccggctgctcctcacttgctctgagacaggtgcggcaagtctactgcgggctggtccgggctcctcaggttcagacccgaccgttatccagtcggttcgtggagaggagaggtgcactttacaggtccccgatgaaccaagagaaccctccaccatatccaggccctggtccaacggccccatacccaccttatccaccacaaccaatgggtccaggacctatggggggaccctacccacctcctcaagggtacccctaccaaggatacccacagtacggctggcagggtggacctcaggagcctcctaaaaccacagtgtatgtggtagaagaccaaagaagagatgagctaggaccatccacctgcctcacagcctgctggacggctctctgttgctgctgtctctgggacatgctcacctgaccagaccagcccagccgtcctgtcctgccagctctgctgccacctctgacaggtgtgcctgcccccatctcttctgattgctgttaacaaatgactagctttgcacagacacctctaccttcagcactatgggattctagattaatgggggttgctactgtttaattcagtgacttgatctttttaatgtccaaaatccatttcttattgatctttaaagatgtgctaaatgacttttttggccaaaggcttagttgtgaaaaatataatttttaaattatacattcaaggtagtggccaaatgtaacacatcaatcatggaatgatttctctgctaacagccgcctgtatgtttcaataaatttgtccaaagctcaaaaaaaaaaagcgaggcgaatcaatggacccgggggccacattacgcatcacaagagtatgtacaggggaccaagtagtgcgttaaagggcaagccggataacaagcggctggaaacgcacgggtattggaagacagccgttgggaaaggaagtcagatagagggaaaaagttggagcagcccggagtcaatttatacacaa

SEQ ID NO: 75482 - DNA, 293 bp, Homo sapiens
cccagaactaggaatcagagtatatggtacagggattcctggctcttagcaatgtcatgggcaactctagtatctatacagctgggaaggactcaaacaaaagggttattaggggaattcaacttccaccttgataaagccgctaaacaggttaccagcctcctgaaaagccaatatgggataagcacagaacttaccaccgtggagtcctctctgactttttgtcctgcttggttctctccccaaagatgagtgccctcaaaagaccccaaccatttctcttcctttgagaa

SEQ ID NO: 75483 - DNA, 481 bp, Homo sapiens
atcaagtgctgctgaaagaataaagagaaatgagcccaagtcagcagctacaggagaaatagaaagggccccatgacatgctgctgactaccaatttggcaatgaaactggctggcatcaagccatggatccaccacatgcccgtgaagaagttcctgccggaggaaacattcatgacacaggacaccaaggctgccaaatgggagacagaaccccttgaaggcctaggatttctgttcaaaagatgataaagtattgttttacattgttacattgctgctttacattgctgctgttttacattgttatttctgcgtacctctaaccttttcctacaatgggcaaaggttatgcaaatagcttacagcaagactcttgctgggtctgtgctctattacccctctctggcaccatggggctgccttggtgcgtcccccacatacaaggaaaaattaggtttataatatcttgattttgtaga

SEQ ID NO: 75484 - DNA, 341 bp, Homo sapiens
tgaggtttgggaatgaaaaatcagtaattaccgaagtggcatattatgacctcaatttgttttctaaatattctgaaaattattaaaaaaaaaaaaaccactaaaattcccttcttatgcctcttcaattgtgcaagaaaatttcatgggctgggttcacatctatgctcccatcagccttacatatatagaacacactgtaattatagatccaagatatttttatcccagtttgagatatattctgaacaattaaatgtccaggaatacattttttctagtacctatgtttttcagagttctaaaggattatttttcgctgggcacagtggctcatgcct

SEQ ID NO: 75485 - DNA, 202 bp, Homo sapiens
tgtctccaaaaaaaaaaaaaaaaaaaaaaaaaagtaatcacaccagagaggcagtgaaatgtgagagcgggtacatcctaccccttcccccacctcaagctgagtaatccacctgctgtattgtatagactctagatagagtgtggccaaagtagctgtaaattaacctcttaatgttgtcatagggataactcatatcctg

SEQ ID NO: 75486 - DNA, 993 bp, Homo sapiens
agcgggctgaggcaggagaatcactcgaggttcttgaatcacttgaggcagaggttgcggtgagccaagatcacgccaatgcattccagcctgggcgacagagcaagactccgtctcaaaacaaaacaaagaaaaggccgggagcagtggctcacgcctgtaatcccaacacttgtgggagatcaaggcaggcagatcacctgagtttgggagttcaagaccagcctgaccaacattgttagtagagcaaaacgtcgtctctactaaaaatacaaaaattgggcaggcttggtggcgtgtgactgtagtcctagctactcgggaggctgaggcaggagaattgcttgaacctggaaggtggagggtgcagtgagccgagatcgtaccactgcactccagcctgagcgacagagtgagtctccatctcaaaacataaataaataaaataaaataaaggaactctaggagtggtcaagtaaaagtatagagcagggatgggatggatgaggttatggactaaattgtatcttcccacctccctcccaaatgcagaggttgaagccctgactcccagcgtgagtgtttttggaggtaggcccttgagggaggtaattaaggttaaatgagatcttaagggtggggccccctactctgagaggactggtatcccaataagaagagagaggccggggcttgtggctcatgcctgtaatcccagcgctttgggaggccaggcaggaggatcgcttgagccaggagctcaagaccagcctgggcaacatagtgagaccccatctctacaaaaaaaatccgaaaagtagcctgggcacaggagcacgcacctgttagccccagctactcaggaggctgaggcgggaggatcgcatgagcctgggaggttgagactgcaatgagccgggattgtgccactgcactccagcctgagcaagagagacagaccttgtctcagagaaaaaaaaaaaaaaaaaaaag

SEQ ID NO: 75487 - DNA, 1069 bp, Homo sapiens
agcgggtgggagagcgggcttctgggactccgctaagaactcccgttgctcgctcacgtcgcccgcgttgcccatacccttcgactgcctgcgcagccctgtgtcactgagctccactgctgactccaaatcaccacaaaagcagaccacggcgcgttgcaccgaggttcggtcacgcgctgtagagcgcgagcgacgtattcggggaatactcgagggccaccgcgaggcagtgcgacgcgtgaggtgtacgggggagctgcgagtggaccgatggtctgtacctatatcattcgctgtacgtatgatgcgacaacatcgtcgctcgtgctatctagagaaaatgacaaaaaattgggcaggcttggtggcgtgtgactgtagtcctagctactcgggaggctgaggcaggagaattgcttgaacctggaaggtggagggtgcagtgagccgagatcgtaccactgcactccagcctgagcgacagagtgagtctccatctcaaaacataaataaataaaataaaataaaggaactctaggagtggtcaagtaaaagtatagagcagggatgggatggatgaggttatggactaaattgtatcttcccacctccctcccaaatgcagaggttgaagccctgactcccagcgtgagtgtttttggaggtaggcccttgagggaggtaattaaggttaaatgagatcttaagggtggggccccctactctgagaggactggtatcccaataagaagagagaggccggggcttgtggctcatgcctgtaatcccagcgctttgggaggccaggcaggaggatcgcttgagccaggagctcaagaccagcctgggcaacatagtgagaccccatctctacaaaaaaaatccgaaaagtagcctgggcacaggagcacgcacctgttagccccagctactcaggaggctgaggcgggaggatcgcatgagcctgggaggttgagactgcaatgagccgggattgtgccactgcactccagcctgagcaagagagacagaccttgtctcagagaaaaaaaaaaaaaaaaaaaag

SEQ ID NO: 75488 - DNA, 127 bp, Homo sapiens
caagctttgcggggtggggaggtgggagcacggaggacgaagcttgacgcaggggctgagacgaaaagagaacccgagagctaggggagcgtgcaggcagtggctggtgcccagaaagtggggggtg

SEQ ID NO: 75489 - DNA, 299 bp, Homo sapiens
tctaccttccattcactctctaaccagcttccatttctctttaccagaatgactccgtcaagcatctactcccctgctccctgtctccaacttgctccatctcttcttccccttcttacctcacatttgtcagagaaagcttcctgacttggaactctgggcccagactctctttccagcttccctgctagccctctgctcaacagatcctgtgttccagccaaaacaaacttcttgtcattcccaaaagactctgccttttcccattccattatgtttccactagtccttccttgcca

SEQ ID NO: 75490 - DNA, 505 bp, Homo sapiens
gagggtgtggtgttctaggataagtggtcaactcctcgcttctgccatgacactgcccatgctcttcttgtattctgtaccaagctccatgatactggcttcatccttgtctaaatgaattgtattattttcatttattgcttatgttacatcattcattcaaccattattttattgagtgtctaataaaataaggcaattctcttatacggcatattctattacaggcactattctaaagttttaaaatatataatttagttagttctcatgacactttatcaaataggtactcttattttccctggatgaagacaaaaggactgaggtacagagactgaagtaactcactcagggtcacaatgagaggctccagtgtccattgaccgcctccctcttctgtgtcactacaacggatcaagtgctgagccaagaactggggatgcaagataacttttgcttattggaagagttttcttttgttcctcaaactcagctcctctct

SEQ ID NO: 75491 - DNA, 390 bp, Homo sapiens
ttgcctatgacttatcaattaacccttggtgtccctagaatccaaaataaagaataaatgtatgtaaaaggataattggagacttagaatctcttcctcaagattttatctggttaatgactatcacaggtgggctgttctttttattcttggaagaacatactctattccggaggggaaaatatcaaattagttcagcctgctacctgctcccatagaagatgggggaagctggctctttcatcggtgttttcgtctgtagccgcccccttccccaaccttgagttgatttaaaaggatggaagaaagtaccgtgctacctccaatgctgtcattcagtgttcaccccaggcagtgtgctagacacattcctggactaaatcctttagt

SEQ ID NO: 75492 - DNA, 737 bp, Homo sapiens
agcagagtgatttgttcctatattaatttaggtaggagaaaatgtagacttagtgaagttgaagatctttgtccagtgtccacatggcctctcttttaaccacaaatctcaacccactgatgaccaagtgccatgcattaacaatgagtgataagagagaagactgctgggttcaattccagaggttgttagaggcaaacctctcactttatttctcaaagttgtactacatagatgactacaacatttcataaagattttctgtttggggagccaggaacccctcttggttttcaagcccagatggccatagtaaattgtctatgattcacagcaaagaaactaatcctgtatatagaacctacacaggaacaagatgtgctccacttgttagtctccattctgacttgatgagttagcttttggaaaaatgtaatttatgaagtagatatatttcatgaactaaaataactatgtgttaggtatggtatgcaaattaagcatatatatccatatatatcctatataaatatggagtgatatgtagatataaacataagcatagacacgcacaaaaaagacatagtacggaacagtggttgaaagcttggcttctgagtcagactgcattctgtgacaattttcttcacttacaaattaattttattttcatcttcagtgcatttaaaggcagaacaaaacaaccctgctccccattcccctgcaaaaaagaaaaa

SEQ ID NO: 75493 - DNA, 294 bp, Homo sapiens
ctgtgtatatttagtatctttcattaagaagactggttgatatttgccttcagctaatttatagaaaggatgatcatcaatgtctctagttttcttctaagtggcttgtctgtgcaggtacatataaaaattcaactatacaaatagctggacagttgagtctcaactatgaaaatcttttctgggatcaagatctaagaagttggtgtgtgtatgagtgcaacccatcattctatcccctaaaaatctggggtttctcagcccaaacattctcactagtaaagtcaagtttca

SEQ ID NO: 75494 - DNA, 415 bp, Homo sapiens
acaatgtggaaccagtccctactcagcgtacctgctgtcaggacattgtaaatgacgtcagctctgatggctcagaagatccagcagagttcagcagaggagacagctgtgcccattcagaaacagagaacaacattgtaagttggaatgctcttattttgccacctgtccccgagggctgtgctgagaagacaatgtggtctccacctggcattcctttagacagcccgacagaggtccttcagcagccccgggaaacctgaggacatgcaaacaaccagtcatgttccaacttcaagccggtaactgcacacaacaggcctgggagcgaactgtgtgaaggaccttaattcaaatcagagaaaatcattatttatttttttgtagtagtaatgtcatatgaatgtatcttaaa

SEQ ID NO: 75495 - DNA, 499 bp, Homo sapiens
atttccttccaggcatgtttaagttatagactttgagtatattttctcaaagggggttctatgtaagagactatttcttaatatagttcctagcttggaattgctcttgctggtttaagctgagcttattttattacagacttcacaacaataacgttttccttcactagtcagtacacaagatggtcttcatttccagtttggaatcccacactatcagagcctgagacaaggactagtatgcagttagtttgtttgggaggtgattccaggaagtgggaatgagagatcagtcagcctgcaacacgaaggaggaaaagtcaatataaggatgaatttggcaattggccgtttcatgcaactggggctaaattttgcttggctctctaagaaatgtaaagaatgcctcccgtaattgctcacctcaagtatttattcattggctctcatgctccattggttgtccatgagaactttagccctccctcgctgcagcaca

SEQ ID NO: 75496 - DNA, 426 bp, Homo sapiens
gagtgactgtttaatgaaatattatggtgaatcaggtgggatttgcagacttctacctaagtagaagtcttttagctgttgtattagtgtgtttttcaggctgctgataaaatgtacccgagattgggcaatttaaaaaagaaagaagtttgttggacttacagttccacatggctggagaggcctcacaatcatggtggaaggcaaggagaagcaagtcacatcttacatggatagcaacaggcaaaaagagagcttgtgcacggaaactccccttttaaaaccatcagatctcatgagactcattcactatcatgagaacagcacaggaaagatttccccctccccataattcaatcaactcccactgggttcctcccatgacatgtgggaattgtgggagttacaattcaagatgagatttgg

SEQ ID NO: 75497 - DNA, 3643 bp, Homo sapiens
  misc_feature (972)..(972): n is a, c, g, or t
  misc_feature (1321)..(1322): n is a, c, g, or t
  misc_feature (2767)..(2767): n is a, c, g, or t
  misc_feature (3026)..(3027): n is a, c, g, or t
  misc_feature (3099)..(3099): n is a, c, g, or t
  misc_feature (3377)..(3377): n is a, c, g, or t
  misc_feature (3639)..(3639): n is a, c, g, or t
  misc_feature (3641)..(3643): n is a, c, g, or t
gtaagtggatcccagcatccttggcaatagggttttaggtggagtctatctggctttcagagaagagttaggaaaacatttttattcccagcctgtgtcccatgggcacaagcaaatcccaaattctcctcctgaaccctcccaatttgtctctacagactctcttcttgtttttgttttctcatggctgaccttgtgtctggcctaagaaagttagggagggggctttatcagccctgagccctatgtggtagaagagacttcagagacggatgagaaggagagtcctcaagatcaagttgcttctcgatgtcaccaacacatccccttctgccacgtctttgttttcttgtacctcttccatgagctacaaggaacatctgaggctttgaaacaagctcacactgttcccccaaatgagacggggaagccccttgggtgagggaggagcagctcagactctgcttcctgctctgctccaggctcctctggtgactggccctgcctgactccacctggggtgggaccagcatgtgtggagaaagagccctggtggcctgtcctgaatttggctaaatcgagctgccagttgaagccaagcctcccccgggccaggctgcagggaaataagaagagagggagcctcagggcagactcctgagctgcgtcctggctctgaagtcaccggctgtatgaggctgtgggcacagcatgtgggacacagcacggaggatagtgactgatgcagagctggagaaatagggagattcacccctggggctctgcatcgcaggaaaggggcagtgcaaaaagtgtgtaattatagagagggtaagactaccaaacactttatatctaatataagacttaccattaactatttctaagtgtgcaatttagtgttgtgtaaccatcacactatccatttccagaactttttcctcttaccatattaaacctctgtacccaatnaacagtaactcactccttctccccataacccttagcacacaacattctacattctgtctctatgtaactggctattctaactatcttttataaatggaattatatgataattatccttttgtgtctggcttatttcagttagcataatatctttaaggttcatccattttgcacgatgtattggaattttattccttgttaaggttgaataacattttaattgtagatacacctcatttgcctacccacttatctttcaatggactttttggttgtttccattttttggctagtgtgagtaatgcttctctgaacatcagagtacaaatatttcttcaaatttctttcnnttctatgtggagtatgtccagaagtggaattgctggatcaaatggtaatttattgtttaattttttgagaaacagccacaccactttttacagtggctataacatttcccattcccatcaagtgtgtgaggtggtgtaacatgtggttttgatttgcatatctctaactattcatgatgctgaggaactttgcatgggcttattggatatttgtatatcttccttggagaaaactccattttaatcctttgttcattttttaattgggtttttggatgtctgctgttgttgacttgtagcttttcatgtattctggaaattaatttcttatcacacatataatttgcaaatatttttatcatttcatgggttgcctttttaccttcctgataatgttcttcgatatacaaaaggttttgatttttgtgaagtccaatttatcaattttatttgttgcctatgcttttgttgttacaaccaagaaatcattgtgaaatccagtatcatggaccttttcttctaagagttgtatagtttttgctcttacatttagatctttcatgtattgtgggttaatttttgcacatggtgttaggtaaaggttccactcttcttgcccttggatatccagcttttccaatatcatttggtgagaacactgtcccttccccattgaacgatcttggcacactcgaagaaatcatttggccatatatgcaagcatttctttctagttattatatttcattaatttctatgtcctcctttatgccagtaccacactgtattgattactggggctttgtagtaaatgctgaaatcagaagtgtgagtcctccagcttcattcttcctcttcaaagctgtgtgtctatttagagtcatgagatgcaatataaattttaggacagatttttctttttctgcaaaaatgtcactgagattctgataagaattgtattgaatctgcagctcactttgggtagcactgtcctcctaaccaaattgagtcttccaattcatgaaaacaaaatgtctttcaatttattgatgtcttctttcatttctttcagcaatattttgtagatttcgggtataatcatttcacctctttggttaaacttattcctaaatattttattctttttgatgttaatagaaattgaatttttttttcttaatttcccttcagattgttcatggttagtgtattgaaatacaactgatgtttgaatgttgattttgtattgtgcaacattactgaatttatttattagtcctaatagatttgttccatctttaggattttctacatataagttcaagttatctgtaaacagaaataattttactccttccttccaatttgaatgtcttttttaaaattcttgcctaatttttctgactagacctttcaatattatattgaataaaagtgtcaaaagnaaagctttcagtctttctctattgagtatgatgttagcattgggtttttcacatatgcctttatgttgaggtggtttccttccattcttagaatgtttttattatgaaaaaatactgaatttcatcaattacttttattgattcaatcttattactgattatagttctattcatatatttgtgtgtttctaagagtttgtctacttcatataggttatccaatttattagcatacaattatttatactacttcataatnnttattttattagaatggtagtaatcgcttcatttttctttttttttttttttttttttttttgaagagaganggacaggctctcactctgtaggccaccctaggatggaatacagtggtgtgtctatggctcactgcagcctcaacctcctgggctcaagcaattctccttcttcagcctcccaagatgctaggactacaggtgtgtcaccatgcccagctaattggttttttatttttgtagagacagcatctcccagggttaactatgctggcccaaacacttggtctcaagaaatccttccgctgtgacctcccaaagtgctaggattaaaacacgacccaccatgntcagagtccattttcatttctgattttagtaattttaaacttttctctttttttcttagtcaatctagttaatggttgtcaattttgttgattttattttgaagaatcaacttttggtttcagtaatttcctctattatttttccattctccattttatttatatccactctaatccttattatttccctcattcactgtgcttgggtttagtttgttcttctttcatatcctgaagtattaaagtaggttgttgacctgantnnn

SEQ ID NO: 75498 - DNA, 371 bp, Homo sapiens
tgttggagatgggaggagaaagggaggaaagggagtagagaaggccacacacaatcttaaattcaatatttcactcccgttaaagataagctgtttataagctccagtgtagggcatgtaattctatgtaaaaactctgtggttcctcttcccacatgtaaatcatgatcactctacattctgctctctgggagccctcaaggcaaagagacaacaagactcgagaccacagaaaggacttatcacaagtctttgtggtagctgaggagtgccccctacagactgatatgcacaatgcaagcagatgaagaggaaagaactgagcagcagtatttcaggattctcaataaggcatcaatgaaaaaaggtaa

SEQ ID NO: 75499 - DNA, 758 bp, Homo sapiens
cccattttactctgtcctgtgtcctgactgaagcgacaaggtgtgtctgcagctgtgctcacacctggaggaaacctcaatggtgtgagtaaattgtaaatgtttacttattatgggttattttattatttatgaagtatgtattttgatttcattctactgacaacacaataaaccaggacatgatgaccctagcagcacatcctctttcctgtgtcaagaagcatcgtccggggaggtgagaagaagacagtcctccctagaattgaagaaccagggagaaccagatgggctgggcagatcaagcacaaacctgagatccaactgtccctcttatgcgcctgggtttcttcactggacaccagtatgagtcaactttcctgtaaagcagaacaagcacgagattggaccatgttagaggaggaatggtgtcatctccacttctggagagatcactgtccccgtgtttgggggaaggaccaagcctcactcccatgcagagaagaagctctgactgtaactgcacctgtggagaggtgaggacctgtcccctctacaccgatggccagagcctccagagtggggccaggcttttccctcagctgtgtcctgtcaggtttatctaggcctcaaagaatagaccctggacattgcctctggcaatgtgagctggacacacacccagatgtaaggtagccctgccaagtatcctggggttgccagtagttctgggtgctcagtgtctggagcggagggtg

SEQ ID NO: 75500 - DNA, 702 bp, Homo sapiens
acagaaaaaaaaagatagttgacatattcaaagaactacatattataatagcttttcagaggaaaaaaagcttgctttttaaaaatatgttttaattttgaaatacttttatatttacagaagagttgcatagagagtacaaagagattccatatacctttcacctagcatcacttagtgttaataccttatataatcatgtacttttattagaactaggaaattaacactaagtaaattacactatatattagagttcaccaattttcccaatgttctttttcttttctggtatcaaactcatgatactgtgctgcatttagttgtcatgtttcagtctcttccaatctgtgaccatttttccatttttttctcatttttcacgacttacacttttgaagaaaactggtcagatattttttcagaagtccatcaatttgtgtttttcgaatgttttctcgtaattatactgaggttacgcatttggggctagaaacccgcagaagtgatgtgattttcacatagcgtcttaactggaggtacatttattttataaaaataatacagaataacaaggaagactatacaagatggtgaagttaacactgtgggacaaaactgtctttcttaaatatgattattacatttgaaaccaaagaataactgaaattagacaataaaataacaaaggaaagaatctga

SEQ ID NO: 75501 - DNA, 380 bp, Homo sapiens
ctcactgcaacctctgcctcacagcttcaagcaattctcgtgcctcaggctctcaagtagctgggattaatttttatatttttaatagagatgggttttaccatgttggccaggctggtcttgaactcctgacctcaagtgatccacccacatctgcctcccaaagtgctgggattggacttcattatcttcaaatatgtctatcaagacatagaagggattacaaatatttctttttacttttttgttttttgagtcagggtctactctgtcgccgaggctggagtgcaggggcgcaataatggctcactacagcctcgacctcctgggctcaagtgattctcccatgcaactgggactacagggatgcaccaccacac

SEQ ID NO: 75502 - DNA, 421 bp, Homo sapiens
tctaaacataaactagatgtccaacaattcaattcaattctgacactatctttgtcagaatccacagatttaagggttcaatcctacaagactgcctcctcttgagttcctctgcccggccgccccactgtctgggaagtgagaagcgcctctgcctagccgcccaccatctgggaagtgaggagcacctctgcccggccgccccacaccaccgccgccatctgggaagtgaggagtgcctctgcctggcccccgcaacgtctgggaagtgaggagcgcctttgcgcggctgctgtgcgaccctccaagtgtgaagtgacagccttgtgtgtgatctttctgccctccccaagtttgcattttcgacattaaagtttacttttcaattaaaatttttaaattggagaatatataatttaaa

SEQ ID NO: 75503 - DNA, 407 bp, Homo sapiens
attgcctcatctataaaatggggacaataatcctacctatttcatagggctattgggaggagggaaagagatgctatacatgtataaaacttttagcatagtatctggcaaataaagtgcccatgaaattttagctagagactctttttcttcaagagtgattctaaaacacactgtttgcccccctttcccactcaaccgttgactctcttcctagccttaaacttcatgtccagaactttttctaattttttatttttggaattgtggttaaaaaaatacataacataaaagttaccacctagtgtccatcagtggataaaaaatctggggtgtatatatgcagatgaatactgttcagcttcaaaagataagggaatcctgtcatttgcagcaacatggatgac

SEQ ID NO: 75504 - DNA, 673 bp, Homo sapiens
catgatgtatgtacctttaaggaagagaaaaccagatcactgtgatactctcttttagatgaagtaaaaattagactaagctgtagtgtagatagaattgaagcaccttcactttggttggcattagtcaactggtgagtgaggagatatatatatatatatatatgtatgtatgagcatgtgcatctgtggtgaagaaatgaggaattagttatgcctgctgctagttgactacagtaaatatgcattaaaaagaaataccaagtacacacatatcagaaactgatttgttccttttattactgttggccatatattaagaaggggagatggttctagtttaattaacccagttgagtgtagcagatggggcagaatgtctttcagcgataagacaattcagaaatggcaccagatgttggaagctgtccctggtggtgtttgagtgcagcccagatgttccagtcccacctggctagtttctaagcactgcggcctaagcagctgtgatgtaacctatataatgttcacataacactaaaagcaccatcattgaactgctgtagacttctaaggttgtgactgttaagaggtgaaatctttaaggacagacaaaaataaggacgactatttaaagtttcagatattggtctgtttcactaaagttgagaaa

SEQ ID NO: 75505 - DNA, 362 bp, Homo sapiens
gtcctatcctggaggaaaagcctattaagatgcttatactcaatgctgcaagcagcaggaagacatgccagctgttcagcaagggctttgttcttgcttatcattggcaaatggtagaaatttcaataattttttcaacatttacctgtttttttatatggattgctatttgttttattgggcttggatgtacacttgtctgtaatgagtggacgagaaatgttgtgaatatacttagtcttttaaacctggaaggtgctgagcaaatgaggaagttcagagcctatgaataactctgtctacccccttcctgtcacacagtgtatgcttgttttttcttttcttttctggcaaaaaaaaaa

SEQ ID NO: 75506 - DNA, 340 bp, Homo sapiens
aggaaaatgcagttaagtgctagaagcagggttcctgatctatttgaatccagccaaagaatcctcagaaatttgtaattgatttgctcaagtatgaaatgtagatctgagttggcaaactttccgtaaagggccaagtggtaaatatttttggctttgtaggacattggtctctgtcacaagtactttcaaaaacaggtggcaagctgcattggctcacaggccagagtttgctgacccctgatctacattgtttttccttctaaatattacctgattatcttagcttcttggcaaacatgctaggccggatggagcagaggtttctgttacatgctgt

SEQ ID NO: 75507 - DNA, 3279 bp, Homo sapiens
gtcggctccagttagagctcgggtctcctcgccacagctccgagtctttcgttctgggaggcccaggcggcttcgcgttctgagaataaacagaacctctgttgctctgcgacttgcaggcactgggagattcgtagctaagacgccagggcatcccggaagctgggaaatgggactgttgacattcagggatgtggccgtagaattctctttggaggagtgggaacacctggaaccagctcagaagaatttgtatcaggatgtgatgttagaaaactacagaaacctggtctctctgggtcttgttgtctctaagccggacctgatcacctttttggaacaaaggaaagagccttggaatgtgaagagtgaggagacagtagccatccagccagatgtgttttcgcattataacaaggacctgttgacagagcactgcacagaagcttcattccaaaaagtgatatcgaggagacatgggagctgtgatcttgagaatttacatttaagaaaaaggtggaaaagggaggagtgtgaagggcacaatggatgttatgatgaaaagacttttaaatatgatcaatttgatgaatcctctgttgaaagtttgtttcaccagcaaatactttcttcttgtgccaaaagctataactttgatcaatataggaaggtctttactcattcatcattgcttaatcaacaagaggaaatagatatttggggaaaacatcacatatatgataaaacttcagtgttatttaggcaggtctctactctaaatagttaccgaaatgtttttattggagagaaaaattatcattgcaataattctgaaaaaaccttgaaccaaagctcaagccctaaaaatcatcaggaaaattattttctagaaaaacaatacaaatgtaaagaatttgaggaagtctttcttcagagtatgcatgggcaagagaaacaagaacagtcttacaaatgtaataaatgtgtagaagtttgtacccagtcattaaaacatattcaacatcagaccatccatatcagagaaaactcatatagctataacaaatatgataaagatcttagtcagtcatcaaatcttagaaagcagataatccataatgaagagaaaccatacaaatgtgaaaaatgtggggatagcttaaaccatagtttgcaccttactcaacatcagatcattcctaccgaagagaaaccctataaatggaaagaatgtggcaaggtctttaaccttaactgtagtttataccttactaaacagcagcaaattgatactggagaaaacctttacaaatgtaaagcatgtagcaaatcttttactcgttcctccaatcttattgtgcatcagagaattcacactggagagaaaccatacaaatgtaaagaatgtggcaaagcctttcgctgtagttcataccttactaaacataagcgaattcatactggagagaaaccttataaatgtaaagaatgtggaaaagcttttaaccgtagttcatgccttactcaacatcagacaactcatacaggagaaaaactttacaaatgtaaagtatgtagcaaatcttatgctcgttcttcaaatcttattatgcatcagagagttcatactggagagaagccttataaatgtaaagaatgtggcaaagtctttagccgtagttcttgccttactcaacatcggaaaattcatactggagaaaatctttacaaatgcaaagtatgtgctaaaccttttacttgtttctcaaatcttattgtgcatgagagaattcatactggagagaaaccctataaatgtaaagaatgtggcaaagcctttccttatagttcacaccttattcgacattatcgaattcatactggagaaaaaccatacaaatgtaaagcatgtagcaaatcttttagtgactcctcaggtctttctgtgcatcggcgaactcatactggagagaaaccctatacatgtaaagaatgtggcaaagcctttagttatagttcagatgttattcagcatcggagaattcatactggccagagaccctacaaatgtgaagaatgtggcaaagccttcaactataggtcatacctcactacacatcagagaagtcatactggagagagaccctacaaatgtgaagaatgtggcaaagccttcaactctaggtcatacctcactacacatcggagaagacatactggagagagaccctacaaatgtgatgaatgtggtaaagccttcagctataggtcatacctcactacacatcggagaagtcatagtggagagagaccctacaaatgtgaagaatgtggcaaagcctttaactctaggtcatacctcattgcacatcagagaagtcatactagagaaaaactttaaaaatgtaaaacatggagcagattttttacttgttacccatgtcttattgtgcatcagataatttatatgggagtgaaaccctacaaatgttaagaatgtggcataacctttaactattttcaagccttacacaatagcagagaatataaactgaaaaaatccatacaaatattaaaaatgtggcaaattattttaaactgtgctcaacccttactcaagataatccatactagagaaacactatagatgtaaaaatgtgaaaagttttattcaaaatatcaaacttatgagtcacctaggggttcatagaaaaaggaagtttgcagatgcaataaatgtgaggaagtatttaataaaaaatgaagtctaaatgtgtcagagaatttatgtgagaaaggactaaagcacagacactttcagcctttatactaaataagagtattttttgtacagaataatctaaaggcaaaataattagataatttatttgcttatatgttttaaagtagcaagaacattgatgttttgacaggtatatttcatagatacttcatttgtatttacagtatttgaggtttttggaaagcaaatattatttatataattcagctttcaaatctgttgctgcttttccttaatccgtggtgttcatgtgaaaatatgtgttctgtttttttttctgcatcagaacaatgtgaggtcattctacgttaatatcattaatatcagcatttttcatggaagtttaatgccaaatgtaaaacacatgaaaatttttaaaaatatgctctttgtgtttgaataaagtagtaatgcacgtaaacatatacgtgtttagagctcttttctatattaaagtaagagggatattctgaatt

SEQ ID NO: 75508 - DNA, 2632 bp, Homo sapiens
gtcggctccagttagagctcgggtctcctcgccacagctccgagtctttcgttctgggaggcccaggcggcttcgcgttctgagaataaacagaacctctgttgctctgcgacttgcaggcactgggagattcgtagctaagacgccagggcatcccggaagctgggaaatgggactgttgacattcagggatgtggccgtagaattctctttggaggagtgggaacacctggaaccagctcagaagaatttgtatcaggatgtgatgttagaaaactacagaaacctggtctctctgggtcttgttgtctctaagccggacctgatcacctttttggaacaaaggaaagagccttggaatgtgaagagtgaggagacagtagccatccagccagatgtgttttcgcattataacaaggacctgttgacagagcactgcacagaagcttcattccaaaaagtgatatcgaggagacatgggagctgtgatcttgagaatttacatttaagaaaaaggtggaaaagggaggagtgtgaagggcacaatggatgttatgatgaaaagacttttaaatatgatcaatttgatgaatcctctgttgaaagtttgtttcaccagcaaatactttcttcttgtgccaaaagctataactttgatcaatataggaaggtctttactcattcatcattgcttaatcaacaagaggaaatagatatttggggaaaacatcacatatatgataaaacttcagtgttatttaggcaggtctctactctaaatagttaccgaaatgtttttattggagagaaaaattatcattgcaataattctgaaaaaaccttgaaccaaagctcaagccctaaaaatcatcaggaaaattattttctagaaaaacaatacaaatgtaaagaatttgaggaagtctttcttcagagtatgcatgggcaagagaaacaagaacagtcttacaaatgtaataaatgtgtagaagtttgtacccagtcattaaaacatattcaacatcagaccatccatatcagagaaaactcatatagctataacaaatatgataaagatcttagtcagtcatcaaatcttagaaagcagataatccataatgaagagaaaccatacaaatgtgaaaaatgtggggatagcttaaaccatagtttgcaccttactcaacatcagatcattcctaccgaagagaaaccctataaatggaaagaatgtggcaaggtctttaaccttaactgtagtttataccttactaaacagcagcaaattgatactggagaaaacctttacaaatgtaaagcatgtagcaaatcttttactcgttcctccaatcttattgtgcatcagagaattcacactggagagaaaccatacaaatgtaaagaatgtggcaaagcctttcgctgtagttcataccttactaaacataagcgaattcatactggagagaaaccttataaatgtaaagaatgtggaaaagcttttaaccgtagttcatgccttactcaacatcagacaactcatacaggagaaaaacatacaaatgtaaagcatgtagcaaatcttttagtgactcctcaggtctttctgtgcatcggcgaactcatactggagagaaaccctatacatgtaaagaatgtggcaaagcctttagttatagttcagatgttattcagcatcggagaattcatactggccagagaccctacaaatgtgaagaatgtggcaaagccttcaactataggtcatacctcattgcacatcagagaagtcatactagagaaaaactttaaaaatgtaaaacatggagcagattttttacttgttacccatgtcttattgtgcatcagataatttatatgggagtgaaaccctacaaatgttaagaatgtggcataacctttaactattttcaagccttacacaatagcagagaatataaactgaaaaaatccatacaaatattaaaaatgtggcaaattattttaaactgtgctcaacccttactcaagataatccatactagagaaacactatagatgtaaaaatgtgaaaagttttattcaaaatatcaaacttatgagtcacctaggggttcatagaaaaaggaagtttgcagatgcaataaatgtgaggaagtatttaataaaaaatgaagtctaaatgtgtcagagaatttatgtgagaaaggactaaagcacagacactttcagcctttatactaaataagagtattttttgtacagaataatctaaaggcaaaataattagataatttatttgcttatatgttttaaagtagcaagaacattgatgttttgacaggtatatttcatagatacttcatttgtatttacagtatttgaggtttttggaaagcaaatattatttatataattcagctttcaaatctgttgctgcttttccttaatccgtggtgttcatgtgaaaatatgtgttctgtttttttttctgcatcagaacaatgtgaggtcattctacgttaatatcattaatatcagcatttttcatggaagtttaatgccaaatgtaaaacacatgaaaatttttaaaaatatgctctttgtgtttgaataaagtagtaatgcacgt

SEQ ID NO: 75509 - DNA, 3221 bp, Homo sapiens
gtcggctccagttagagctcgggtctcctcgccacagctccgagtctttcgttctgggaggcccaggcggcttcgcgttctgagaataaacagaacctctgttgctctgcgacttgcaggcactgggagattcgtagctaagacgccagggcatcccggaagctgggaaatgggactgttgacattcagggatgtggccgtagaattctctttggaggagtgggaacacctggaaccagctcagaagaatttgtatcaggatgtgatgttagaaaactacagaaacctggtctctctgggtcttgttgtctctaagccggacctgatcacctttttggaacaaaggaaagagccttggaatgtgaagagtgaggagacagtagccatccagccagatgtgttttcgcattataacaaggacctgttgacagagcactgcacagaagcttcattccaaaaagtgatatcgaggagacatgggagctgtgatcttgagaatttacatttaagaaaaaggtggaaaagggaggagtgtgaagggcacaatggatgttatgatgaaaagacttttaaatatgatcaatttgatgaatcctctgttgaaagtttgtttcaccagcaaatactttcttcttgtgccaaaagctataactttgatcaatataggaaggtctttactcattcatcattgcttaatcaacaagaggaaatagatatttggggaaaacatcacatatatgataaaacttcagtgttatttaggcaggtctctactctaaatagttaccgaaatgtttttattggagagaaaaattatcattgcaataattctgaaaaaaccttgaaccaaagctcaagccctaaaaatcatcaggaaaattattttctagaaaaacaatacaaatgtaaagaatttgaggaagtctttcttcagagtatgcatgggcaagagaaacaagaacagtcttacaaatgtaataaatgtgtagaagtttgtacccagtcattaaaacatattcaacatcagaccatccatatcagagaaaactcatatagctataacaaatatgataaagatcttagtcagtcatcaaatcttagaaagcagataatccataatgaagagaaaccatacaaatgtgaaaaatgtggggatagcttaaaccatagtttgcaccttactcaacatcagatcattcctaccgaagagaaaccctataaatggaaagaatgtggcaaggtctttaaccttaactgtagtttataccttactaaacagcagcaaattgatactggagaaaacctttacaaatgtaaagcatgtagcaaatcttttactcgttcctccaatcttattgtgcatcagagaattcacactggagagaaaccatacaaatgtaaagaatgtggcaaagcctttcgctgtagttcataccttactaaacataagcgaattcatactggagagaaaccttataaatgtaaagaatgtggaaaagcttttaaccgtagttcatgccttactcaacatcagacaactcatacaggagaaaaactttacaaatgtaaagtatgtagcaaatcttatgctcgttcttcaaatcttattatgcatcagagagttcatactggagagaagccttataaatgtaaagaatgtggcaaagtctttagccgtagttcttgccttactcaacatcggaaaattcatactggagaaaatctttacaaatgcaaagtatgtgctaaaccttttacttgtttctcaaatcttattgtgcatgagagaattcatactggagagaaaccctataaatgtaaagaatgtggcaaagcctttccttatagttcacaccttattcgacattatcgaattcatactggagaaaaaccatacaaatgtaaagcatgtagcaaatcttttagtgactcctcaggtctttctgtgcatcggcgaactcatactggagagaaaccctatacatgtaaagaatgtggcaaagcctttagttatagttcagatgttattcagcatcggagaattcatactggccagagaccctacaaatgtgaagaatgtggcaaagccttcaactataggtcatacctcactacacatcagagaagtcatactggagagagaccctacaaatgtgaagaatgtggcaaagccttcaactctaggtcatacctcactacacatcggagaagacatactggagagagaccctacaaatgtgatgaatgtggtaaagccttcagctataggtcatacctcactacacatcggagaagtcatagtggagagagaccctacaaatgtgaagaatgtggcaaagcctttaactctaggtcatacctcattgcacatcagagaagtcatactagagaaaaactttaaaaatgtaaaacatggagcagattttttacttgttacccatgtcttattgtgcatcagataatttatatgggagtgaaaccctacaaatgttaagaatgtggcataacctttaactattttcaagccttacacaatagcagagaatataaactgaaaaaatccatacaaatattaaaaatgtggcaaattattttaaactgtgctcaacccttactcaagataatccatactagagaaacactatagatgtaaaaatgtgaaaagttttattcaaaatatcaaacttatgagtcacctaggggttcatagaaaaaggaagtttgcagatgcaataaatgtgaggaagtatttaataaaaaatgaagtctaaatgtgtcagagaatttatgtgagaaaggactaaagcacagacactttcagcctttatactaaataagagtattttttgtacagaataatctaaaggcaaaataattagataatttatttgcttatatgttttaaagtagcaagaacattgatgttttgacaggtatatttcatagatacttcatttgtatttacagtatttgaggtttttggaaagcaaatattatttatataattcagctttcaaatctgttgctgcttttccttaatccgtggtgttcatgtgaaaatatgtgttctgtttttttttctgcatcagaacaatgtgaggtcattctacgttaatatcattaatatcagcatttttcatggaagtttaatgccaaatgtaaaacacatgaaaatttttaaaaatatgctctttgtgtttgaataaagtagtaatgcacgt

SEQ ID NO: 75510 - DNA, 2969 bp, Homo sapiens
gtcggctccagttagagctcgggtctcctcgccacagctccgagtctttcgttctgggaggcccaggcggcttcgcgttctgagaataaacagaacctctgttgctctgcgacttgcaggcactgggagattcgtagctaagacgccagggcatcccggaagctgggaaatgggactgttgacattcagggatgtggccgtagaattctctttggaggagtgggaacacctggaaccagctcagaagaatttgtatcaggatgtgatgttagaaaactacagaaacctggtctctctgggtcttgttgtctctaagccggacctgatcacctttttggaacaaaggaaagagccttggaatgtgaagagtgaggagacagtagccatccagccagatgtgttttcgcattataacaaggacctgttgacagagcactgcacagaagcttcattccaaaaagtgatatcgaggagacatgggagctgtgatcttgagaatttacatttaagaaaaaggtggaaaagggaggagtgtgaagggcacaatggatgttatgatgaaaagacttttaaatatgatcaatttgatgaatcctctgttgaaagtttgtttcaccagcaaatactttcttcttgtgccaaaagctataactttgatcaatataggaaggtctttactcattcatcattgcttaatcaacaagaggaaatagatatttggggaaaacatcacatatatgataaaacttcagtgttatttaggcaggtctctactctaaatagttaccgaaatgtttttattggagagaaaaattatcattgcaataattctgaaaaaaccttgaaccaaagctcaagccctaaaaatcatcaggaaaattattttctagaaaaacaatacaaatgtaaagaatttgaggaagtctttcttcagagtatgcatgggcaagagaaacaagaacagtcttacaaatgtaataaatgtgtagaagtttgtacccagtcattaaaacatattcaacatcagaccatccatatcagagaaaactcatatagctataacaaatatgataaagatcttagtcagtcatcaaatcttagaaagcagataatccataatgaagagaaaccatacaaatgtgaaaaatgtggggatagcttaaaccatagtttgcaccttactcaacatcagatcattcctaccgaagagaaaccctataaatggaaagaatgtggcaaggtctttaaccttaactgtagtttataccttactaaacagcagcaaattgatactggagaaaacctttacaaatgtaaagcatgtagcaaatcttttactcgttcctccaatcttattgtgcatcagagaattcacactggagagaaaccatacaaatgtaaagaatgtggcaaagcctttcgctgtagttcataccttactaaacataagcgaattcatactggagagaaaccttataaatgtaaagaatgtggaaaagcttttaaccgtagttcatgccttactcaacatcagacaactcatacaggagaaaaactttacaaatgtaaagtatgtagcaaatcttatgctcgttcttcaaatcttattatgcatcagagagttcatactggagagaagccttataaatgtaaagaatgtggcaaagtctttagccgtagttcttgccttactcaacatcggaaaattcatactggagaaaatctttacaaatgcaaagtatgtgctaaaccttttacttgtttctcaaatcttattgtgcatgagagaattcatactggagagaaaccctataaatgtaaagaatgtggcaaagcctttccttatagttcacaccttattcgacattatcgaattcatactggagaaaaaccatacaaatgtaaagcatgtagcaaatcttttagtgactcctcaggtctttctgtgcatcggcgaactcatactggagagaaaccctatacatgtaaagaatgtggcaaagcctttagttatagttcagatgttattcagcatcggagaattcatactggccagagaccctacaaatgtgaagaatgtggcaaagccttcaactataggtcatacctcattgcacatcagagaagtcatactagagaaaaactttaaaaatgtaaaacatggagcagattttttacttgttacccatgtcttattgtgcatcagataatttatatgggagtgaaaccctacaaatgttaagaatgtggcataacctttaactattttcaagccttacacaatagcagagaatataaactgaaaaaatccatacaaatattaaaaatgtggcaaattattttaaactgtgctcaacccttactcaagataatccatactagagaaacactatagatgtaaaaatgtgaaaagttttattcaaaatatcaaacttatgagtcacctaggggttcatagaaaaaggaagtttgcagatgcaataaatgtgaggaagtatttaataaaaaatgaagtctaaatgtgtcagagaatttatgtgagaaaggactaaagcacagacactttcagcctttatactaaataagagtattttttgtacagaataatctaaaggcaaaataattagataatttatttgcttatatgttttaaagtagcaagaacattgatgttttgacaggtatatttcatagatacttcatttgtatttacagtatttgaggtttttggaaagcaaatattatttatataattcagctttcaaatctgttgctgcttttccttaatccgtggtgttcatgtgaaaatatgtgttctgtttttttttctgcatcagaacaatgtgaggtcattctacgttaatatcattaatatcagcatttttcatggaagtttaatgccaaatgtaaaacacatgaaaatttttaaaaatatgctctttgtgtttgaataaagtagtaatgcacgt

SEQ ID NO: 75511 - DNA, 762 bp, Homo sapiens
gtgttttgtgttatggatcgacaattttgtcggttctttgtagcgactaaccagtgccatgtttgttgattggatctcctttatcactctgatggtcaacagaccccacccacaactcttgctgcctccatacaccttgctattttcatttatcatgtgttggaacctaaaaacaaaactaagcacatgggaattatgcatggaatatgaataaatgggcactgcatatgcggctgagatgctgtcctacaaagaaagcacatgctcttcatggtattaactttgactttggcaattttctgcctgagagggcttgggctggaacttctgtactcatatgtcactgaagtcctgctaactccacaccccacggcatgtggatgcaaggctcccaccatggcctagctttctgacagcctttagtgagcgtgccccatgttctgtgcactcgacattgctggaaatggcccctcttctgcttgtttcgggactgtgctagacagctgaagttgtcatattgtgactctgtatagaagaggctttatcacattttacttttcatgaattctagctaatgcctttgattgtactgtgtacttttttgagacaaggactgcctaccttttctttttatcttcctaatagtctagcatagctcttgaggtacagtgctcaacactgtctgtttccttgctttgaaacatattatgtttttatttattatgttatttattaaacaaagcctttaaaggaataaaacaa

SEQ ID NO: 75512 - DNA, 566 bp, Homo sapiens
gctgcagctccggtggaaataataagatataaaccacgaggttgttatttgcatagaaatagcatggagccccaggcagcaagggagaaggacacagggatgatttgtctaaaattttaatgaaaacttttgctgaggcagagatttttaaaaactttctttctccctgcttttccccttccttcccctaccccccaaaccccatcattgattttacttaacatggttcagtttgaagagaaaaggttgacactccacatatcatactcccataatgcagcaacctgtaaattgtttcttcctttaatagatatgaagctgaagagacatgcattttcaacttaatacattgcatgtgtgcgcctggctttatggctatactccatcttgggcatacacatgatgttgcctgtcattagcctgtttttaattagtttacaccttcctatcttttgcttccaaagactcttactttttaaaggatttctttttatagccaacagtagtaaccttcatataaaataaatattttctggtgttttcctgtttttttacttttggtggtt

SEQ ID NO: 75513 - DNA, 840 bp, Homo sapiens
aaagaataaagtgatgaagtcaacaggtgttattaaaaaatgtgaataacaggaaaatgttttgttgtttgttttgttttgtctttgaagtctttcacagactagatttgaaggtttatgaaggatagggcaaaattttctaaggaaagttgcatcctatgacctcaggctgacttcaagtaagagtggatttgataaaggcattgtctttcttagagtatgtgcatcttggcagaggagcctggagaggcagtatagaaggattgttttagatgttggatctctgtaacctgcatttacattttgttgagccgttgtcatttgggggaaaacacgaaaaagaaaagatcattatcatgctactataatgcacatcacatagaattgcaatgatttgttggttgttcattccagtccaagaactgtgagtttctccagccaaaggtcttgtatttattgatctttctgtcccacaggcctaaaacagcagttggcccatggacagtttaataaatgtttgctgactaatagatagggtatctaaaatcttttccatggccttatctctggagattaaaattttccagcacttgtctataaaagatgtctatgcgtaactgtagggaagacattgtaatttctgaagaggaggagcaaaccgacaaggttattgtagcattgattataatgcatggtagcagtctattctcagacctttagatgcctatttacctgatgcactggcaccaatgcccccattttggtgtgccatcttcccttcaccacttgggacaacacagataataaaatcagctccaaaagctaacccatggtggatcc

SEQ ID NO: 75514 - DNA, 334 bp, Homo sapiens
gaattccccccccccccccccccccatagggtatctaaaatcttttccatggccttatctctggagattaaaattttccagcacttgtctataaaagatgtctatgcgtaactgtagggaagacattgtaatttctgaagaggaggagcaaaccgacaaggttattgtagcattgattataatgcatggtagcagtctattctcagacctttagatgcctatttacctgatgcactggcaccaatgcccccattttggtgtgccatcttcccttcaccacttgggacaacacagataataaaatcagctccaaaagctaacccatggtggatcc

SEQ ID NO: 75515 - DNA, 446 bp, Homo sapiens
tgaattagaaacagcaattgatggtggactttcactttggtctacacagtgctttgtgttatcagctgttgccacctcttcccacagtagaactctcaactcctagacatgactggttgaccagccgttccccaggaggatgtatgttccaccttgacctgtgtttggcaggcagtttccaaggtaccccacattgaggcagtgacccagcaccttcaccactgggttctttattcctgattatcaaaagtcagactactgctctgtggtaactgcatctcgtttggttgccatcactggatgcttggagtagccatgtgaacgttattactgtacacacttgggacagctccagggattttgtgtgtgtgaagttgcagaaaggaagaatgtccccatgctggggagaattaagcatgtcacctaattgtgtaacaagatgactt

SEQ ID NO: 75516 - DNA, 632 bp, Homo sapiens
gccgagctcttgggttactgcaacctccgccttcctggcttaagcaatttttgtgcctcagcctcccaagtatctgagattacaggcgtgtgccaccacacccagctattttttattttttatttttagtagagatggggtttcgccatgttggccagactggtctggaactcctggcctcaagtggtcctcccacctcggcctctcaaagtgctgggattacaggcgtgagccaccacgtttagctgagtataattttaaatagccctatgtgacaagtggctactttattggacagtgtagatctaagattaattcctcaactgttttgcactcaacaaagacatacctctgagttggcaaccagcagggtggataacgggccagtggtgataaaatcaaagaataggtaatgaaacaatcatccagttaacaatcagcaaggttcttcagagcctaattaatgtttaattctaaataaattgcaacaattaagaaaagtagtgtttttgtagttctttattgcatttgcagaagagtactgtattttgtgagaattgggaaatgtgttttaaagagatgtgtgaggaggaaaatctttcttcctcatctttacagtggttaggttcaga

SEQ ID NO: 75517 - DNA, 689 bp, Homo sapiens
tttgccctcgagtccagatttcggcacgaggtttaaatttcttgagacagagtctcactctgtcacctaggcgggagtacagtggcgagctcttgggttactgcaacctccgccttcctggtctcaagcgatcctcctgccttagcctcccaaagtgctgggattacaggtgtgagccactgcgcccgaccaagtctcagtttctaaatttataaaaatcaggagtgcaaaccagagcaagatttgtcaaagtctccagacacccagacatttgttactttcagctattgcagcttcatccttctgatataattttaaatagccctatgtgacaagtggctactttattggacagtgtagatctaagattaattcctcaactgttttgcactcaacaaagacatacctctgagttggcaaccagcagggtggataacgggccagtggtgataaaatcaaagaataggtaatgaaacaatcatccagttaacaatcagcaaggttcttcagagcctaattaatgtttaattctaaataaattgcaacaattaagaaaagtagtgtttttgtagttctttattgcatttgcagaagagtactgtattttgtgagaattgggaaatgtgttttaaagagatgtgtgaggaggaaaatctttcttcctcatctttacagtggttaggttcaga

SEQ ID NO: 75518 - DNA, 417 bp, Homo sapiens
  misc_feature (39)..(39): n is a, c, g, or t
  misc_feature (412)..(412): n is a, c, g, or t
tctttgcttgtctaaattctttagatataattattaacncagtcctttctccctttaaaagttactccaacttacactgctgtttattaagtgtaggtattgttttgagaagcttttatttcacacccaataaaagtgtgcaggattcctcttgttccagccttaccttcccgatgatcctagcacatacttgtgtgtatatacagacatgttacagtgccaagtgtacttcctactgtggtgtgatttaaaaaattgaaataccctaaactggaagaactcctcaaggtctaaactgcgcccggcctaagctaagtgttttaatacatgacctcactgacacttcacagtaggcctgtgaagtaagcataaagaagagctacagataagtttagggacccagacaggaacnccgga

SEQ ID NO: 75519 - DNA, 1075 bp, Homo sapiens
gatctgctatgttgcccacactagtctcaaactcctggtctcaagcgatcctcctgccttagcctcccaaagtgctgggattacaggtgtgagccactgcgcccgaccaagtctcagtttctaaatttataaaaatcaggagtgcaaaccagagcaagatttgtcaaagtctccagacacccagacatttgttactttcagctattgcagcttcatccttctgagtacatgagttagtgggcaagcccaacatttaaatttctttaaatggaagaaagaaagtggataagatagaaaaatcagggtgttgcactttattaagtgtaggtattgttttgagaagcttttatttcacacccaataaaagtgtgcaggattcctcttgttccagccttaccttcccgatgatcctagcacatacttgtgtgtatatacagacatgttacagtgccaagtgtacttcctactgtggtgtgatttaaaaaattgaaataccctaaactggaagaactcctcaaggtctaaactgccgaatcgaacttcctattgtaatggaaatgttctatagctgtactatctagtaccgtagccactagccacatgtagctgttgagcacttgaaatgtgtctagtgtgacgaagaattaagaattttagtgggattacaggcgtgagccaccacgtttagctgagtataattttaaatagccctatgtgacaagtggctactttattggacagtgtagatctaagattaattcctcaactgttttgcactcaacaaagacatacctctgagttggcaaccagcagggtggataacgggccagtggtgataaaatcaaagaataggtaatgaaacaatcatccagttaacaatcagcaaggttcttcagagcctaattaatgtttaattctaaataaattgcaacaattaagaaaagtagtgtttttgtagttctttattgcatttgcagaagagtactgtattttgtgagaattgggaaatgtgttttaaagagatgtgtgaggaggaaaatctttcttcctcatctttacagtggttaggttcaga

SEQ ID NO: 75520 - DNA, 837 bp, Homo sapiens
gatctgctatgttgcccacactagtctcaaactcctggtctcaagcgatcctcctgccttagcctcccaaagtgctgggattacaggtgtgagccactgcgcccgaccaagtctcagtttctaaatttataaaaatcaggagtgcaaaccagagcaagatttgtcaaagtctccagacacccagacatttgttactttcagctattgcagcttcatccttctgagtacatgagttagtgggcaagcccaacatttaaatttctttaaatggaagaaagaaagtggataagatagaaaaatcagggtgttgcactttattaagtgtaggtattgttttgagaagcttttatttcacacccaataaaagtgtgcaggattcctcttgttccagccttaccttcccgatgatcctagcacatacttgtgtgtatatacagacatgttacagtgccaagtgtacttcctactgtggtgtgatttaaaaaattgaaataccctaaactggaagaactcctcaaggtctaaactgccgaatcgaacttcctattgtaatggaaatgttctatagctgtactatctagtaccgtagccactagccacatgtagctgttgagcacttgaaatgtgtctagtgtgacgaagaattaagaattttagctgggcgcggtggcttacgcctgtaatcccagcactttgggaggccaaggtgggtggatcaccaggtcagaagatcgagaccatcccggctaacatggtgaaaccccatctctactgaaaaatacaaaataattagccgggcgtggtggcgtgcacctgtagtcccagctactcgggagg

SEQ ID NO: 75521 - DNA, 372 bp, Homo sapiens
gcaaaagccctcacttggtttcccttccacatcttctggtgtgaagctttaaaatatgttgctattgataatataaaataatatttgtactagaaacatgcatgtataaagttatttgccgatttgcaaacaacacaatgcacctttcctacactgttattcacaaggaccctggaaaaggtagaggcatcattagcccaaatttattttattttatttattttgagatggagttttgctcttgatgcccaggctggagtgcaatggcacgcgcgatcttggctcaccgcaacctccacctcccgggttcaagcaattctcctgcctcagcctcctgagtagctgagattacaggcatgtgccaccacacct

SEQ ID NO: 75522 - DNA, 798 bp, Homo sapiens
aaaacggaggataaattattgaaaaagtaattcagccaaattttacagaaccgaaggacacgattttccagatttgaagacgccactgagtgcccaacatagtggatgaaaatagacccataccaaaagacatgttgttatgaaacaaaagagacaaaaggaatctgttacaatgatgaaagtagcttttcaaatgacaactgcacagcaggcaatgagggaaaccactccaaattggagcaagttagaaggctctgggagagatttttttcaacaagatgaaactgataaagtacctaatacatttgaatgtattgagagttgatagaaatggggaaacacgtggaggtgaattgtatatagaaaagtgaggaaatgaaaaatcaaacagttttcatgagcaaattttaaaaatcctctagaataaagtagattatttagggaattacatccctcaactgtgaatattatttacataataaaaataaatactgaatatcattaaaagtaaatactgaatattgatctaactaaaattacagtataattcttttgggggcacatgtttatggttaggactggaatggtggaacatgcctaatcattatctgtggccatgagtatgatagttacagaagcacactaaatatcagaagaattagttaaagcaattcaaaagtgttgcctctagggagcagaaaatggggtgagcatggcagagagatactgttgtttttaattagtcttgtagaacaatttctctttttaatgtataaatatatgagtttagtaataagc

SEQ ID NO: 75523 - DNA, 206 bp, Homo sapiens
gcagttacaaagagaactagtggaaactgatgtcattcacaatacctttggaaattagcctggaccctctaccttcgtaaagcatgctgcctgaaagcgctccgtgaaaggatgattttttgtaaacttttatttttattaaaagagaaaaagatagtttacatcttggtaaggctgagaatggtcacttataaaaatgttgaaaa

SEQ ID NO: 75524 - DNA, 702 bp, Homo sapiens
ctccgtcttaaaaaaaaaaaaaaaaaaaaaaaaaaaaaaaaaaaaattgattgaatgttcagtccattttcttattagtcatgttccacccccaaaatgaagaggggggataagacgctgtgtgcgtagaagtatcaagttggacagaactgtatttagaaagagatgctggaagtctggaaagggctgcccatctgtatagttgacctcaatatatggtcgtctgtatagttggtcaactatatatggtcaactatacagctataaaatatggttgaccacaataaggcactgattaaattcaaaatcataagatacacgcactcagatttattcagacaaattgttcctcttcctgaaagatgtttttttaagtctgaaatttcaataagaaaaggattctaatcatttcaaagatctttttttaaaaaaaccttctttccccttcccacctcccccaatccttcttagtatatagatgaaaactccagccacccagccccaacttgacaggttcattttgtctccacctgggttgtgcaatatggtaacttctgtccttatgtagttattaaccacttggaatgtgattagtcccaatacagaagctctgtgcacaccagatttctaagacgtgtacaacaaaaggaatggaaaacatcacattatattttaatattgattatgtgttaaaatgatatt

SEQ ID NO: 75525 - DNA, 316 bp, Homo sapiens
tttttagtagagacggggtttcaccgtgttggtcaggctggtctcgaactcctgacctccagtgatccacccgcctcggcctcccaaaatgctgggattacaggcgtgagccactgcgcctggcccattatatatctttgaatatttcatttaagccttgtatataatacattcccaacaaatgattgttgaataatgaataaaagggatctatttagtgcattatggcattcttgtaggacgttgtattcgggttctccagagagacagaaccaataggatatatacagcatacagatatatgagaggggattta

SEQ ID NO: 75526 - DNA, 344 bp, Homo sapiens
taaatttatttatatagagttgtttgagctccttatacattttggttatcaatcccctgacagatgagtggtttgcatagtttctctcattctgtcagctgtgtcttcattttgatattgttttgctctgcagaagattttcaacttagtgttatcagttttgtcaatttttaatttgattaactgtgattttgaggtattattcaaaaaagttttgcctagaccaatgtccttcagattttttccaaagttttcttgtaatagcttcgtagattgaggtcttaaattttagtctttagtatatttggatttttttttttttttgagacagaatcatgctgtgt

SEQ ID NO: 75527 - DNA, 391 bp, Homo sapiens
ttccctgcttggggggtttgaataggctgatttccagactcgaggctgtcatatagcctttttgtttttcctggtagttttctgattttttttttttaatctttaattcatagaaaacagtttacttccatccaaattaggtgggaatttttttaaaccatatgtagacacaaaagagatattccttgccaactagtgacacatggcagatgaagacagagtgggagatacacttccggttcacaacagcacttctgagcagtttgtgcttaaccctttaggggagcatttgtgctcagaaccctggaatagcaggacagtgccagggccacacagagactcagtctggaaagagcctgcctaactgcagatggagcctgaaccctgcgct

SEQ ID NO: 75528 - DNA, 455 bp, Homo sapiens
gtgactgtgagtgggtacaggcttccttctggggtgatgaaagtattctggaactcagtggtggttgtacatcattgtgaatgtactaagtgccactgaattgctcacttgaaaatgattttttttttttttttttttttgagaccgggtctcgctctgctgcccaggcgggagtgtggtggtgcaatcatagctcactgcagccttgaactcccaggctcaagtgatcctccactttagcctctcgagtacctgggaccacaggcgcgtgccaccatgcttggctaatattttgtatttttagtagagatgaggttttgacacgttgcccaggctgatctcgaactcttggactcaagcaatgtacccacctcggcctcccaaagtgctaggattaaggcatgagtcagtcttaaaatggctaattttatgtcatgcaaatcttatccccatca

SEQ ID NO: 75529 - DNA, 413 bp, Homo sapiens
taaatgcacgaatgtatttcacttcctcttaaagcaaatacaaagtagggctgatattaactaccaaaatgacaaactttcatatgactgacctacatgcacacacagttagaataaacaccagggaagaggcccagacagtgacctcaggagttcaggcaagcaagggaaaactggaggctgggccaaagagtcttcacagaagagtggtgctctggtgtggaggaagtaataatctgagtcttcaagagagtgccagagtagtggagtgtcctcccggaggggtgggagtgatgctgggagttaactgagcccatccattgagcttggaagcccaagctaaagatctagacctctcattacttcccaatcagtgacaaagggagtgttttgaagccatgttagcccccaca

SEQ ID NO: 75530 - DNA, 344 bp, Homo sapiens
aataaacttctgttgttttaagccacctagttgtggtcacttgttatggcagcctttggaaaccaacacacccgcacatggcgtgtttaacgcaggctgatacaaccttaagaaaggaatggatgtggtcatcagcaatctccaatacctacagcaaatgggaagacagggaaggaccagaggtgtaggtaaagcaaaaagccacaggtcattaggaagtgatgctccaactgggcatggaaaaggagtttggagttaggaacacgacagatctgtctggacaaggatccagatctctcctagggggaaggaggggcaactaggacagtttttgtgtctgtggg

SEQ ID NO: 75531 - DNA, 412 bp, Homo sapiens
agaacctcagtggatctcagagagagccccagactgagggaagcatggatggatggagaaggatgcctcgctggggactgctgctgctgctctggggctcctgtacctttggtctcccgacagacaccaccacctttaaacgcttcatccgaaagttctacacagagtttgatcggcgtaacaaccgcattggcttcgccttggcccgctgaggccctctgccacccaggcaggccctgccttcagccctggcccagagctggaacactctctgagatgcccctctgcctgggcttatgccctcagatggagacattggatgtggagctcctgctggatgcgtgccctgacccctgcaccagcccttccctgctttgaggacaaagagaataaagacttcatgttcacagcc

SEQ ID NO: 75532 - DNA, 1393 bp, Homo sapiens
  misc_feature (2)..(2): n is a, c, g, or t
tnttccagaggattatgtaaccaaatccaagcacacaccactcaccacacaacagcaagtaagctgagaggatcttcctcaagagaatgccctcaatccgagaaagcctgaaggaacgaggtgtggacatggccaggcttggtcccgagtggagccaacccatgaagaggctgacacttggcaacaccacctcctccgtgatcctcaccaactacatggacacccagtactatggcgagattggcatcggcaccccaccccagaccttcaaagtcgtctttgacactggttcgtccaatgtttgggtgccctcctccaagtgcagccgtctctacactgcctgtgtgtatcacaagctcttcgatgcttcggattcctccagctacaagcacaatggaacagaactcaccctccgctattcaacagggacagtcagtggctttctcagccaggacatcatcaccgtgggtggaatcacggtgacacagatgtttggagaggtcacggagatgcccgccttacccttcatgctggccgagtttgatggggttgtgggcatgggcttcattgaacaggccattggcagggtcacccctatcttcgacaacatcatctcccaaggggtgctaaaagaggacgtcttctctttctactacaacagagattccgagaattcccaatcgctgggaggacagattgtgctgggaggcagcgacccccagcattacgaagggaatttccactatatcaacctcatcaagactggtgtctggcagattcaaatgaagggggtgtctgtggggtcatccaccttgctctgtgaagacggctgcctggcattggtagacaccggtgcatcctacatctcaggttctaccagctccatagagaagctcatggaggccttgggagccaagaagaggctgtttgattatgtcgtgaagtgtaacgagggccctacactccccgacatctctttccacctgggaggcaaagaatacacgctcaccagcgcggactatgtatttcaggaatcctacagtagtaaaaagctgtgcacactggccatccacgccatggatatcccgccacccactggacccacctgggccctgggggccaccttcatccgaaagttctacacagagtttgatcggcgtaacaaccgcattggcttcgccttggcccgctgaggccctctgccacccaggcaggccctgccttcagccctggcccagagctggaacactctctgagatgcccctctgcctgggcttatgccctcagatggagacattggatgtggagctcctgctggatgcgtgccctgacccctgcaccagcccttccctgctttgaggacaaagagaataaagacttcatgttcacagcc

SEQ ID NO: 75533 - DNA, 1465 bp, Homo sapiens
agaacctcagtggatctcagagagagccccagactgagggaagcatggatggatggagaaggatgcctcgctggggactgctgctgctgctctggggctcctgtacctttggtctcccgacagacaccaccacctttaaacggatcttcctcaagagaatgccctcaatccgagaaagcctgaaggaacgaggtgtggacatggccaggcttggtcccgagtggagccaacccatgaagaggctgacacttggcaacaccacctcctccgtgatcctcaccaactacatggacacccagtactatggcgagattggcatcggcaccccaccccagaccttcaaagtcgtctttgacactggttcgtccaatgtttgggtgccctcctccaagtgcagccgtctctacactgcctgtgtgtatcacaagctcttcgatgcttcggattcctccagctacaagcacaatggaacagaactcaccctccgctattcaacagggacagtcagtggctttctcagccaggacatcatcaccgtgggtggaatcacggtgacacagatgtttggagaggtcacggagatgcccgccttacccttcatgctggccgagtttgatggggttgtgggcatgggcttcattgaacaggccattggcagggtcacccctatcttcgacaacatcatctcccaaggggtgctaaaagaggacgtcttctctttctactacaacagagattccgagaattcccaatcgctgggaggacagattgtgctgggaggcagcgacccccagcattacgaagggaatttccactatatcaacctcatcaagactggtgtctggcagattcaaatgaagggggtgtctgtggggtcatccaccttgctctgtgaagacggctgcctggcattggtagacaccggtgcatcctacatctcaggttctaccagctccatagagaagctcatggaggccttgggagccaagaagaggctgtttgattatgtcgtgaagtgtaacgagggccctacactccccgacatctctttccacctgggaggcaaagaatacacgctcaccagcgcggactatgtatttcaggaatcctacagtagtaaaaagctgtgcacactggccatccacgccatggatatcccgccacccactggacccacctgggccctgggggccaccttcatccgaaagttctacacagagtttgatcggcgtaacaaccgcattggcttcgccttggcccgctgaggccctctgccacccaggcaggccctgccttcagccctggcccagagctggaacactctctgagatgcccctctgcctgggcttatgccctcagatggagacattggatgtggagctcctgctggatgcgtgccctgacccctgcaccagcccttccctgctttgaggacaaagagaataaagacttcatgttcacagcc

SEQ ID NO: 75534 - DNA, 2188 bp, Homo sapiens
  misc_feature (1541)..(1541): n is a, c, g, or t
  misc_feature (1544)..(1544): n is a, c, g, or t
agaacctcagtggatctcagagagagccccagactgagggaagcatggatggatggagaaggatgcctcgctggggactgctgctgctgctctggggctcctgtacctttggtctcccgacagacaccaccacctttaaacggatcttcctcaagagaatgccctcaatccgagaaagcctgaaggaacgaggtgtggacatggccaggcttggtcccgagtggagccaacccatgaagaggctgacacttggcaacaccacctcctccgtgatcctcaccaactacatggacacccagtactatggcgagattggcatcggcaccccaccccagaccttcaaagtcgtctttgacactggttcgtccaatgtttgggtgccctcctccaagtgcagccgtctctacactgcctgtgtgtatcacaagctcttcgatgcttcggattcctccagctacaagcacaatggaacagaactcaccctccgctattcaacagggacagtcagtggctttctcagccaggacatcatcaccgtgggtggaatcacggtgacacagatgtttggagaggtcacggagatgcccgccttacccttcatgctggccgagtttgatggggttgtgggcatgggcttcattgaacaggccattggcagggtcacccctatcttcgacaacatcatctcccaaggggtgctaaaagaggacgtcttctctttctactacaacagagattccgagaattcccaatcgctgggaggacagattgtgctgggaggcagcgacccccagcattacgaagggaatttccactatatcaacctcatcaagactggtgtctggcagattcaaatgaagggggtgtctgtggggtcatccaccttgctctgtgaagacggctgcctggcattggtagacaccggtgcatcctacatctcaggttctaccagctccatagagaagctcatggaggccttgggagccaagaagaggctgtttgattatgtcgtgaagtgtaacgagggccctacactccccgacatctctttccacctgggaggcaaagaatacacgctcaccagcgcggactatgtatttcaggaatcctacagtagtaaaaagctgtgcacactggccatccacgccatggatatcccgccacccactggacccacctgggccctgggggccaccttcatccgaaagttctacacagagtttgatcggcgtaacaaccgcattggcttcgccttggcccgctgaggccctctgccacccaggcaggccctgccttcagccctggcccagagctggaacactctctgagatgcccctctgcctgggcttatgccctcagatggagacattggatgtggagctcctgctggatgcgtgccctgacccctgcaccagcccttccctgctttgaggacaaagagaataaagacttcatgttcacagccaaaaaaaaaaaaaaaaaaaaaaaaaaaaaaaaaaaaaaaaaaaaaaaaaaaaaaaaaaaaaaaaaaaaaaaaaaanaanaaaaaaaaaaaaaaaaaaaaaaaaaaaaataggggggggggcgcgggccgggaaacacagtcaagtgggggggcgcgcgggagcccacaagatcaggagaaaaagacagtcgtaccaaacgacagatcgaacgcgacgcagacaactggggactgacgaaacgcagggagggacgctaaacacatcccaaacaacaaaaagccgaggggtcgagaacaacagctagctaggatgacacaaacaacagaacgacgaggaaccacagtgaagacaagagagatgctcataataacagcgagaaagaacacacaagtcccagtcatataacaaaacgccacacgggagcggagcagaaaacgaaagagacggagaaacacaggaagaaaacacacaagacagagacgaaggacaagcgggaggcagaacagaagacacgagaggggagagagcagagcagaaaggacccacgcaaacacgggaggcaaccgaggaagggagtgaagacgggcgagagatgcgagaccagaaaaggaggggcgtcggctaaaggacgacaagtctagagacgggagcagaaccacacaggcgagcagccggaggggacagcagcctcagaaagggaaataagaaagccagagacgcag

SEQ ID NO: 75535 - DNA, 855 bp, Homo sapiens
gcaggaagaggaggacacctccagtgctagtccgatgaattgggtcaagcaccggtctcaacacatccacgctctgtgagctctggtttcctcacctgtgaagaagggctaataacacccagtatgcaaggcaggcggtggaaccgaatcccagccatgcaacttgtgtgctgtgcaacgatggcaagttaacctgagcctgtttcctcatgagaaatgattaccttggaagctgcttctaacaatgtgactagaacctttaggaaaaacacatagcacaagcttgccacagaagagaggctcaacaaatagaaaaacttgatttccagcgctcttgttgggaataaatggaagtcactgtgaatattgcatactgccgagaagaggaaaaaaatcaagtttcttgcctaggactttctgtgcagctcctatgtcttagaagatgtgtttggctcccttttgtgaaaggcttttccttcagtttatttacctgtgtgaacagaattcaaaattctttcatcatttcgctaaagctcagtgaggagtgtcaactccacaagccaaaaagcctaatcctacgttggcagccagattacacacatctgaaattgaaccaccagaaataccatacccagaaaatcatttgatctgtgaactgaatcctgtgagggttccgggcctcctcaaggcagaaagggttcaatttgaaaggcggttattagccctgtcccatgagagggagcgggagatccacatctttcctgggagcctcgtgccttgcacacaccatcgaaaacctgttcatctgcactggaagcagcatgcaaataaaacgttttggctctataaaaaaag

SEQ ID NO: 75536 - DNA, 471 bp, Homo sapiens
gccaccacgcccagtctcatttctattctatgaatatttccatacatttttcctttcttgtacaccctgctctcttagccaccttcttgaaataatcgactgttgaactgttagtacttccctgaagaccaataatttccagattaatcgtgtttactccgtggatcactattataagtaatttaaatggatttctactaactgtgtgtgtgtgtaaatactagcaatactagcaaccaccattctttggtatgtctttgttaattttcttaagagttagtagagaattttgtcccagtcttactttctgtatcctatgggagatgaactaaactgccttattcactctaatcacttcatttgaaattcagtaagcctctctaatttcaaacactggcatcagcaagtcggtgagcatttgtgagcacacatttgtagatgtgtgtttttttaaaggcaaaaaaaaaaaaa

SEQ ID NO: 75537 - DNA, 426 bp, Homo sapiens
gacacaggccacatcacattgagtaccatggatttatgggtcagcattgccccctaagtcccaaggaaggggaaagacttagcaagctcaacctcatgtgattcacaaagggtttctttctgcatttgtattgactcagaataggacccagtacagagaatccactgttatctatgggtgtcattccttcagaaagaatgtacagtaaaattggctatttcatgctatgcaaacaaaatgaaactagtttgaagttgcaaagtgtctcccctcttgcgcccacgtagtcatccaagaaggaaactcctttcttgccttgatattcaccaggcctacctagatagaacttgacaaattggcctaacttcatctccgctgctattgttatatatttgctttactgaatctatgtcctatgtcagtcag

SEQ ID NO: 75538 - DNA, 753 bp, Homo sapiens
cacccgccatggcctcccaaagtgctgggattacaggcgtgagccaccgtgcccggccagaaaatacattctttacagcaaatgttataggttaaggagacagttcctgggtttagctgtgaaactgtttaggattttctttaagtggtgttcccaagagcttttttctggtaagttggaggctataggcaaagcgtctaggagcttgttgttttttgctatggaaggccagctttgggatctatatacatgggcatgtttctcaatggagtggtcacaggattctcttctcagaactctgcctgaaacctttccggtgtgttttgtcttcaactttttcctagctatcctattagcctgtaaatatgtcagcagacaatgtgtttggaagaaacaaggtgtacaacttcacaaagcaagttttttctggtctgagacttactgtgtgcaggaagtctcgtgagaatatacttagaaaatcacacttatctggaaattcaataagtcatattaaaaatatacaatttcttgaactcaggactagcctgaaaatccaaaatgcatgtagagttgacatgttgacatatgtctatgtcctctgtttttatttaagcctcatttatttctcccttgccatgcccatttgggattttctttgcccagcatatgtgccataaacagaacaaatggatccagggtatacctctaataacctttatctaaatagaatacatttaacctgtcaattatatg

SEQ ID NO: 75539 - DNA, 2673 bp, Homo sapiens
agccctctgcaggcatttgctctgggctccaggacgaactcctcgtcagctggtgcgtctgggttgggacagtgaaaatgtttagtgtcattggcgacaaatacacatacaggggatcccagtaggtaggctggtgcattggaggggcaggagcaagcccgacataggtgtgtgcacacacataggagtagctggccacatgtgtgtgtactttaaggagagactttagttttgggtttttttttttttttggttcctggggtaaattttctgttgaacatttttccctcctatttagttttttttcttttgcatttttaaaaatttgaacataaaaagtataaagaatcaaatctttgaaaggaccgaggcgtgcagcggacagcagatggatcccgcggccagcagctgcatgaggagcctccagcccccagcccctgtctggggctgccttcgaaacccccactcggaaggcaatggggcctcagggctaccccactacccgcccaccccgttctccttccaccagaaaccagacttcctggcgacagcgacggcagcgtaccctgacttctcagcctcctgcctggcagccaccccacacagcctgccccaggaggagcacatcttcactgagcagcaccccgctttcccacagtcccccaactggcacttccctgtctcagacgcccggcgcaggcccaactcaggcccggcagggggttccaaggaaatggggaccagcagcctgggcctggtggacaccacaggaggcccaggcgatgactacggggtgcttgggagcactgccaatgagacagagaagaaatcatccaggcggagaaaggagagttcagacaaccaggagaacagagggaagccggagggcagcagcaaagcccgcaaggagaggacggccttcaccaaggagcagctgcgagagctggaggcagagtttgcccatcataactacctgactcggctccgcagatatgagattgcggtaaacctggacctctctgagcgccaggtcaaagtgtggttccagaaccgaaggatgaagtggaagcgtgtgaagggaggtcagcccatctcccccaatgggcaggaccctgaggatggggactccacagcctctccaagttcagagtgagattctgcatggaggaaaaatgactaaggactgagccccctacccaactacccccaccccaatcccaccttcaccctcttccttccccagccagggcagcctctccacatctttccctgactcttggatatgaaactgcccagcattcctgggagtcttaggattttctaggaagttctgtccagcctcttagcagcctcttccctagggcctttgctcccacactctcatggaatcagacagagatcctaccgggccggatgaatctggaaacagcttcagagatactgcttctcagcgtctcttggctgccacccatgcctcctcctaccgctgttctcctaggtcagccaggcctcctcctggtctggacaccacctggcctggtgggagaggagctttggaaccagctggcgactcggaaagtaaatgcttcaaaaggaaggaaatgacagagacacacgcccttgcccaccttcctctgtaggctgcacatctgaggctttggggccccttagttgtcccgaaaccccaagaaaaatcagaatgaggagagtcaaggacagcaactcagctgctgcaagccagaaacacatccctgtctccaaatttgttggctaagtggagacacttctgagaactgactagagaagacaagaaaaatagcccgatgtaggtttcggtgtccccatataggccccgtccacacaggcttgactgggtggacaagaatgaacccatgacagcacctgctgcttcaaaatcaaaatcaatttagggatacagcaggggctgttgggctgtgctccagagaaaaggagcagctactccttttaaatccacgatttctggattgaaaacctgtccagatgctgagttgttgggctgaacaactaggagctgaaaacaacgtagaggctggaaagtgtcccctgcattctggaggggaggggagataataaggagggctgctgggtgagggcctggagatgtggaaccctggagtggaaggttctccagtgacagtgtcctgtgactgcaaaaggggacaagaaaatccctcttcctccatgggatggatttaagctcttgctgtgtgttctacaaatgctgttattgtgggaggaaatgctaggtttttgtgtgtggactgcccagacctcagccaggtcttctggagatgacatttgaggactgatggccaaagagcatgggggactgaagccctggctgcctcagcgctctgtctcccaacaccagctggtgttgcagagggaggtcaacgtgagtttggatctcttgtacgcagatgtaatcattcacatgtaaaaataaccccacctccccaccccaaaaagggcaagagctgtggaaaatgattgccaaatgagatggctggttagagcatgattttttctaaagcatacttcatatattttcttaagattacatcaagctaattgtgcgagctcaattcactttgtaagaaaactctcggagaaataaaatcaataaaaagc

SEQ ID NO: 75540 - DNA, 2493 bp, Homo sapiens
agccctctgcaggcatttgctctgggctccaggacgaactcctcgtcagctggtgcgtctgggttgggacagtgaaaatgtttagtgtcattggcgacaaatacacatacaggggatcccagtaggtaggctggtgcattggaggggcaggagcaagcccgacataggtgtgtgcacacacataggagtagctggccacatgtgtgtgtactttaaggagagactttagttttgggtttttttttttttttggttcctggggtaaattttctgttgaacatttttccctcctatttagttttttttcttttgcatttttaaaaatttgaacataaaaagtataaagaatcaaatctttgaaaggaccgaggcgtgcagcggacagcagatggatcccgcggccagcagctgcatgaggagcctccagcccccagcccctgtctggggctgccttcgaaacccccactcggaaggcaatggggcctcagggctaccccactacccgcccaccccgttctccttccaccagaaaccagacttcctggcgacagcgacggcagcgtaccctgacttctcagcctcctgcctggcagccaccccacacagcctgccccaggaggagcacatcttcaatgagacagagaagaaatcatccaggcggagaaaggagagttcagacaaccaggagaacagagggaagccggagggcagcagcaaagcccgcaaggagaggacggccttcaccaaggagcagctgcgagagctggaggcagagtttgcccatcataactacctgactcggctccgcagatatgagattgcggtaaacctggacctctctgagcgccaggtcaaagtgtggttccagaaccgaaggatgaagtggaagcgtgtgaagggaggtcagcccatctcccccaatgggcaggaccctgaggatggggactccacagcctctccaagttcagagtgagattctgcatggaggaaaaatgactaaggactgagccccctacccaactacccccaccccaatcccaccttcaccctcttccttccccagccagggcagcctctccacatctttccctgactcttggatatgaaactgcccagcattcctgggagtcttaggattttctaggaagttctgtccagcctcttagcagcctcttccctagggcctttgctcccacactctcatggaatcagacagagatcctaccgggccggatgaatctggaaacagcttcagagatactgcttctcagcgtctcttggctgccacccatgcctcctcctaccgctgttctcctaggtcagccaggcctcctcctggtctggacaccacctggcctggtgggagaggagctttggaaccagctggcgactcggaaagtaaatgcttcaaaaggaaggaaatgacagagacacacgcccttgcccaccttcctctgtaggctgcacatctgaggctttggggccccttagttgtcccgaaaccccaagaaaaatcagaatgaggagagtcaaggacagcaactcagctgctgcaagccagaaacacatccctgtctccaaatttgttggctaagtggagacacttctgagaactgactagagaagacaagaaaaatagcccgatgtaggtttcggtgtccccatataggccccgtccacacaggcttgactgggtggacaagaatgaacccatgacagcacctgctgcttcaaaatcaaaatcaatttagggatacagcaggggctgttgggctgtgctccagagaaaaggagcagctactccttttaaatccacgatttctggattgaaaacctgtccagatgctgagttgttgggctgaacaactaggagctgaaaacaacgtagaggctggaaagtgtcccctgcattctggaggggaggggagataataaggagggctgctgggtgagggcctggagatgtggaaccctggagtggaaggttctccagtgacagtgtcctgtgactgcaaaaggggacaagaaaatccctcttcctccatgggatggatttaagctcttgctgtgtgttctacaaatgctgttattgtgggaggaaatgctaggtttttgtgtgtggactgcccagacctcagccaggtcttctggagatgacatttgaggactgatggccaaagagcatgggggactgaagccctggctgcctcagcgctctgtctcccaacaccagctggtgttgcagagggaggtcaacgtgagtttggatctcttgtacgcagatgtaatcattcacatgtaaaaataaccccacctccccaccccaaaaagggcaagagctgtggaaaatgattgccaaatgagatggctggttagagcatgattttttctaaagcatacttcatatattttcttaagattacatcaagctaattgtgcgagctcaattcactttgtaagaaaactctcggagaaataaaatcaataaaaagc

SEQ ID NO: 75541 - DNA, 4734 bp, Homo sapiens
  misc_feature (1075)..(1075): n is a, c, g, or t
  misc_feature (1204)..(1204): n is a, c, g, or t
  misc_feature (2660)..(2660): n is a, c, g, or t
  misc_feature (3523)..(3523): n is a, c, g, or t
  misc_feature (3527)..(3527): n is a, c, g, or t
  misc_feature (3539)..(3539): n is a, c, g, or t
  misc_feature (3592)..(3592): n is a, c, g, or t
  misc_feature (3595)..(3595): n is a, c, g, or t
  misc_feature (3602)..(3602): n is a, c, g, or t
  misc_feature (3631)..(3631): n is a, c, g, or t
  misc_feature (3634)..(3634): n is a, c, g, or t
  misc_feature (3944)..(3944): n is a, c, g, or t
  misc_feature (4171)..(4171): n is a, c, g, or t
  misc_feature (4406)..(4406): n is a, c, g, or t
  misc_feature (4484)..(4484): n is a, c, g, or t
  misc_feature (4547)..(4547): n is a, c, g, or t
  misc_feature (4556)..(4556): n is a, c, g, or t
  misc_feature (4607)..(4607): n is a, c, g, or t
  misc_feature (4620)..(4620): n is a, c, g, or t
  misc_feature (4624)..(4624): n is a, c, g, or t
agccctctgcaggcatttgctctgggctccaggacgaactcctcgtcagctggtgcgtctgggttgggacagtgaaaatgtttagtgtcattggcgacaaatacacatacaggggatcccagtaggtaggctggtgcattggaggggcaggagcaagcccgacataggtgtgtgcacacacataggagtagctggccacatgtgtgtgtactttaaggagagactttagttttgggtttttttttttttttggttcctggggtaaattttctgttgaacatttttccctcctatttagttttttttcttttgcatttttaaaaatttgaacataaaaagtataaagaatcaaatctttgaaaggaccgaggcgtgcagcggacagcagatggatcccgcggccagcagctgcatgaggagcctccagcccccagcccctgtctggggctgccttcgaaacccccactcggaaggcaatggggcctcagggctaccccactacccgcccaccccgttctccttccaccagaaaccagacttcctggcgacagcgacggcagcgtaccctgacttctcagcctcctgcctggcagccaccccacacagcctgccccaggaggagcacatcttcactgagcagcaccccgctttcccacagtcccccaactggcacttccctgtctcagacgcccggcgcaggcccaactcaggcccggcagggggttccaaggaaatggggaccagcagcctgggcctggtggacaccacaggaggcccaggcgatgactacggggtgcttgggagcactgccaatgagacagagaagaaatcatccaggcggagaaaggagagttcaggtaggtggctcaggagcagctgatcattcctttactgtgtgaccctggggaagttactcaccctctctgtgcctaggtgctctgagcatgaatttctgtctagtccatccaaatgcaggagactggaccagttacctttggggtttcttccactgagagttctaggattctctggtgatggggaccatgtctgtgtcccagcactcctgggccccagnaagggtgtccagcaagagaatgaaacaggatcagccaggatttggaggacacgtgaaatggatcctctgggtgcagactggcgagggctggtgaggggctttcctgaatcaggctgccattgagtcatnctcctccccaccatgctttggccagccccaagtggtcctagagccacagggctcgcttaccagggaagttcagctgaggttaaggctctgagagctaagactgaagctgggaccctgggtggccacccaaagccaagaccctatgtgtccaggagcctagaggcagagaagcaggcctgcggctgggatgggagaatcaaggggtgagggggagatggagggctgaggtttggggcagactgcccaccagatatcaccctgcggagctgggccatgtccaggccaaggggacagacaactcagcatgctgagatctggctgaccccccaggaaggcagccccgcaaggagctgcaagggatgggcagcctctgagagagtcagggaggcaggcagccaagggagtccgtgctggagtcccagaggctggaggatgagattggcctatttgttaagattccagctaaagcccttctcttccccagggtggggacctgctgcttcctcacctccccaccaggccctccctggttgctcactatacctgtccaccttttgtctggttccttgtcccggcctcgttcagaacaaagcagtgaccaagcctcctgcccgtgctgccctgttttcctcctgacagccgccctcaggggcacgcctgtctgtcggagcctgtagaggaccttcccatggggctaaccagggcaggacagaaaagaaggacaccaaccaacaggtgggaatgctttgtgctttgctttataagcacagctttcccgagtttctgctcttagccaagcccaggaatgctctgagatgaataaaggggtctcacccaagaaagctcaaactgagaggaagaagaggcctgcagaggtgtgtcagcagtgggatgtgccctgatggggaggcttaaggtgccatgggatactgacgtcagctcttttgagtcccacgggtttgggagatggggacagcaggttttattagtaccttgattctctcaatctgcaaaatgaaagactgaaagttggtgagaacacagaaagaatggggtcaaactagagtgagcagctcatctccatttgcccaggacttttccagttttagcactgaaaatcctgtcgtaggaaaccccacagtcccaggcaaacagaagaattggtcaccctagaagtgagctcaaaccccaggcttcaggcccccggtatcacccccttcagtagatttcaaatgcagtcctcattttgaaatgatgtttggtctgtctgcttgaagaagccccttcttcaatgggagataggaactctagcagccctcatggctgctaaatagaagggccctttaaaccgccagccagttagatccccatcccgaaaattaactcatcctgcccctggtaggaaatgtgctaaggatgagaagcaactctcagcgacttggctctgaacctggtngaagagctttccccttggtggcggcacgcagcactgtggctccttcctctctgccactttccagagaactgacagccaagggcattgggaagggatagcaaagccaagagcctgctgggctcaggcagaatcttccagcattccgagtctcagcaaaacccaaatgcaccagctctctttttggcgagtggccgatggccctgcaatgcagagagaccattcacactaagcagctggccacccaggagtacagggacaccctcggctgaacggcctgcatgcttcagggtcagactttggtggagggaggttcccatccgcaggggccctgggcttccctaagggtcccctcaggagcaccagcagcagatgaggcagggcccagtgagctgactctcactcatccccctgtgattccagacaaactcactgttcagcatggaaatctttattgccgcaatgcttgcatcctcctttggaatttaactgaaggggaggaaggaggcaagaaagatcagctttgtaagagcccaaagaagggggaaagtgacgcaaggctcatgacctactccaggaatctggaattcagctcagaaaaggcaaacccacagagagccccccacccaaccctgccaatcctgagtctataattggatcccctctccaaaattgtgatattttgttcattatcaattttttgcattacttttgatttttacaaatattgccttaaaatattcttttttttttttttttgagatggagtctcactctaacgcccatgctggagtgcagtggcatagtttcaattcactgcaacctctgccccttgggttcaagcaattctcctgtctcagcctccngagnagctgggattanaggcgcacgccccctctcccggctaatttttgtatttttagtagagtcggggnttnaccatgntggtcaggatggtctcaaactcctgaccncgngatcagcccacctcggcctcccaaagtgctggcatgcgccaccgtgcccggccttccttaaaatattattgatcttgactacagaggggttgggcatgcccttgcatttgggcctccccaagtccaggctgagtggtccctggaaggttaaccagcattgatcagaaacgcgttttccatagttcttcccagccagacagacaggctgcagtgtcagcacggcaacttttggctgcatgactttggaaaagttcataacttcttccagcctttgtttccctggctgtaaaatgggcatatagcagtagcnccttccatagagagtctctctgtgaaggttagatgcagtgatccatgagattaactctgtgcctggcacatagtaagagttcaataaatagcagctgtaaatggtattaggcccatatttcctgaaccagccttcagaatataaggtctgacaaatatttctatatttatggggatggtggaattgaatatttcaattatgctgtctcagaaattcctgagtctagngaacttctggcaatcattttgttccagttgtcatcaggagcatggagctcagagacctgccggagaggttatggggtgagttgggcctggcaaatgcaccccatattgagtggctgagaagcctccagaaatggaaagtttattgtaagaggaatgttctctgcgcttccttcctcctttgccatctccttcaactgctccccgctcactcccagtagaatctggagctgatctnctcaaagaaattatcaagaaagcaagggttggccgggcgcggtggctcatgcctataatcccagcactttgggaggcngagccaggcggatcacctgaggccaggagttcaagactgacctggccaacatggtgaaacccnatctctacnaaaaatacaaaaaaaaaaaaaaaaattagccaggtgtggtggcaggcaccngtaaatcccagcnactngggaagctgaggcaggagaatagcttgaacttgggaggtggagattgcagtgagcagagatcacgccactgcacttcattcagcctgggtgacagagcgggactacatca

SEQ ID NO: 75542 - DNA, 2196 bp, Homo sapiens
agccctctgcaggcatttgctctgggctccaggacgaactcctcgtcagctgaaaccagacttcctggcgacagcgacggcagcgtaccctgacttctcagcctcctgcctggcagccaccccacacagcctgccccaggaggagcacatcttcactgagcagcaccccgctttcccacagtcccccaactggcacttccctgtctcagacgcccggcgcaggcccaactcaggcccggcagggggttccaaggaaatggggaccagcagcctgggcctggtggacaccacaggaggcccaggcgatgactacggggtgcttgggagcactgccaatgagacagagaagaaatcatccaggcggagaaaggagagttcagacaaccaggagaacagagggaagccggagggcagcagcaaagcccgcaaggagaggacggccttcaccaaggagcagctgcgagagctggaggcagagtttgcccatcataactacctgactcggctccgcagatatgagattgcggtaaacctggacctctctgagcgccaggtcaaagtgtggttccagaaccgaaggatgaagtggaagcgtgtgaagggaggtcagcccatctcccccaatgggcaggaccctgaggatggggactccacagcctctccaagttcagagtgagattctgcatggaggaaaaatgactaaggactgagccccctacccaactacccccaccccaatcccaccttcaccctcttccttccccagccagggcagcctctccacatctttccctgactcttggatatgaaactgcccagcattcctgggagtcttaggattttctaggaagttctgtccagcctcttagcagcctcttccctagggcctttgctcccacactctcatggaatcagacagagatcctaccgggccggatgaatctggaaacagcttcagagatactgcttctcagcgtctcttggctgccacccatgcctcctcctaccgctgttctcctaggtcagccaggcctcctcctggtctggacaccacctggcctggtgggagaggagctttggaaccagctggcgactcggaaagtaaatgcttcaaaaggaaggaaatgacagagacacacgcccttgcccaccttcctctgtaggctgcacatctgaggctttggggccccttagttgtcccgaaaccccaagaaaaatcagaatgaggagagtcaaggacagcaactcagctgctgcaagccagaaacacatccctgtctccaaatttgttggctaagtggagacacttctgagaactgactagagaagacaagaaaaatagcccgatgtaggtttcggtgtccccatataggccccgtccacacaggcttgactgggtggacaagaatgaacccatgacagcacctgctgcttcaaaatcaaaatcaatttagggatacagcaggggctgttgggctgtgctccagagaaaaggagcagctactccttttaaatccacgatttctggattgaaaacctgtccagatgctgagttgttgggctgaacaactaggagctgaaaacaacgtagaggctggaaagtgtcccctgcattctggaggggaggggagataataaggagggctgctgggtgagggcctggagatgtggaaccctggagtggaaggttctccagtgacagtgtcctgtgactgcaaaaggggacaagaaaatccctcttcctccatgggatggatttaagctcttgctgtgtgttctacaaatgctgttattgtgggaggaaatgctaggtttttgtgtgtggactgcccagacctcagccaggtcttctggagatgacatttgaggactgatggccaaagagcatgggggactgaagccctggctgcctcagcgctctgtctcccaacaccagctggtgttgcagagggaggtcaacgtgagtttggatctcttgtacgcagatgtaatcattcacatgtaaaaataaccccacctccccaccccaaaaagggcaagagctgtggaaaatgattgccaaatgagatggctggttagagcatgattttttctaaagcatacttcatatattttcttaagattacatcaagctaattgtgcgagctcaattcactttgtaagaaaactctcggagaaataaaatcaataaaaagc

SEQ ID NO: 75543 - DNA, 2500 bp, Homo sapiens
agccctctgcaggcatttgctctgggctccaggacgaactcctcgtcagctggtgcgtctgggttgggacagtgaaaatgtttagtgtcattggcgacaaatacacatacaggggatcccagtaggtaggctggtgcattggaggggcaggagcaagcccgacataggtgtgtgcacacacataggagtagctggccacatgtgtgtgtactttaaggagagactttagttttgggtttttttttttttttggttcctggggtaaattttctgttgaacatttttccctcctatttagttttttttcttttgcatttttaaaaatttgaacataaaaagtataaagaatcaaatctttgaaaggaccgaggcgtgcagcggacagcagatggatcccgcggccagcagctgcatgaggagcctccagcccccagcccctgtctggggctgccttcgaaacccccactcggaaggcaatggggcctcagggctaccccactacccgcccaccccgttctccttccaccagaaaccagacttcctggcgacagcgacggcagcgtaccctgacttctcagcctcctgcctggcagccaccccacacagcctgccccaggaggagcacatcttcactgagcagcaccccgctttcccacagtcccccaactggcacttccctgtctcagacgcccggcgcaggcccaactcaggcccggcagggggttccaaggaaatggggaccagcagcctgggcctggtggacaccacaggaggcccaggcgatgactacggggtgcttgggagcactgccaatgagacagagaagaaatcatccaggcggagaaaggagagttcaggtcaaagtgtggttccagaaccgaaggatgaagtggaagcgtgtgaagggaggtcagcccatctcccccaatgggcaggaccctgaggatggggactccacagcctctccaagttcagagtgagattctgcatggaggaaaaatgactaaggactgagccccctacccaactacccccaccccaatcccaccttcaccctcttccttccccagccagggcagcctctccacatctttccctgactcttggatatgaaactgcccagcattcctgggagtcttaggattttctaggaagttctgtccagcctcttagcagcctcttccctagggcctttgctcccacactctcatggaatcagacagagatcctaccgggccggatgaatctggaaacagcttcagagatactgcttctcagcgtctcttggctgccacccatgcctcctcctaccgctgttctcctaggtcagccaggcctcctcctggtctggacaccacctggcctggtgggagaggagctttggaaccagctggcgactcggaaagtaaatgcttcaaaaggaaggaaatgacagagacacacgcccttgcccaccttcctctgtaggctgcacatctgaggctttggggccccttagttgtcccgaaaccccaagaaaaatcagaatgaggagagtcaaggacagcaactcagctgctgcaagccagaaacacatccctgtctccaaatttgttggctaagtggagacacttctgagaactgactagagaagacaagaaaaatagcccgatgtaggtttcggtgtccccatataggccccgtccacacaggcttgactgggtggacaagaatgaacccatgacagcacctgctgcttcaaaatcaaaatcaatttagggatacagcaggggctgttgggctgtgctccagagaaaaggagcagctactccttttaaatccacgatttctggattgaaaacctgtccagatgctgagttgttgggctgaacaactaggagctgaaaacaacgtagaggctggaaagtgtcccctgcattctggaggggaggggagataataaggagggctgctgggtgagggcctggagatgtggaaccctggagtggaaggttctccagtgacagtgtcctgtgactgcaaaaggggacaagaaaatccctcttcctccatgggatggatttaagctcttgctgtgtgttctacaaatgctgttattgtgggaggaaatgctaggtttttgtgtgtggactgcccagacctcagccaggtcttctggagatgacatttgaggactgatggccaaagagcatgggggactgaagccctggctgcctcagcgctctgtctcccaacaccagctggtgttgcagagggaggtcaacgtgagtttggatctcttgtacgcagatgtaatcattcacatgtaaaaataaccccacctccccaccccaaaaagggcaagagctgtggaaaatgattgccaaatgagatggctggttagagcatgattttttctaaagcatacttcatatattttcttaagattacatcaagctaattgtgcgagctcaattcactttgtaagaaaactctcggagaaataaaatcaataaaaagc

SEQ ID NO: 75544 - DNA, 756 bp, Homo sapiens
gaattgagggagttataggcagaggaggatcctagctccagccataagaactgggagagccgcctgctgctccagaagacctgcccacctccacagaaatgctagcccttcagaccttctggtcagtgaactgggaccagctctgactaaggatgccttccatggcctgggactcgagttcttcagaaccaagaggctaactgggcttcctccaagaagggaccaggggctagaagcagaagttggcatcagcaaacatttctggaatctaccaaagggaggcccaggcagaaccccttcctcagtctcccttcccctcttccccccagccttgaagaggttgatcctttgtgctgtgtctcttagccctttcatcggggatgcccagaggcaacagcccaggctggaggttctcttccccttcctagaggaggaagtgaccaagtttgaaggcggcagaaatggccacacagccaagaagagcccatgcaactcagtccaggattttactgggtcagtgacattggtggaagccttcatgcctcctcattccacagcacttcctcctatgttgaccttaaacactggcttcccactgatacagactgggatgagctgagggcagtctcatttactgtcaagagttgtatttttgtattgtcctttttgccaagtctacatgtgttgactctgtaatggatttatgtagcccacttcagtctgcaaataaagcaaagtaactggaaaaaaaaaaaa

SEQ ID NO: 75545 - DNA, 1611 bp, Homo sapiens
tttatttatttatttatttatttatttatttatttatttatttatagagacaagggcttgccatgttacccaggctggtcttgaactcttgagctcgagcgatccccacctcccaaagtgctgggcttacaggtgtaagccatcatgtccagccgttcagatattctagttgaattggagttggtgggctagtacaccttctaaattaaatgagtaaaggatttagaatggtgcctgacacacagtaggtgctacattcatgttagctactattataaacctttcctgcctctgactttcagggtcttgcccaccaccagcgatgcccagcccttggtagagcttgaaccaccttctataaacaggatggcggtggagagacaggcccagtccctgagcccatgaggagtgtggccccttcaggcccaaagatggggaacatcactgcagacaactcctcgatgagctgtaccatcgaccataccatccaccagacgctggccccggtggtctatgttaccgtgctggtggtgggcttcccggccaactgcctgtccctctacttcggctacctgcagatcaaggcccggaacgagctgggcgtgtacctgtgcaacctgacggtggccgacctcttctacatctgctcgctgcccttctggctgcagtacgtgctgcagcacgacaactggtctcacggcgacctgtcctgccaggtgtgcggcatcctcctgtacgagaacatctacatcagcgtgggcttcctctgctgcatctccgtggaccgctacctggctgtggcccatcccttccgcttccaccagttccggaccctgaaggcggccgtcggcgtcagcgtggtcatctgggccaaggagctgctgaccagcatctacttcctgatgcacgaggaggtcatcgaggacgagaaccagcaccgcgtgtgctttgagcactaccccatccaggcatggcagcgcgccatcaactactaccgcttcctggtgggcttcctcttccccatctgcctgctgctggcgtcctaccagggcatcctgcgcgccgtgcgccggagccacggcacccagaagagccgcaaggaccagatccagcggctggtgctcagcaccgtggtcatcttcctggcctgcttcctgccctaccacgtgttgctgctggtgcgcagcgtctgggaggccagctgcgacttcgccaagggcgttttcaacgcctaccacttctccctcctgctcaccagcttcaactgcgtcgccgaccccgtgctctactgcttcgtcagcgagaccacccaccgggacctggcccgcctccgcggggcctgcctggccttcctcacctgctccaggaccggccgggccagggaggcctacccgctgggtgcccccgaggcctccgggaaaagcggggcccagggtgaggagcccgagctgttgaccaagctccacccggccttccagacccctaactcgccagggtcgggcgggttccccacgggcaggttggcctagcctgggtcctccgcgggtggctccacgtgaggcctgagcttcagcccacggcctcagggctgccgcctcctgcttccctcgc

SEQ ID NO: 75546 - DNA, 1557 bp, Homo sapiens
tttatttatttatttatttatttatttatttatttatttatttatagagacaagggcttgccatgttacccaggctggtcttgaactcttgagctcgagcgatccccacctcccaaagtgctgggcttacaggtgtaagccatcatgtccagccgttcagatattctagttgaattggagttggtgggctagtacaccttctaaattaaatgagtaaaggatttagaatggtgcctgacacacagtaggtgctacattcatgttagctactattataaacctttcctgcctctgactttcagggtcttgcccaccaccagcgatgcccagcccttggtagagcttgaaccaccttctataaacaggatggcggtggagagacaggcccagtccctgagcccatgaggagtgtggccccttcaggcccaaagatggggaacatcactgcagacaactcctcgatgagctgtaccatcgaccataccatccaccagacgctggccccggtggtctatgttaccgtgctggtggtgggcttcccggccaactgcctgtccctctacttcggctacctgcagatcaaggcccggaacgagctgggcgtgtacctgtgcaacctgacggtggccgacctcttctacatctgctcgctgcccttctggctgcagtacgtgctgcagcacgacaactggtctcacggcgacctgtcctgccaggtgtgcggcatcctcctgtacgagaacatctacatcagcgtgggcttcctctgctgcatctccgtggaccgctacctggctgtggcccatcccttccgcttccaccagttccggaccctgaaggcggccgtcggcgtcagcgtggtcatctgggccaaggagctgctgaccagcatctacttcctgatgcacgaggaggtcatcgaggacgagaaccagcaccgcgtgtgctttgagcactaccccatccaggcatggcagcgcgccatcaactactaccgcttcctggtgggcttcctcttccccccagccttgaagaggttgatcctttgtgctgtgtctcttagccctttcatcggggatgcccagaggcaacagcccaggctggaggtgccccagggaagggtgctcacagtggtcccagggctacacttggctttgactgcacagcccctgctcagatccttgtggagggtgtccgatgacttggggaggttctcttccccttcctagaggaggaagtgaccaagtttgaaggcggcagaaatggccacacagccaagaagagcccatgcaactcagtccaggattttactgggtcagtgacattggtggaagccttcatgcctcctcattccacagcacttcctcctatgttgaccttaaacactggcttcccactgatacagactgggatgagctgagggcagtctcatttactgtcaagagttgtatttttgtattgtcctttttgccaagtctacatgtgttgactctgtaatggatttatgtagcccacttcagtctgcaaataaagcaaagtaactggaaaaaaaaaaaa

SEQ ID NO: 75547 - DNA, 860 bp, Homo sapiens
gaattgagggagttataggcagaggaggatcctagctccagccataagaactgggagagccgcctgctgctccagaagacctgcccacctccacagaaatgctagcccttcagaccttctggtcagtgaactgggaccagctctgactaaggatgccttccatggcctgggactcgagttcttcagaaccaagaggctaactgggcttcctccaagaagggaccaggggctagaagcagaagttggcatcagcaaacatttctggaatctaccaaagggaggcccaggcagaaccccttcctcagtctcccttcccctcttccccccagccttgaagaggttgatcctttgtgctgtgtctcttagccctttcatcggggatgcccagaggcaacagcccaggctggaggtgccccagggaagggtgctcacagtggtcccagggctacacttggctttgactgcacagcccctgctcagatccttgtggagggtgtccgatgacttggggaggttctcttccccttcctagaggaggaagtgaccaagtttgaaggcggcagaaatggccacacagccaagaagagcccatgcaactcagtccaggattttactgggtcagtgacattggtggaagccttcatgcctcctcattccacagcacttcctcctatgttgaccttaaacactggcttcccactgatacagactgggatgagctgagggcagtctcatttactgtcaagagttgtatttttgtattgtcctttttgccaagtctacatgtgttgactctgtaatggatttatgtagcccacttcagtctgcaaataaagcaaagtaactggaaaaaaaaaaaa

SEQ ID NO: 75548 - DNA, 1453 bp, Homo sapiens
tttatttatttatttatttatttatttatttatttatttatttatagagacaagggcttgccatgttacccaggctggtcttgaactcttgagctcgagcgatccccacctcccaaagtgctgggcttacaggtgtaagccatcatgtccagccgttcagatattctagttgaattggagttggtgggctagtacaccttctaaattaaatgagtaaaggatttagaatggtgcctgacacacagtaggtgctacattcatgttagctactattataaacctttcctgcctctgactttcagggtcttgcccaccaccagcgatgcccagcccttggtagagcttgaaccaccttctataaacaggatggcggtggagagacaggcccagtccctgagcccatgaggagtgtggccccttcaggcccaaagatggggaacatcactgcagacaactcctcgatgagctgtaccatcgaccataccatccaccagacgctggccccggtggtctatgttaccgtgctggtggtgggcttcccggccaactgcctgtccctctacttcggctacctgcagatcaaggcccggaacgagctgggcgtgtacctgtgcaacctgacggtggccgacctcttctacatctgctcgctgcccttctggctgcagtacgtgctgcagcacgacaactggtctcacggcgacctgtcctgccaggtgtgcggcatcctcctgtacgagaacatctacatcagcgtgggcttcctctgctgcatctccgtggaccgctacctggctgtggcccatcccttccgcttccaccagttccggaccctgaaggcggccgtcggcgtcagcgtggtcatctgggccaaggagctgctgaccagcatctacttcctgatgcacgaggaggtcatcgaggacgagaaccagcaccgcgtgtgctttgagcactaccccatccaggcatggcagcgcgccatcaactactaccgcttcctggtgggcttcctcttccccccagccttgaagaggttgatcctttgtgctgtgtctcttagccctttcatcggggatgcccagaggcaacagcccaggctggaggttctcttccccttcctagaggaggaagtgaccaagtttgaaggcggcagaaatggccacacagccaagaagagcccatgcaactcagtccaggattttactgggtcagtgacattggtggaagccttcatgcctcctcattccacagcacttcctcctatgttgaccttaaacactggcttcccactgatacagactgggatgagctgagggcagtctcatttactgtcaagagttgtatttttgtattgtcctttttgccaagtctacatgtgttgactctgtaatggatttatgtagcccacttcagtctgcaaataaagcaaagtaactggaaaaaaaaaaaa

SEQ ID NO: 75549 - DNA, 1167 bp, Homo sapiens
  misc_feature (781)..(781): n is a, c, g, or t
ccaatgagaatggagaaggtccaggacacgtgggtgggggaagctgagcgctgagaccaagggctaaagctgggagactgaaaaaatgcagaccgccggggcattattcatttctccagctctgatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatggggggtcaccggcctgttgctactgcaactccacaccattcttggtgctggggtgtgttaagctttaccattaaacacaacgtttctctaaaaaaaaaaaaaaaagggcggccggtcgctgtggatatggatgccattagaagggtctacaccagatggctctctattgaaaaacttgaaactgctttctcaatgcacttgttttttcgtcacctaacgtggaatgtgacttgacgtatcacaatgtatactctcgagatcctaattatctgaatncgtcatatcgtatgggaatagaaatctccacagcctgaatatctggaaatggttgtgcccttatttcgccaaaggcgatgaagcaaagataccccctggaaggcccagggacacgggacacagacgggggccctaactccatgcggaccaggatcggggaatggtggaaacattccacacagcttatcactataacgccatacgccaggacctgaaccgcgaaacctcggggaaggttgagtatgccccggtggcgcccaaagcgtgacaggtccatgccagttcgggggggcgggaccaaccacgacaagataaaacccacgggtcacaggacacagcctggaaggaaagcagcgcggccgacaactggacagggacactcccac

SEQ ID NO: 75550 - DNA, 925 bp, Homo sapiens
ccaatgagaatggagaaggtccaggacacgtgggtgggggaagctgagcgctgagaccaagggctaaagctgggagactgaaaaaatgcagaccgccggggcattattcatttctccagctctgatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatggggggtcaccggcctgttgctactgcaactccacaccattcttggtgctggggtgtgttaagctttaccattaaacacaacgtttctctaaaaaaaagtaattgctgtgtgacgatgatgacgatgatgatgaagaggattgttggttgcggctgccggtgctaatgatttgttgagacacaagttgggagacagcgccggagaaattaaactgagaactccggcaaaaggaacaaccgtcagcagagtgggagagaccacacataataacgccgggggagacggggtgtcctcaacacgggagccgagcacaggcacacggcgaacataggatgtccccagaggtggcacggcgcccaattagtgtggtcacacaccagacccagcgcggtaaattaagagggagaaccatcacaacac

SEQ ID NO: 75551 - DNA, 706 bp, Homo sapiens
gcacgagcccagctgctcgggaggctgaggcaggagaatcgcttgagcccgggatgtggaggttgcagtgagctgagattgcaccattgcactccagcctggccaacagagcaagactccatctcaaaaaaaaaaaaaaaaaactcgagactagttctctctctcctcgtgccgaattcggcacgagggaagctgagcgctgagaccaagggctaaagctgggagactgaaacatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatggggggtcaccggcctgttgctactgcaactccacaccattcttggtgctggggtgtgttaagctttaccattaaacacaacgtttctctaaa

SEQ ID NO: 75552 - DNA, 746 bp, Homo sapiens
ccaatgagaatggagaaggtccaggacacgtgggtgggggaagctgagcgctgagaccaagggctaaagctgggagactgaaaaaatgcagaccgccggggcattattcatttctccagctctgatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatggggggtcaccggcctgttgctactgcaactccacaccattcttggtgctggggtgtgttaagctttaccattaaacacaacgtttctctaaatatatatctatacataatcatgtcggcccgcttggcccatcgactttagacttggcctgcttttgcatcgcgccgaattttggctcattggccaattggcctatagtgggccgatacaattcactggccgcgtttaccgtgtgactggt

SEQ ID NO: 75553 - DNA, 654 bp, Homo sapiens
  misc_feature (654)..(654): n is a, c, g, or t
ccaatgagaatggagaaggtccaggacacgtgggtgggggaagctgagcgctgagaccaagggctaaagctgggagactgaaaaaatgcagaccgccggggcattattcatttctccagctctgatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatggggggtcaccggcctgttgctactgcaactccacaccattcttggtgctggggtgtgttaagctttaccattaaacacaacgtttctctaaataaatatatttaattgcgccgcatttcaggctacttgcctcgccctgcgggtcgttn

SEQ ID NO: 75554 - DNA, 757 bp, Homo sapiens
  misc_feature (4)..(4): n is a, c, g, or t
ctanacggggggggggctgggagactgaaaaaatgcagaccgccggggcattattcatttctccagctctgatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatggggggtcaccggcctgttgctactgcaactccacaccattcttggtgctggggtgtgttaagctttaccattaaacacaacgtttctctaaagtgttttgaacaaaaattggacaagacctggaccctgtcgggcgccttgtccaataaaatttaaattcaggcaggttttgttgcggcccaatttcagctacttggccattggcctttaggggaggggtaacaaattagggcctgggtttaacacggggtgacgtggaaaacctgcgtccccaactttgctttgggcccctttccccagtgggt

SEQ ID NO: 75555 - DNA, 770 bp, Homo sapiens
ctgtatcttttaagacttctccagatgattccaccgtgcagccaagtttgagaaccactgcactaaaaattatttcaaaaaagccatgttacagatggctctccttggatggctattccagtcggtttccggggctgactggcccactccatttagggtgtgtagctgtgagtgtattttagcagaataaaatttcccccatctgattacttggtgatctgggtataaacctttcctgtacctgctttggtattagtgtgggttcttgttccattctgagaagctgattaaagctgtgcccaaagaagtgaactttggtttggttttgaatggtgaaggttgccactgctgactatatcaagctattgagacagctgtctctggggcaggcctatctgataggaacaggaataaattgaccttgaaatacattgaacttattctgtttatgaaatctgtagtcatttttgacagctcagcaattaggattttttttccttgactgatttggtaggatgtggctttctgattttacagaatccgctgttgtaccaggggtctaatcaggcctgtgtctgcctccttcttgaatagcccagtgaattcatctaaacaggtaagggaggaatagctctcttaggaatgttcccaaggcccaggatggtggctcacacctgtaatcccagctctttgagaggctgaggcgagaggatcacttgagcccagttgttcaagaccagcctgggcaacacagtgaaaccccatctcta

SEQ ID NO: 75556 - DNA, 312 bp, Homo sapiens
aactctacaggagcttacccgactagcctgacatgccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgggctagtcggggagtcggggctgtcgggctactacgtgt

SEQ ID NO: 75557 - DNA, 1165 bp, Homo sapiens
ccaatgagaatggagaaggtccaggacacgtgggtgggggaagctgagcgctgagaccaagggctaaagctgggaggtgagtctgtcaccttgagccgggcgagcgctgtgggccaagcaggggttgcagggcagtaggagtgcaggtgacttggggccgggagccagcaataggcagggttgtgggctgggcagtgtggaggggtatttccccccagtgctgggagaggctatggcaatctagatatggccttatcaatgaatgttaattaccaacggtaatgaacgattgactgcctcggctggggcgggtcggggactgctgtgtaagatgggcaggatcctgcgcgacacctgcccagtatccgcctccagtcttcccgagagaccattccctttcgcaacatttccttcctggggcttgggcacatttccttgacttccgatctccatgactttgctttgaagacccactgctctgtccctctgacctctaatgccctcctcagctggggcacggtgcaaggaagagcgtggtctagggaggacggacgggggtgaaggggacgaccaaaggtcgtcattataagcaaacaaccagggtctcagtgggattattattactattttttccccctctgcagactgaaaaaatgcagaccgccggggcattattcatttctccagctctgatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatggggggtcaccggcctgttgctactgcaactccacaccattcttggtgctggggtgtgttaagctttaccattaaacacaacgtttctctaaa

SEQ ID NO: 75558 - DNA, 858 bp, Homo sapiens
ccaatgagaatggagaaggtccaggacacgtgggtgggggaagctgagcgctgagaccaagggctaaagctgggaggtgagtctgtcaccttgagccgggcgagcgctgtgggccaagcaggggttgcagggcagtaggagtgcaggtgacttggggccgggagccagcaataggcagggttgtgggctgggcagtgtggaggggtatttccccccagtgctgggagaggctatggcaatctagatatggccttatcaatgaatgttaattaccaacggtaatgaacgattgactgcctcggctggggcgggtcggggactgctgtgtaagatgggcaggatcctgcgcgacacctgcccagatgtggctttctgattttacagaatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatggggggtcaccggcctgttgctactgcaactccacaccattcttggtgctggggtgtgttaagctttaccattaaacacaacgtttctctaaa

SEQ ID NO: 75559 - DNA, 1011 bp, Homo sapiens
ctgtatcttttaagacttctccagatgattccaccgtgcagccaagtttgagaaccactgcactaaaaattatttcaaaaaagccatgttacagatggctctccttggatggctattccagtcggtttccggggctgactggcccactccatttagggtgtgtagctgtgagtgtattttagcagaataaaatttcccccatctgattacttggtgatctgggtataaacctttcctgtacctgctttggtattagtgtgggttcttgttccattctgagaagctgattaaagctgtgcccaaagaagtgaactttggtttggttttgaatggtgaaggttgccactgctgactatatcaagctattgagacagctgtctctggggcaggcctatctgataggaacaggaataaattgaccttgaaatacattgaacttattctgtttatgaaatctgtagtcatttttgacagctcagcaattaggattttttttccttgactgatttggtaggatgtggctttctgattttacagaatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatggggggtcaccggcctgttgctactgcaactccacaccattcttggtgctggggtgtgttaagctttaccattaaacacaacgtttctctaaa

SEQ ID NO: 75560 - DNA, 653 bp, Homo sapiens
ccaatgagaatggagaaggtccaggacacgtgggtgggggaagctgagcgctgagaccaagggctaaagctgggagactgaaaaaatgcagaccgccggggcattattcatttctccagctctgatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatggggggtcaccggcctgttgctactgcaactccacaccattcttggtgctggggtgtgttaagctttaccattaaacacaacgtttctctaaaaaaaaaaaaaaaaaaaaaaaaaaaaaaaaaaaaaaaaggggggggggcaaaaaaaa

SEQ ID NO: 75561 - DNA, 564 bp, Homo sapiens
ccaatgagaatggagaaggtccaggacacgtgggtgggggaagctgagcgctgagaccaagggctaaagctgggagactgaaaaaatgcagaccgccggggcattattcatttctccagctctgatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatggaccattcttggtgctggggtgtgttaagctttaccattaaacacaacgtttctctaaa

SEQ ID NO: 75562 - DNA, 556 bp, Homo sapiens
  misc_feature (51)..(51): n is a, c, g, or t
atcgagtcggtaccaagttgtgtaggaaggctgtttagatgaattcactgnggctattcaagaggaggcagacacaggctgattagacccctggtacaacagcggatcagagctggagaaatgaataatgccccggcggtctgcattttttcagtctgcacccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatggggggtcaccggcctgttgctactgcaactccacaccattcttggtgctggggtgtgttaagctttaccattaaacacaacgtttctctaaa

SEQ ID NO: 75563 - DNA, 1221 bp, Homo sapiens
ccaatgagaatggagaaggtccaggacacgtgggtgggggaagctgagcgctgagaccaagggctaaagctgggaggtgagtctgtcaccttgagccgggcgagcgctgtgggccaagcaggggttgcagggcagtaggagtgcaggtgacttggggccgggagccagcaataggcagggttgtgggctgggcagtgtggaggggtatttccccccagtgctgggagaggctatggcaatctagatatggccttatcaatgaatgttaattaccaacggtaatgaacgattgactgcctcggctggggcgggtcggggactgctgtgtaagatgggcaggatcctgcgcgacacctgcccagtatccgcctccagtcttcccgagagaccattccctttcgcaacatttccttcctggggcttgggcacatttccttgacttccgatctccatgactttgctttgaagacccactgctctgtccctctgacctctaatgccctcctcagctggggcacggtgcaaggaagagcgtggtctagggaggacggacgggggtgaaggggacgaccaaaggtcgtcattataagcaaacaaccagggtctcagtgggattattattactattttttccccctctgcagactgaaaaaatgcagaccgccggggcattattcatttctccagctctgatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatggggggtcaccggcctgttgctactgcaactccacaccattcttggtgctggggtgtgttaagctttaccattaaacacaacgtttctctaaaaaaaaaaaaaaaaaaaaaaaaaaaaaaaaaaaaaaaaggggggggggcaaaaaaaa

SEQ ID NO: 75564 - DNA, 498 bp, Homo sapiens
ccaatgagaatggagaaggtccaggacacgtgggtgggggaagctgagcgctgagaccaagggctaaagctgggaggtgagtctgtcaccttgagccgggcgagcgctgtgggccaagcaggggttgcagggcagtaggagtgcagactgaaaaaatgcagaccgccggggcattattcatttctccagctctgatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaaccaagcaaccctggtaccgagctgatcactgc

SEQ ID NO: 75565 - DNA, 401 bp, Homo sapiens
tccagcctggctcacttaaacttaccaggttggcccactctgcttgtccatccaaatccccaggatctgtgcaggctaggccctctcccaggagtaacagtccccattcacctcaccctcctgtgtcctcccctcccctcaccccttcctctccctcaactggcaatgatctctgtccctcccaggaacccgtctctcaagcagcagctcttctcctatgccattcttggctttgccctgtctgaggccatggggcttttctgtttgatggtcgccttcctcatcctcttcgccatgtgaggctccatggggggtcaccggcctgttgctactgcaactccacaccattcttggtgctggggtgtgttaagctttaccattaaacacaacgtttctctaaa

SEQ ID NO: 75566 - DNA, 882 bp, Homo sapiens
ccaatgagaatggagaaggtccaggacacgtgggtgggggaagctgagcgctgagaccaagggctaaagctgggaggtgagtctgtcaccttgagccgggcgagcgctgtgggccaagcaggggttgcagggcagtaggagtgcaggtgacttggggccgggagccagcaataggcagggttgtgggctgggcagtgtggaggggtatttccccccagtgctgggagaggctatggcaatctagatatggccttatcaatgaatgttaattaccaacggtaatgaacgattgactgcctcggctggggcgggtcggggactgctgtgtaagatgggcaggatcctgcgcgacacctgcccagtatccgcctccagtcttcccgagagaccattccctttcgcaacatttccttcctggggcttgggcacatttccttgacttccgatctccatgactttgctttgaagacccactgctctgtccctctgacctctaatgccctcctcagctggggcacggtgcaaggaagagcgtggtctagggaggacggacgggggtgaaggggacgaccaaaggtcgtcattataagcaaacaaccagggtctcagtgggattattattactattttttccccctctgcagactgaaaaaatgcagaccgccggggcattattcatttctccagctctggtaaggtgccgcgccgcggtgctctgtagtaccaggtgtatggtgtggacgccatcagtgtttaatgaatgaacccagggagcttggcgtcctgatgatgtaggctctttgaggtggtgtaggatgtgatgaaggtaacccctgttatctgggcctgtgaacaagctatcttggttggaatgtggtcaga

SEQ ID NO: 75567 - DNA, 597 bp, Homo sapiens
ccaatgagaatggagaaggtccaggacacgtgggtgggggaagctgagcgctgagaccaagggctaaagctgggagactgaaaaaatgcagaccgccggggcattattcatttctccagctctgatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatggggggtcaccggcctgttgctactgcaactccacaccattcttggtgctggggtgtgttaagctttaccattaaacacaacgtttctctaaa

SEQ ID NO: 75568 - DNA, 667 bp, Homo sapiens
ccaatgagaatggagaaggtccaggacacgtgggtgggggaagctgagcgctgagaccaagggctaaagctgggaggtgagtctgtcaccttgagccgggcgagcgctgtgggccaagcaggggttgcagggcagtaggagtgcagactgaaaaaatgcagaccgccggggcattattcatttctccagctctgatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatggggggtcaccggcctgttgctactgcaactccacaccattcttggtgctggggtgtgttaagctttaccattaaacacaacgtttctctaaa

SEQ ID NO: 75569 - DNA, 586 bp, Homo sapiens
gcgcgacaaccccgacgtgtcggaaacttaggctaggtacgaggcctggtttgaatcggccgaggactgaaaaaatgcagaccgccggggcattattcatttctccagctctgatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatggggggtcaccggcctgttgctactgcaactccacaccattcttggtgctggggtgtgttaagctttaccattaaacacaacgtttctctaaa

SEQ ID NO: 75570 - DNA, 599 bp, Homo sapiens
cctagtcctgtctgctgtctgacaacagactctaagactaattcccagcatactctgcaatcagagtattctgcatttaccaggcagtttgccaacagtttcagagctcaggtgggtggggtgaaggaggtagagtcagccacctgtccttatgccatactatctctctgctatctcgcctgccttgcttctctttctagccttccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatggggggtcaccggcctgttgctactgcaactccacaccattcttggtgctggggtgtgttaagctttaccattaaacacaacgtttctctaaa

SEQ ID NO: 75571 - DNA, 1169 bp, Homo sapiens
  misc_feature (783)..(783): n is a, c, g, or t
cctagtcctgtctgctgtctgacaacagactctaagactaattcccagcatactctgcaatcagagtattctgcatttaccaggcagtttgccaacagtttcagagctcaggtgggtggggtgaaggaggtagagtcagccacctgtccttatgccatactatctctctgctatctcgcctgccttgcttctctttctagccttccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatggggggtcaccggcctgttgctactgcaactccacaccattcttggtgctggggtgtgttaagctttaccattaaacacaacgtttctctaaaaaaaaaaaaaaaagggcggccggtcgctgtggatatggatgccattagaagggtctacaccagatggctctctattgaaaaacttgaaactgctttctcaatgcacttgttttttcgtcacctaacgtggaatgtgacttgacgtatcacaatgtatactctcgagatcctaattatctgaatncgtcatatcgtatgggaatagaaatctccacagcctgaatatctggaaatggttgtgcccttatttcgccaaaggcgatgaagcaaagataccccctggaaggcccagggacacgggacacagacgggggccctaactccatgcggaccaggatcggggaatggtggaaacattccacacagcttatcactataacgccatacgccaggacctgaaccgcgaaacctcggggaaggttgagtatgccccggtggcgcccaaagcgtgacaggtccatgccagttcgggggggcgggaccaaccacgacaagataaaacccacgggtcacaggacacagcctggaaggaaagcagcgcggccgacaactggacagggacactcccac

SEQ ID NO: 75572 - DNA, 380 bp, Homo sapiens
ccaatgagaatggagaaggtccaggacacgtgggtgggggaagctgagcgctgagaccaagggctaaagctgggagactgaaaaaatgcagaccgccggggcattattcatttctccagctctgatccgctgttgtaccaggggtctaatcaggcctgtgtctgcctccttcttgatacggctgcgagaagacgacagaagggagagcacaagaggaagagagagaccctcactgctggggagtccctgccacactcagtcccccaccacactgaatctcccctcctcacagtttccatgtagaccccttgaagaggggaggggcctagggagccgcaccttgtcatgtaccatcaataaagtaccctgtgctcaacctt

SEQ ID NO: 75573 - DNA, 729 bp, Homo sapiens
ccaatgagaatggagaaggtccaggacacgtgggtgggggaagctgagcgctgagaccaagggctaaagctgggagactgaaaaaatgcagaccgccggggcattattcatttctccagctctgatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatggggggtcaccggcctgttgctactgcaactccacaccattcttggtgctggggtgtgttaagctttaccattaaacacaacgtttctctaaaaaagcctaccgacgatcaccccctacaccacctgtgcacgagccctccacgggctctctgagaagacgtctcctgcaggacccccggccggatggggccccgcgggggcccccaacggcgccgacacggcac

SEQ ID NO: 75574 - DNA, 1010 bp, Homo sapiens
ccaatgagaatggagaaggtccaggacacgtgggtgggggaagctgagcgctgagaccaagggctaaagctgggagactgaaaaaatgcagaccgccggggcattattcatttctccagctctgatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatggggggtcaccggcctgttgctactgcaactccacaccattcttggtgctggggtgtgttaagctttaccattaaacacaacgtttctctaaaaaaaaaaaaaaaaaaaaaaaaaaaaaaaagtgggtgcggcgcgcgcccgcgcggcccctcggaagaaagcctttatagaaaccacattgcgcggtggggcgcgcgcgggggccaccaggagaggaagagggaaacacggggccacaaagagggtgtgtactccaatgaggagaaactcgcggggacaagagaaagagaggggcggggaattctcccaccacaaataaaaagaggcgccgggggggaaaaacacggagagcggttttctgtgaaaaaaaattctccagagagagggggagtattggcagggggggcccatatacggggggaactcttatataaccgggggagactccccaagggagaagctagcgaaaaatccaaaatttatacgccccgcacggggggacgcg

SEQ ID NO: 75575 - DNA, 723 bp, Homo sapiens
ccaatgagaatggagaaggtccaggacacgtgggtgggggaagctgagcgctgagaccaagggctaaagctgggaggtgagtctgtcaccttgagccgggcgagcgctgtgggccaagcaggggttgcagggcagtaggagtgcagactgaaaaaatgcagaccgccggggcattattcatttctccagctctgatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatggggggtcaccggcctgttgctactgcaactccacaccattcttggtgctggggtgtgttaagctttaccattaaacacaacgtttctctaaaaaaaaaaaaaaaaaaaaaaaaaaaaaaaaaaaaaaaaggggggggggcaaaaaaaa

SEQ ID NO: 75576 - DNA, 479 bp, Homo sapiens
ccaatgagaatggagaaggtccaggacacgtgggtgggggaagctgagcgctgagaccaagggctaaagctgggagactgaaaaaatgcagaccgccggggcattattcatttctccagctctgatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgggctagtcggggagtcggggctgtcgggctactacgtgt

SEQ ID NO: 75577 - DNA, 932 bp, Homo sapiens
ccaatgagaatggagaaggtccaggacacgtgggtgggggaagctgagcgctgagaccaagggctaaagctgggagactgaaaaaatgcagaccgccggggcattattcatttctccagctctgccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatggggggtcaccggcctgttgctactgcaactccacaccattcttggtgctggggtgtgttaagctttaccattaaacacaacgtttctctaaaaaaaaaaaaaaaaaaaaaaaaaaaaaaaagtgggtgcggcgcgcgcccgcgcggcccctcggaagaaagcctttatagaaaccacattgcgcggtggggcgcgcgcgggggccaccaggagaggaagagggaaacacggggccacaaagagggtgtgtactccaatgaggagaaactcgcggggacaagagaaagagaggggcggggaattctcccaccacaaataaaaagaggcgccgggggggaaaaacacggagagcggttttctgtgaaaaaaaattctccagagagagggggagtattggcagggggggcccatatacggggggaactcttatataaccgggggagactccccaagggagaagctagcgaaaaatccaaaatttatacgccccgcacggggggacgcg

SEQ ID NO: 75578 - DNA, 814 bp, Homo sapiens
tccagcctggctcacttaaacttaccaggttggcccactctgcttgtccatccaaatccccaggatctgtgcaggctaggccctctcccaggagtaacagtccccattcacctcaccctcctgtgtcctcccctcccctcaccccttcctctccctcaactggcaatgatctctgtccctcccaggaacccgtctctcaagcagcagctcttctcctatgccattcttggctttgccctgtctgaggccatggggcttttctgtttgatggtcgccttcctcatcctcttcgccatgtgaggctccatggggggtcaccggcctgttgctactgcaactccacaccattcttggtgctggggtgtgttaagctttaccattaaacacaacgtttctctaaaaaaaaaaaaaaaaaaaaaaaaaaaaaaaagtgggtgcggcgcgcgcccgcgcggcccctcggaagaaagcctttatagaaaccacattgcgcggtggggcgcgcgcgggggccaccaggagaggaagagggaaacacggggccacaaagagggtgtgtactccaatgaggagaaactcgcggggacaagagaaagagaggggcggggaattctcccaccacaaataaaaagaggcgccgggggggaaaaacacggagagcggttttctgtgaaaaaaaattctccagagagagggggagtattggcagggggggcccatatacggggggaactcttatataaccgggggagactccccaagggagaagctagcgaaaaatccaaaatttatacgccccgcacggggggacgcg

SEQ ID NO: 75579 - DNA, 2552 bp, Homo sapiens
  misc_feature (1262)..(1262): n is a, c, g, or t
gagaaaagctcagtccccagtttgagtcagagtagggaccatgctgtcccaggttcaaggataaaaaccatcaggcccaagtgccatccatagtccatctccagagtcttcctccacaaactgggattcatccccgctgaaaaagcacaatctaacagcaagggaacaaaaaaaccatgctatcacataatactatgatgaagcagagaaaacagcaagcaacagccatcatgaaggaagtccatggaaatgatgttgatggcatggacctgggcaaaaaggtcagcatccccagagacatcatgttggaagaattatcccatctcagtaaccgtggtgccaggctatttaagatgcgtcaaagaagatctgacaaatacacatttgaaaatttccagtatcaatctagagcacaaataaatcacagtattgctatgcagaatgggaaagtggatggaagtaacttggaaggtggttcgcagcaagcccccttgactcctcccaacaccccagatccacgaagccctccaaatccagacaacattgctccaggatattctggaccactgaaggaaattcctcctgaaaaattcaacaccacagctgtccctaagtactatcaatctccctgggaacaagccattagcaatgatccggagcttttagaggctttatatcctaaacttttcaagcctgaaggaaaggcagaactgcctgattacaggagctttaacagggttgccacaccatttggaggttttgaaaaagcatcaagaatggttaaatttaaagttccagattttgagctactattgctaacagatcccaggtttatgtcctttgtcaatcccctttctggcagacggtcctttaataggactcctaagggatggatatctgagaatattcctatagtgataacaaccgaacctacagatgataccactgtaccagaatcagaagacctatgaaaagaaagttgtatgtgccacataaaactctgaatataaaagttgctgttctactattttaactactggcaaagccacttgcatttttcattagtagcaacaatagcaatttagtgattttccttttctgacattcaatttcaatctcagatcaaatactaataaacaattagaaatcttactttaaaaaacttataactcacttgtcttcattcataattttgttttcacctggtttaaagaatccagatattttactgcaaaagttcagatggaaaagtaattgacagnttcacctttgtctcattttatatgatttattacagtgtaagtttttcaagtggaatctagaatcaaaatacagggagagatatgaagacctattcagagtttcatctggggatgaaagctatggaagatgatgtacaaatgttattgatggagaaaatggttgggtgtgtcctttctggtgaccatgagaaaataatatgtcttgatgaagtcttttcattagtcactcttagaattctaaagtgctttgcacttttcaatatgttttgaatcattaggtaatttattctggatgatattctccaaaattcaattcagttattatattcatttagcattaagtcaaggagactgagaatgactcaagggacgtcatagtaccatagttttaaggaccaaggtgtgcccagaattcaagtttcacaaatcccaatgctgtgcattgattatgttcaactttatgtgtgcattcttagaagagtaagaacaaataaagtacaccgtaatatacatataaatacattcatgtttgtgagagaaggaaagagtaagtaatttgaattggcagctttctttgctaaatctttaaattctgttaagatcctcaagtaactggggagtacatgctttaggacacaaacaaaaacaaagggcatgaaagtatctgaaagcaatgtagcacatatctatcgtaatatatgtaatatattgacataaaagacacaaactaatataaagttatagttatatcttaaaatataattgaagaagcatatgacatataacttatagaaatcagtatcaattcctcccatttcaattcagttaagacttctgtgatagatgtttatagcagagaagaaatgtctcatcaatagaaaactatcagataaagtttaggagataggaagaaggactgtgtgtagtaatgaaaataccaagttgcaacattacatgtttacaaaaaaaaatctgtgtttgtagtgtggaagttggtgactgttttaatcatcatctagacttgttaagtagaaaaattttaaaaatttgcttatgaaaatataacccccagaaagtaacaatgacaaagtattatatttatatatattattgtagagaatttgtatatttttaaagatgtcttaagatatcttaattttatttataagttttggtgtttacctgttttaaaatgataatgttggcatctgtgataaactatcaatgaggctcccatcatgccattttttgttcattttaatctttaaaaaataaaaattaggcatatta

SEQ ID NO: 75580 - DNA, 727 bp, Homo sapiens
  misc_feature (708)..(708): n is a, c, g, or t
gagaaaagctcagtccccagtttgagtcagagtagggaccatgctgtcccaggttcaaggataaaaaccatcaggcccaagtgccatccatagtccatctccagagtcttcctccacaaactgggattcatccccgctgaaaaagcacaatctaacagcaagggaacaaaaaaaccatgctatcacataatactatgatgaagcagagaaaacagcaagcaacagccatcatgaaggaagtccatggaaatgatgttgatggcatggacctgggcaaaaaggtcagcatccccagagacatcatgttggaagaattatcccatctcagtaaccgtggtgccaggctatttaagatgcgtcaaagaagatctgacaaatacacatttgaaaatttccagtatcaatctagagcacaaataaatcacagtattgctatgcagaatgggaaagtggatggaagtaacttggaaggtggttcgcagcaagcccccttgactcctcccaacaccccagatccacgaagccctccaaatccagacaacattgctccaggatattctggaccactgaaggaaattcctcctgaaaaattcaacaccacagctgtccctaagtactatcaatctccctgggaacaagccattagcaatgatccggagcttttagaggctttatatcctaaacttttcaagccttgaagaaaagcanacttgcttgataccagagc

SEQ ID NO: 75581 - DNA, 2728 bp, Homo sapiens
  misc_feature (1262)..(1262): n is a, c, g, or t
gagaaaagctcagtccccagtttgagtcagagtagggaccatgctgtcccaggttcaaggataaaaaccatcaggcccaagtgccatccatagtccatctccagagtcttcctccacaaactgggattcatccccgctgaaaaagcacaatctaacagcaagggaacaaaaaaaccatgctatcacataatactatgatgaagcagagaaaacagcaagcaacagccatcatgaaggaagtccatggaaatgatgttgatggcatggacctgggcaaaaaggtcagcatccccagagacatcatgttggaagaattatcccatctcagtaaccgtggtgccaggctatttaagatgcgtcaaagaagatctgacaaatacacatttgaaaatttccagtatcaatctagagcacaaataaatcacagtattgctatgcagaatgggaaagtggatggaagtaacttggaaggtggttcgcagcaagcccccttgactcctcccaacaccccagatccacgaagccctccaaatccagacaacattgctccaggatattctggaccactgaaggaaattcctcctgaaaaattcaacaccacagctgtccctaagtactatcaatctccctgggaacaagccattagcaatgatccggagcttttagaggctttatatcctaaacttttcaagcctgaaggaaaggcagaactgcctgattacaggagctttaacagggttgccacaccatttggaggttttgaaaaagcatcaagaatggttaaatttaaagttccagattttgagctactattgctaacagatcccaggtttatgtcctttgtcaatcccctttctggcagacggtcctttaataggactcctaagggatggatatctgagaatattcctatagtgataacaaccgaacctacagatgataccactgtaccagaatcagaagacctatgaaaagaaagttgtatgtgccacataaaactctgaatataaaagttgctgttctactattttaactactggcaaagccacttgcatttttcattagtagcaacaatagcaatttagtgattttccttttctgacattcaatttcaatctcagatcaaatactaataaacaattagaaatcttactttaaaaaacttataactcacttgtcttcattcataattttgttttcacctggtttaaagaatccagatattttactgcaaaagttcagatggaaaagtaattgacagnttcacctttgtctcattttatatgatttattacagtgtaagtttttcaagtggaatctagaatcaaaatacagggagagatatgaagacctattcagagtttcatctggggatgaaagctatggaagatgatgtacaaatgttattgatggagaaaatggttgggtgtgtcctttctggtgaccatgagaaaataatatgtcttgatgaagtcttttcattagtcactcttagaattctaaagtgctttgcacttttcaatatgttttgaatcattaggtaatttattctggatgatattctccaaaattcaattcagttattatattcatttagcattaagtcaaggagactgagaatgactcaagggacgtcatagtaccatagttttaaggaccaaggtgtgcccagaattcaagtttcacaaatcccaatgctgtgcattgattatgttcaactttatgtgtgcattcttagaagagtaagaacaaataaagtacaccgtaatatacatataaatacattcatgtttgtgagagaaggaaagagtaagtaatttgaattggcagctttctttgctaaatctttaaattctgttaagatcctcaagtaactggggagtacatgctttaggacacaaacaaaaacaaagggcatgaaagtatctgaaagcaatgtagcacatatctatcgtaatatatgtaatatattgacataaaagacacaaactaatataaagttatagttatatcttaaaatataattgaagaagcatatgacatataacttatagaaatcagtatcaattcctcccatttcaattcagttaagacttctgtgatagatgtttatagcagagaagaaatgtctcatcaatagaaaactatcagataaagtttaggagataggaagaaggactgtgtgtagtaatgaaaataccaagttgcaacattacatgtttacaaaaaaaaatctgtgtttgtagtgtggaagttggtgactgttttaatcatcatctagacttgttaagtagaaaaattttaaaaatttgcttatgaaaatataacccccagaaagtaacaatgacaaagtattatatttatatatattattgtagagaatttgtatatttttaaagatgtcttaagatatcttaattttatttataagttttggtgtttacctgttttaaaatgataatgttggcatctgtgataaactatcaatgaggctcccatcatgccattttttgttcattttaatctttaaaaaataaaaattaggcatattacaaaaataaaaaaaaaaaaaaaactgtgggggccggccacaaaaagtttaaaacatcgtggggggcgggccaaagtaggaaacggtaagggccagaaaacggaaagagggggttccccaaaaaacgcgggacggagtggaaacacaggtcggacagggaacaagggcggcgaaagg

SEQ ID NO: 75582 - DNA, 2912 bp, Homo sapiens
  misc_feature (1446)..(1446): n is a, c, g, or t
agtggttcccaatccccacatttaaaatggaatgtttggtttatttaaagtaaataggctattttttcttactgggtctggcttctctggcccttcgcatacgtgtgtctgctgagtgttcctgcatgtaagaattaagaccaagggaggggagagagaaacccacacataaacaatgcactaaagatcactgaactgtttaaacatttccacttgccagtttaatttcttgaagactgttgcttgtttggaatgtttcttgtcactgattttaaggttgcatctggaaaagactaaaggcttcagtcccctcccaccaccagaaaaaccacaatctaacagcaagggaacaaaaaaaccatgctatcacataatactatgatgaagcagagaaaacagcaagcaacagccatcatgaaggaagtccatggaaatgatgttgatggcatggacctgggcaaaaaggtcagcatccccagagacatcatgttggaagaattatcccatctcagtaaccgtggtgccaggctatttaagatgcgtcaaagaagatctgacaaatacacatttgaaaatttccagtatcaatctagagcacaaataaatcacagtattgctatgcagaatgggaaagtggatggaagtaacttggaaggtggttcgcagcaagcccccttgactcctcccaacaccccagatccacgaagccctccaaatccagacaacattgctccaggatattctggaccactgaaggaaattcctcctgaaaaattcaacaccacagctgtccctaagtactatcaatctccctgggaacaagccattagcaatgatccggagcttttagaggctttatatcctaaacttttcaagcctgaaggaaaggcagaactgcctgattacaggagctttaacagggttgccacaccatttggaggttttgaaaaagcatcaagaatggttaaatttaaagttccagattttgagctactattgctaacagatcccaggtttatgtcctttgtcaatcccctttctggcagacggtcctttaataggactcctaagggatggatatctgagaatattcctatagtgataacaaccgaacctacagatgataccactgtaccagaatcagaagacctatgaaaagaaagttgtatgtgccacataaaactctgaatataaaagttgctgttctactattttaactactggcaaagccacttgcatttttcattagtagcaacaatagcaatttagtgattttccttttctgacattcaatttcaatctcagatcaaatactaataaacaattagaaatcttactttaaaaaacttataactcacttgtcttcattcataattttgttttcacctggtttaaagaatccagatattttactgcaaaagttcagatggaaaagtaattgacagnttcacctttgtctcattttatatgatttattacagtgtaagtttttcaagtggaatctagaatcaaaatacagggagagatatgaagacctattcagagtttcatctggggatgaaagctatggaagatgatgtacaaatgttattgatggagaaaatggttgggtgtgtcctttctggtgaccatgagaaaataatatgtcttgatgaagtcttttcattagtcactcttagaattctaaagtgctttgcacttttcaatatgttttgaatcattaggtaatttattctggatgatattctccaaaattcaattcagttattatattcatttagcattaagtcaaggagactgagaatgactcaagggacgtcatagtaccatagttttaaggaccaaggtgtgcccagaattcaagtttcacaaatcccaatgctgtgcattgattatgttcaactttatgtgtgcattcttagaagagtaagaacaaataaagtacaccgtaatatacatataaatacattcatgtttgtgagagaaggaaagagtaagtaatttgaattggcagctttctttgctaaatctttaaattctgttaagatcctcaagtaactggggagtacatgctttaggacacaaacaaaaacaaagggcatgaaagtatctgaaagcaatgtagcacatatctatcgtaatatatgtaatatattgacataaaagacacaaactaatataaagttatagttatatcttaaaatataattgaagaagcatatgacatataacttatagaaatcagtatcaattcctcccatttcaattcagttaagacttctgtgatagatgtttatagcagagaagaaatgtctcatcaatagaaaactatcagataaagtttaggagataggaagaaggactgtgtgtagtaatgaaaataccaagttgcaacattacatgtttacaaaaaaaaatctgtgtttgtagtgtggaagttggtgactgttttaatcatcatctagacttgttaagtagaaaaattttaaaaatttgcttatgaaaatataacccccagaaagtaacaatgacaaagtattatatttatatatattattgtagagaatttgtatatttttaaagatgtcttaagatatcttaattttatttataagttttggtgtttacctgttttaaaatgataatgttggcatctgtgataaactatcaatgaggctcccatcatgccattttttgttcattttaatctttaaaaaataaaaattaggcatattacaaaaataaaaaaaaaaaaaaaactgtgggggccggccacaaaaagtttaaaacatcgtggggggcgggccaaagtaggaaacggtaagggccagaaaacggaaagagggggttccccaaaaaacgcgggacggagtggaaacacaggtcggacagggaacaagggcggcgaaagg

SEQ ID NO: 75583 - DNA, 1153 bp, Homo sapiens
gagaaaagctcagtccccagtttgagtcagagtagggaccatgctgtcccaggttcaaggataaaaaccatcaggcccaagtgccatccatagtccatctccagagtcttcctccacaaactgggattcatccccgctgaaaaagcacaatctaacagcaagggaacaaaaaaaccatgctatcacataatactatgatgaagcagagaaaacagcaagcaacagccatcatgaaggaagtccatggaaatgatgttgatggcatggacctgggcaaaaaggtcagcatccccagagacatcatgttggaagaattatcccatctcagtaaccgtggtgccaggctatttaagatgcgtcaaagaagatctgacaaatacacatttgaaaatttccagtatcaatctagagcacaaataaatcacagtattgctatgcagaatgggaaagtggatggaagtaacttggaaggtggttcgcagcaagcccccttgactcctcccaacaccccagatccacgaagccctccaaatccagacaacattgctccaggatattctggaccactgaaggaaattcctcctgaaaaattcaacaccacagctgtccctaagtactatcaatctccctgggaacaagccattagcaatgatccggagcttttagaggctttatatcctaaacttttcaagcctgaaggaaaggcagaactgcctgattacaggagctttaacagggttgccacaccatttggaggttttgaaaaagcatcaagaatggttaaatttaaagttccagattttgagctactattgctaacagatcccaggtttatgtcctttgtcaatcccctttctggcagacggtcctttaataggactcctaagggatggatatctgagaatattcctatagtgataacaaccgaacctacagatgataccactgtaccagaatcagaagacctatgaaaagaaagttgtatgtgccacataaaactctgaatataaaagttgctgttctactattttaactactggcaaagccacttgcatttttcattagtagcaacaatagcaatttagtgattttccttttctgacattcaatttcaatctcagatcaaatactaataaacaattagaaatcttac

SEQ ID NO: 75584 - DNA, 574 bp, Homo sapiens
gagaaaagctcagtccccagtttgagtcagagtagggaccatgctgtcccaggttcaaggataaaaaccatcaggcccaagtgccatccatagtccatctccagagtcttcctccacaaactgggattcatccccgctgaaaaagcacaatctaacagcaagggaacaaaaaaaccatgctatcacataatactatgatgaagcagagaaaacagcaagcaacagccatcatgaaggaagtccatggaaatgatgttgatggcatggacctgggcaaaaaggtcagcatccccagagacatcatgttggaagaattatcccatctcagtaaccgtggtgccaggctatttaagatgcgtcaaagaagatctgacaaatacacatttgaaaatttccagtatcaatctagagcacaaataaatcacagtattgctatgcagaatgggaaagtggatggaagtaacttggaaggtggtcgacaccccttgatctccacaccagtcagggctcaaccaaaaattcccggttttggccaggggattccctaaataaccattcctatttttcccgggaa

SEQ ID NO: 75585 - DNA, 2064 bp, Homo sapiens
  misc_feature (598)..(598): n is a, c, g, or t
tagcggtacctctctcccagaaaaggcagctgaaggaaaggcagaactgcctgattacaggagctttaacagggttgccacaccatttggaggttttgaaaaagcatcaagaatggttaaatttaaagttccagattttgagctactattgctaacagatcccaggtttatgtcctttgtcaatcccctttctggcagacggtcctttaataggactcctaagggatggatatctgagaatattcctatagtgataacaaccgaacctacagatgataccactgtaccagaatcagaagacctatgaaaagaaagttgtatgtgccacataaaactctgaatataaaagttgctgttctactattttaactactggcaaagccacttgcatttttcattagtagcaacaatagcaatttagtgattttccttttctgacattcaatttcaatctcagatcaaatactaataaacaattagaaatcttactttaaaaaacttataactcacttgtcttcattcataattttgttttcacctggtttaaagaatccagatattttactgcaaaagttcagatggaaaagtaattgacagnttcacctttgtctcattttatatgatttattacagtgtaagtttttcaagtggaatctagaatcaaaatacagggagagatatgaagacctattcagagtttcatctggggatgaaagctatggaagatgatgtacaaatgttattgatggagaaaatggttgggtgtgtcctttctggtgaccatgagaaaataatatgtcttgatgaagtcttttcattagtcactcttagaattctaaagtgctttgcacttttcaatatgttttgaatcattaggtaatttattctggatgatattctccaaaattcaattcagttattatattcatttagcattaagtcaaggagactgagaatgactcaagggacgtcatagtaccatagttttaaggaccaaggtgtgcccagaattcaagtttcacaaatcccaatgctgtgcattgattatgttcaactttatgtgtgcattcttagaagagtaagaacaaataaagtacaccgtaatatacatataaatacattcatgtttgtgagagaaggaaagagtaagtaatttgaattggcagctttctttgctaaatctttaaattctgttaagatcctcaagtaactggggagtacatgctttaggacacaaacaaaaacaaagggcatgaaagtatctgaaagcaatgtagcacatatctatcgtaatatatgtaatatattgacataaaagacacaaactaatataaagttatagttatatcttaaaatataattgaagaagcatatgacatataacttatagaaatcagtatcaattcctcccatttcaattcagttaagacttctgtgatagatgtttatagcagagaagaaatgtctcatcaatagaaaactatcagataaagtttaggagataggaagaaggactgtgtgtagtaatgaaaataccaagttgcaacattacatgtttacaaaaaaaaatctgtgtttgtagtgtggaagttggtgactgttttaatcatcatctagacttgttaagtagaaaaattttaaaaatttgcttatgaaaatataacccccagaaagtaacaatgacaaagtattatatttatatatattattgtagagaatttgtatatttttaaagatgtcttaagatatcttaattttatttataagttttggtgtttacctgttttaaaatgataatgttggcatctgtgataaactatcaatgaggctcccatcatgccattttttgttcattttaatctttaaaaaataaaaattaggcatattacaaaaataaaaaaaaaaaaaaaactgtgggggccggccacaaaaagtttaaaacatcgtggggggcgggccaaagtaggaaacggtaagggccagaaaacggaaagagggggttccccaaaaaacgcgggacggagtggaaacacaggtcggacagggaacaagggcggcgaaagg

SEQ ID NO: 75586 - DNA, 973 bp, Homo sapiens
attttctcttttcaggcaaagcaaatactaatgctatttctgtaaccacagatcaagagaacagtatgcgtaacatcttatgcctaaagttccttgtttgtgttgagaaaaagcctcagcatatacaattatgcataaaataaactttcatagcatgccatccaacttatttgttattcgatgtaagcatggagaaacctgcttaagtctttttttgttttaagtggaaacaaaaaagaactgcacagggaaatggtccacagtaaggctctttgccctttaagtgaagatccttgggctctggaagacaaatgacaggtggattaaagatccgtcaatctttctatgcctggggaaccctccaaccctgtaagacttgatctttgtatggctgagggtggggctggctgtccattaaattaccacatactgaaattgccagagaaatgtgatgggttctgacgtttatacagcacttcatacttttagatccatgagagactagcatttttctatcaggattcatggatgtgattccacttacgataaaagctgctagaggtggaaaccccgcagcttttcctactgactttcttttgtcgggagctctgtggccttccagagaccactgagaaggaccagctccatgcacaagaaggtgatcaattttgcaaaagacaaaaatcttaaccatttccagaaactactagttatattaggcacgttttaaaaacttaaacaaaataaaggccatcccaaaccctgggctgttgtcgggttattttgcagcagggttgtgttcaaaatcttcctttgactccctgagactttatcttcttcttgcagaataagatggaaagccaatcagtgtttgctgtaatgtaatacagaatagtgccaatctggaaataacctaaatgtccaacattaaggaaatggcttaataaactattaatagcaacaaaaataatat

SEQ ID NO: 75587 - DNA, 591 bp, Homo sapiens
tgaatggttctgtctcactggggttccaggagccactggggtacaaaaaaactcctgcggctagctccgtgtctgcccaaacagctgcccagttttgtgcttgaaacccagggccccagtggtgtaggcacacgagggaatctcctgatgtgcagattgcaaaaaccgtgggaaaagcgtagtaacccagctgggtaacacagttcctcacagcttccattggctgggggaagggaggtccctggccccttgcacttcctgggtggagcatcaccccatcttgcttctgctcgctctccacgggttggacccactgcctaaccatttccagtgagatgaactggttacctcagttggagatacagaaatcaccagccttctgagttggtctcgctgggagctgcagaccagagctgttcctatttagccatcttggcccctccccccttgaaaattccatttctttaatagatatagggctattgaggctatttctccttaaatgaacctagatagtttgtgtgcagctgtcaaggaatttgtccattttatctaagttgtcatatttatctatataaagtttttcataat

SEQ ID NO: 75588 - DNA, 715 bp, Homo sapiens
atttctacggtgtcttaaattataactacacaaaattaacacactaactctgtcacttatttacaccaataaaagtctgtttccaaacaagaaagctgcactgggtatatgtatatgggtgtttatgtgatttagatgactggcatatttttaaaaactgtccaaaggagtttgaagtcataattttaatgtagcaggaaaagataaagtcattctcccatatttccttaatgttcagatgctatgtgttgtatgacatgatgtatataatgtaagttactaaaactttttttggaagagaaaaagctagagtagcagatatgcacactaaaaggcaaaaatctggttttacaagttttataataaaaaaggtggcaagatgaacgtttttttaacttagaactaaatttaagcttaacttttacagcaatctttagaaaattttgctatatggtctttcttgaagattatttgtaattttgtataattgatttagaaattcccatcaaattttaaaattcagagttctagataaaaccatcaattatctgaaatcctttctcagtcaagactgcccatgaagccaagtgccttatttgatcctataagcttcactgaaaatcagcagagtctttattaatttataaatgatgggcatgattaactggtctcaagtttgctcacaattctgaacccttgaaatcactgaaatacc

SEQ ID NO: 75589 - DNA, 354 bp, Homo sapiens
gataccttaatctaaattttatcttaatttttatttttatttcattgtctaaatttttatctaaaattttttctagctctttattacaccaagacagcttcacatttttatttatatattgtacatctcatgtaaggaattaccgtatataagctagtgtcataacttaagtagccacattcattcagtatgttttatgttttctctctgactggatctctgatacattctttcctgttctagctgcttttatgcaaaagggcattatatgtttgtcaatcaaccaggcttctgtgactgtttagaagaattatgtaaatatataatcctgtgcctgttcactttgccatgttt

SEQ ID NO: 75590 - DNA, 531 bp, Homo sapiens
agactcatgaaattgctgtgtgaccttgggcaagtcacttaccctgtctggatcaacatttctcctgctgccaagtgtgggagcctggctgggtctttctcagcagaagttgtttccaggtgtgctcaagtgccttcctctagcagagcacagaaagctagaatacccccagggagacagggatgccaagagtagaccagagctgggacccacagacagaacctccacctgcctgctgcccactgagctgggacctggtcaccttggattttagccggcctctttctggctataacaggcagagtcggagctgcctcccaccccagtcagaagcctggcaccccctctgcttcggccagatgtgctggctgactccgacttccgaccagcactcagctggcctctggggattctagctccacaaccaggccgtgaggctggagaaactggcagttattgctgtcaaaagcctgttctctcaactgctgtcaataaaattaaagatacagatttgctgccatgtgaccagca

SEQ ID NO: 75591 - DNA, 592 bp, Homo sapiens
tttaaataaaacagaattagcaaacttttgtgactgtagagaacgaagacaaaaatttagtcctaataagctctcccaccttccaggcaaaatcttttagaccctagttctaaccggtatgtaaagctaagaaaaataatttccaaaatgaactcttgaaatttgaatggaaaaaaactgcctttagttctgaggtttgttaataagcaatattttacatagaaatcttaaggaatgaaattagctccgataccccagtgtttcgaggaaagggaatatgttttacttttgagcaggttagtataagaatcacactcagccaggtttcttaggcccaagtgagcctcagaacctgaaaaggggaaaaagaaggcatcttggggcataatggaagctgaggttcccccctcctctacccgctgctgggaccaacatcacatctccttcccatatgaaatggctatatgctattacagaaaagactagataagagaaagtgaatctggaatacatgaattgcttttttgccatccccaacttgtttggcttttaataaactggcatggctttcaatatcctttcctttatctac

SEQ ID NO: 75592 - DNA, 814 bp, Homo sapiens
tttaaataaaacagaattagcaaacttttgtgactgtagagaacgaagacaaaaatttagtcctaataagctctcccaccttccaggcaaaatcttttagaccctagttctaaccggtatgtaaagctaagaaaaataatttccaaaatgaactcttgaaatttgaatggaaaaaaactgcctttagttctgaggtttgttaataagcaatattttacatagaaatcttaaggaatgaaattagctccgataccccagtgtttcgaggaaagggaatatgttttacttttgagcaggttagtataagaatcacactcagccaggtttcttaggcccaagtgagcctcagaacctgaaaaggggaaaaagaaggcatcttggggcataatggaagctgaggttcccccctcctctacccgctgctgggaccaacatcacatctccttcccatatgaaatggctatatgctattacagaaaagactagataagagaaagtgaatctggaatacatgaattgcttttttgccatccccaaccttgctgagctttcatcagacctgccatgccttcacaacctcttaccttccccaacataagccaacaaccgaagccatgtcgcagaagatatatatgtaaatgtatgcacacatgtgtatgtgtgtgagtatatatgtacacacacatatgcatatactttatgtatatatttgctttggtatatatgctttaaatatatatatttatatatgcatatatacctgtagttctcaaaaatatcaccagtagcccaaatttgcctttatttcaggagt

SEQ ID NO: 75593 - DNA, 148 bp, Homo sapiens
ctccgttcccccgtccccatcctccatccccgtctcccatcgccgtccccccgtccccgtcccccgtccccgtcccccctgtccctgtcccccttcccccgacccctcccagatcctggggaccaataaagcccgcagcgggtctcgg

SEQ ID NO: 75594 - DNA, 842 bp, Homo sapiens
ggagcgtctctgcccggccgcccatcgtctgaaatgtggggagcgcctctgcaccgccgccccatctgggatgtgaggagcgcctctgccctgccgtgaccccgtctgggagctaaaattcaagtaatggactatttggatgatagtgtgcccggaattggttccttccgatattcttggtctcgctgactttaacaatgaagcctcagaccaccgcgcacagtccagtgttaagacagggcatgaggaccagctccactggaaacaccagccagcgtcttaaccggggaggaaggaaggtgtgtgctgggcaagtggggcatgtgacaaagtggaactgaagtggccgtcgcttgcctttaggccagcaggttcctcagcagcctttgctcataggctggcttaactatgatcctgctgtgggaagataaaaaaactgaccgaaggagataggctgagtaatggctccctcaagatgtccatatttcatccctggaacctgtgaatacatttctttatgtggcaaaagggactttgtggctgtgattaaactaagaaccttgaaatgaggagattctccgggatcgtccagatgcatcaaatgtaacaagaaggagtcagagtcaggctagaagccgctatgctgctggctttgaaggcagatgaaggggccaaggaattagggtggtctctagaatctggaaaaggcaatgaaattgattctcccctagagctttcagaaggaatgcagccttgcccacaccttcattttagaccagtgaaactgatttcagacttctgactgccagaactgtaagataataaatgtatattgtttgaag

SEQ ID NO: 75595 - DNA, 436 bp, Homo sapiens
gcgggggaggggggtcaataacttgtgagtaatccattagtcttttaaacggctttattgagatataattcacttacacaatttgccagttcaaattgtgcagttcagtggttcttattgtattcagagttgcacaatactagtattttaaaaaagaattttatccaaaattccttggatttttatctgtgtacctaatgtgcaacggaatagagtgaggactgctttgaggccttcacccccaagtaactgtgtagctgaggaggccgactaataaataattctactatcaatataaaagtgctacatcaaaaatgtatacattgggtaggattgtatagatacgtcacttgcactgtgtagtttactcaacacaattcagagtagggttggttttgttaaaatgcagattctgggtcctgctcctgagattctg

SEQ ID NO: 75596 - DNA, 241 bp, Homo sapiens
tgcaaataccaaggaaccactagtggatcattaggaaccatctgtacttatgacagggcggtgggataactttcaaaagcaaacaaacgaaactagtagacttgaagacttaggttccagctttagctctgacattagtgtgtatcttatcttaggcatgccaacctccctggtcttcatctgtgcactagagataataatgcctcataaggtggttataataataattgggtgattgtat

SEQ ID NO: 75597 - DNA, 466 bp, Homo sapiens
aaactactgtaaaaagatggcataaaatattttaaaatggtatacctgtataggacacttaccattaatggaagcctgtaggactggaagttgatctgggtgagtcagtgagtgagtggtaagcgcatgtgaaggtctaggacattactgtacactacttgatacggtttggctctgtgtccccacccaaatctcatctcaaattgtaatccttacatgtcagaggggcctggtgggaggtgactgaatcatgggggcagacttcctccttactgttctttttatagtgagctctcatgagatctgggggtttaaaagtatgtggcttgctctctctctctctctctcaagctttgtcatggttagatgtgccttgcttccccttcaccttctgtcatgattgtaagtttcctgagggctcctcaggcatacggaactgtcagtcaattaaacctcttttctttat

SEQ ID NO: 75598 - DNA, 402 bp, Homo sapiens
gtgaagttaagcagcaagggctgagaaccgctgctccagagaggccaggaggtctggtcagaggctggggccccagcccccaggcacctctctgtgtcagtttccctggagaagtcatgagtttgaagagtaggcagaggccaggtgtcatcactgagtcactcatcaatggccaatgagagtgcaaagggtagctctgagcacaggatgtgtagcaagactcctgggttcagctcccagtcccaccactgccaagtgggggatccttagcaaggtacttaccttttttctgcctctgtttctacgcctgcaaaatgggcacaataatgtcagattcatgaggataatgaggactaaattagttaattcctataagctgcttctaaacgtattacttataaa

SEQ ID NO: 75599 - DNA, 310 bp, Homo sapiens
tattcagtgaaacctttatatcccttatggtcctccatcttcaagaaaggtagaatggactaaaggtcttttaaaaacacacctcaccaagctcagccaccaactttaaaaggactggataatacttttaccactttcccttctcagaattcaggcctgtcctcggaatgctacaaggcacagcccatttaagctcctgtatagacgctcctttttattaggccccagtctcattccagacaccagaccaacttagactgtgcctcaaaacaaacaaacaaacaaacaaacttgtcatccctactatttt

SEQ ID NO: 75600 - DNA, 428 bp, Homo sapiens
aactggatttattatacttcatatcacaaaaatgccgacttggaggttttacgtagctttaatttagtgttaagatattagttctcaacatcaagaaactatgtgattttaagtatttctgtaactaactttccaagcagttaggatgtagagttcagttattctttttattctttgatagcagtgttgttttctttgattacatatacatatatttgatctgtaaatatgtttgtatgtatgtgtgttacataaatatgcatgtgacaattaattccattctccctagaataaggctggaactaattgactgtaagcagactatcctgctcattatctattaggttatactcaaagtcttttaaccagtgcattaacatgttttaaccaagtttattggctttaccaataaatttaccaattcattt

SEQ ID NO: 75601 - DNA, 597 bp, Homo sapiens
tacaaattttaggtgaccaaactgattttagtgacctcaatcctaaaatctaagccatttgtttagcttttaatgacattttataatgttaaagggaggactttggagctgttatctcatctagagattgtttggaacatatgtcttccagaataggttgataagctcacaatcatttattgctacgtttttgtttttgttttgagacaaggtctcactccgtcacccaggctggagtgcagtggcatgatcatagctcactgcagcctcgacctcccgggctcaagcaatcctctcacttcagcctcctgagtagctgggactacagggaggcactaccatgccctgctaatttttggatttttttgtagagacaaggtctcactatgttgcccaggctggtctcaaactcctggtctcaagcgatcctcttgccttgtcttcccaaagtgctgggattacagatgtgagccaccacacctggcctcatttctatattttgaaacacggtatgatccattctagaattctagttgttatgttgacatttttctttgaataatcttaactttgcttaaataaattaaagatttcaat

SEQ ID NO: 75602 - DNA, 418 bp, Homo sapiens
tgtaaaataaaacacaggtacagaaaaccataaaaaagcaagtatagcttagtgaatgtagggcaaacacccttgtaacaataatccaggtcaagaaatagagctttaacagccagcccagaatccctttctttgtcccatccctgttacatcgtcttccctccaaaaatgagatgattattagcaccagaaaaggaaaaaaaaagagcacaaggaagggaaatgtaatccttgtttaccattggttcaaccatgatcatattgataataatcgcataactgaaacactgtatatggacttaatcataactttttaatatatattacaatttttaatcatgcgggatacaacaccagagggacgagcctttgagctttttggtcccaactgaatgttggggtaaatattgggagggaa

SEQ ID NO: 75603 - DNA, 386 bp, Homo sapiens
cccaatattttgacagtatttaatataatatgaacaaatacaaactgagtggtgagcttgttgaggaataacaaataattcacttaaacttgataagccagtttgattgttttatttcactaaaatatgatatgatttattttatattgcctaaaacttggtgccttttataatcatcaggatctggtaaatgacagaactaacatacataatttatgtaaagtgtggtcaattggagagagatatatatttatatatatttattaaatttttcaagctctgtattgtggtaaacaaaaacatcattactttttccagtagtcctaagtaagaaagcatccattcataacattgtggataatttttcattaaaattccagtaacta

SEQ ID NO: 75604 - DNA, 485 bp, Homo sapiens
gagagctagcaccattaccctggcttataaattatcttcagaaaatatttgaaagtggtaactattagtacagactgttttgttcatttgtttgtttgtttgcagctgatacattcctcaatggcaaaacctttacctccacctcggtttttattctccctaatgtgttccacttccaaaggtaactaacaaagacaccctatattccgaaatctccctcctcccccatctgccaactggatgctgagacccagggtggccttgcggctgatgtgttaaggacagcagtgcctctgtcagcctacatccctgaatgactccatggacccaaacacccactcaccactcccactttggccagctaggtacaaatacatggaactttctatgagcaggtaacaaacatcctttatgttaagtcactgagattctgggatgcctctattaaagagctaatgtcaccttaattacaattgtaaattaaa

SEQ ID NO: 75605 - DNA, 2130 bp, Homo sapiens
  misc_feature (840)..(840): n is a, c, g, or t
cgcggccgccgccccctcctcctccggcacacgcgcacgcaggtgcagccctcgctgcgccggccacctgcgcgcggacgccccgctcggccccgcgaccctccgccgcccgacgtctggccgtgcaggccgggaggggacgggtaggaggtggcgggtggccccgggcgcggcgctgccttcgatggcccaacccccttattcacgagccgcggccgtgactctgcccggtgacgtggggaggccgaactttacgtaacccgcccggcgccccacgcgtgccggcacagggcatatctggggcccggaggcccaggcttggggaaggggctccagtcacggtgttgcccacgggccacagcctacccgcaccgcgccgctctctttaactcagttactgccagtgatagtgacccagtcagtgtgtgtggacgcggcctgccttctgtcccaggccccttgtgaccaagggcttacccttgaaagaaggcagtagggaggttgggacggagccagaggtcagacgcctaggctcaggtcggggctggggactcagagggcagggtcagggcctaagctcgattgcctgtgggttgggggtccccaccaattctggaatgagcccaaactgagacgcaggggacctgagttctaggcctggctctgccgtggcttgctgaccttggagaattggagaagcttgtgccctgctggaaagtgggatggcagtacccgcttcatctagtagtcggggagatcaagagaggtatgggacctgaagaggatggcagactgtgcagtgcggtgcacaccggtctccaggttgttttcaccctcctntctcctcccaggagctaacgtgtaagcaaacatgtttggatagagggctggtgccacgccccaggctcaccccgcccgcacagccgtcgtccacccctcccctttcttacagataaagctgaggctcggccagggactgtgatatacccacatccccggaactaggtgatcgcggtgcaggaaccaggtgtgccttcgcgggatccatgccttgaggcccaggaacgccccgccgccagcatgccgtgggacgcgcggcggcctgggggtggcgcggacggcgggcccgaggcctcgggcgcggcgcgctcgcgagcgcagaagcagtgccgcaagtcgtcgttcgccttctaccaggcggtgcgcgacctgctacccgtgtggctgctggaggatatgcgcgccagcgaggccttccactgggacgagcgcgggcgcgccgccgcctactcgccctctgaggcgctgctctacgcgctcgtgcacgaccaccaagcgtacgcgcattacctgctggccacgttcccgcggcgcgcgctcgcaccgcccagtgccggcttccgctgctgcgcggctcccgggccgcacgtggcgctggcagtgcgctacaaccgcgtgggcattctgcgccgcatcctgcgcaccttgcgcgacttcccggccgaggagcgggcgcgcgtgctggaccggcgtggctgcagccgcgtggagggcggtggcacgtcgctgcacgtggcctgtgagctggcgcgccccgagtgcctcttcctgctgctgggccacggcgcctcgcccggtctgcgggacggcggcggcctcacgcctctcgagctgctgctgcgccagctgggccgcgacgccggggccactccctccgccgccggagcccccgcctcagctcccggggagccgcgccagcgccgcctgctgctgctggacctcctggcgctgtacacccccgtgggtgccgccggctcggcccgccaggagctgctgggcgaccggccgcgctggcagcggctgctgggtgaggacaagttccagtggctggcgggcctggcgccgccctcgctcttcgcgcgcgccatgcaggtgctggtcaccgccatctctccaggccgcttccccgaggccctggacgagctgccgctgcccccattcctgcagccgttggacctcactggcaaaggctaggcccggagcaccctaggcgctggattttgggacaaaactatttttcagagcgttgtaccggcactttatatatattgatctctgtacggcaaaaaa

SEQ ID NO: 75606 - DNA, 1238 bp, Homo sapiens
  misc_feature (840)..(840): n is a, c, g, or t
cgcggccgccgccccctcctcctccggcacacgcgcacgcaggtgcagccctcgctgcgccggccacctgcgcgcggacgccccgctcggccccgcgaccctccgccgcccgacgtctggccgtgcaggccgggaggggacgggtaggaggtggcgggtggccccgggcgcggcgctgccttcgatggcccaacccccttattcacgagccgcggccgtgactctgcccggtgacgtggggaggccgaactttacgtaacccgcccggcgccccacgcgtgccggcacagggcatatctggggcccggaggcccaggcttggggaaggggctccagtcacggtgttgcccacgggccacagcctacccgcaccgcgccgctctctttaactcagttactgccagtgatagtgacccagtcagtgtgtgtggacgcggcctgccttctgtcccaggccccttgtgaccaagggcttacccttgaaagaaggcagtagggaggttgggacggagccagaggtcagacgcctaggctcaggtcggggctggggactcagagggcagggtcagggcctaagctcgattgcctgtgggttgggggtccccaccaattctggaatgagcccaaactgagacgcaggggacctgagttctaggcctggctctgccgtggcttgctgaccttggagaattggagaagcttgtgccctgctggaaagtgggatggcagtacccgcttcatctagtagtcggggagatcaagagaggtatgggacctgaagaggatggcagactgtgcagtgcggtgcacaccggtctccaggttgttttcaccctcctntctcctcccaggagctaacgtataaagctgaggctcggccagggactgtgatatacccacatccccggaactaggtgatcgcggtgcaggaaccaggtgtgccttcgcgggatccatgccttgaggccctgctgggtgaggacaagttccagtggctggcgggcctggcgccgccctcgctcttcgcgcgcgccatgcaggtgctggtcaccgccatctctccaggccgcttccccgaggccctggacgagctgccgctgcccccattcctgcagccgttggacctcactggcaaaggctaggcccggagcaccctaggcgctggattttgggacaaaactatttttcagagcgttgtaccggcactttatatatattgatctctgtacggcaaaaaa

SEQ ID NO: 75607 - DNA, 2039 bp, Homo sapiens
  misc_feature (840)..(840): n is a, c, g, or t
cgcggccgccgccccctcctcctccggcacacgcgcacgcaggtgcagccctcgctgcgccggccacctgcgcgcggacgccccgctcggccccgcgaccctccgccgcccgacgtctggccgtgcaggccgggaggggacgggtaggaggtggcgggtggccccgggcgcggcgctgccttcgatggcccaacccccttattcacgagccgcggccgtgactctgcccggtgacgtggggaggccgaactttacgtaacccgcccggcgccccacgcgtgccggcacagggcatatctggggcccggaggcccaggcttggggaaggggctccagtcacggtgttgcccacgggccacagcctacccgcaccgcgccgctctctttaactcagttactgccagtgatagtgacccagtcagtgtgtgtggacgcggcctgccttctgtcccaggccccttgtgaccaagggcttacccttgaaagaaggcagtagggaggttgggacggagccagaggtcagacgcctaggctcaggtcggggctggggactcagagggcagggtcagggcctaagctcgattgcctgtgggttgggggtccccaccaattctggaatgagcccaaactgagacgcaggggacctgagttctaggcctggctctgccgtggcttgctgaccttggagaattggagaagcttgtgccctgctggaaagtgggatggcagtacccgcttcatctagtagtcggggagatcaagagaggtatgggacctgaagaggatggcagactgtgcagtgcggtgcacaccggtctccaggttgttttcaccctcctntctcctcccaggagctaacgtataaagctgaggctcggccagggactgtgatatacccacatccccggaactaggtgatcgcggtgcaggaaccaggtgtgccttcgcgggatccatgccttgaggcccaggaacgccccgccgccagcatgccgtgggacgcgcggcggcctgggggtggcgcggacggcgggcccgaggcctcgggcgcggcgcgctcgcgagcgcagaagcagtgccgcaagtcgtcgttcgccttctaccaggcggtgcgcgacctgctacccgtgtggctgctggaggatatgcgcgccagcgaggccttccactgggacgagcgcgggcgcgccgccgcctactcgccctctgaggcgctgctctacgcgctcgtgcacgaccaccaagcgtacgcgcattacctgctggccacgttcccgcggcgcgcgctcgcaccgcccagtgccggcttccgctgctgcgcggctcccgggccgcacgtggcgctggcagtgcgctacaaccgcgtgggcattctgcgccgcatcctgcgcaccttgcgcgacttcccggccgaggagcgggcgcgcgtgctggaccggcgtggctgcagccgcgtggagggcggtggcacgtcgctgcacgtggcctgtgagctggcgcgccccgagtgcctcttcctgctgctgggccacggcgcctcgcccggtctgcgggacggcggcggcctcacgcctctcgagctgctgctgcgccagctgggccgcgacgccggggccactccctccgccgccggagcccccgcctcagctcccggggagccgcgccagcgccgcctgctgctgctggacctcctggcgctgtacacccccgtgggtgccgccggctcggcccgccaggagctgctgggcgaccggccgcgctggcagcggctgctgggtgaggacaagttccagtggctggcgggcctggcgccgccctcgctcttcgcgcgcgccatgcaggtgctggtcaccgccatctctccaggccgcttccccgaggccctggacgagctgccgctgcccccattcctgcagccgttggacctcactggcaaaggctaggcccggagcaccctaggcgctggattttgggacaaaactatttttcagagcgttgtaccggcactttatatatattgatctctgtacggcaaaaaa

SEQ ID NO: 75608 - DNA, 1390 bp, Homo sapiens
cgccgcccgccgcccgccgccggcgacggcaccgccgccctgcgatccggccgcggcggctcagagcgcggctgcggcgggcgcgggcggcggtggctccctcccgtgcgtccgtcgtgggacctttgcccgctcgcccgcgggggacagcgcgcgctccggtccgcggcaggggcggggacgcccggcctgtggcccccgcgccccccatgataaagctgaggctcggccagggactgtgatatacccacatccccggaactaggtgatcgcggtgcaggaaccaggtgtgccttcgcgggatccatgccttgaggcccaggaacgccccgccgccagcatgccgtgggacgcgcggcggcctgggggtggcgcggacggcgggcccgaggcctcgggcgcggcgcgctcgcgagcgcagaagcagtgccgcaagtcgtcgttcgccttctaccaggcggtgcgcgacctgctacccgtgtggctgctggaggatatgcgcgccagcgaggccttccactgggacgagcgcgggcgcgccgccgcctactcgccctctgaggcgctgctctacgcgctcgtgcacgaccaccaagcgtacgcgcattacctgctggccacgttcccgcggcgcgcgctcgcaccgcccagtgccggcttccgctgctgcgcggctcccgggccgcacgtggcgctggcagtgcgctacaaccgcgtgggcattctgcgccgcatcctgcgcaccttgcgcgacttcccggccgaggagcgggcgcgcgtgctggaccggcgtggctgcagccgcgtggagggcggtggcacgtcgctgcacgtggcctgtgagctggcgcgccccgagtgcctcttcctgctgctgggccacggcgcctcgcccggtctgcgggacggcggcggcctcacgcctctcgagctgctgctgcgccagctgggccgcgacgccggggccactccctccgccgccggagcccccgcctcagctcccggggagccgcgccagcgccgcctgctgctgctggacctcctggcgctgtacacccccgtgggtgccgccggctcggcccgccaggagctgctgggcgaccggccgcgctggcagcggctgctgggtgaggacaagttccagtggctggcgggcctggcgccgccctcgctcttcgcgcgcgccatgcaggtgctggtcaccgccatctctccaggccgcttccccgaggccctggacgagctgccgctgcccccattcctgcagccgttggacctcactggcaaaggctaggcccggagcaccctaggcgctggattttgggacaaaactatttttcagagcgttgtaccggcactttatatatattgatctctgtacggcaaaaaa

SEQ ID NO: 75609 - DNA, 1942 bp, Homo sapiens
  misc_feature (840)..(840): n is a, c, g, or t
cgcggccgccgccccctcctcctccggcacacgcgcacgcaggtgcagccctcgctgcgccggccacctgcgcgcggacgccccgctcggccccgcgaccctccgccgcccgacgtctggccgtgcaggccgggaggggacgggtaggaggtggcgggtggccccgggcgcggcgctgccttcgatggcccaacccccttattcacgagccgcggccgtgactctgcccggtgacgtggggaggccgaactttacgtaacccgcccggcgccccacgcgtgccggcacagggcatatctggggcccggaggcccaggcttggggaaggggctccagtcacggtgttgcccacgggccacagcctacccgcaccgcgccgctctctttaactcagttactgccagtgatagtgacccagtcagtgtgtgtggacgcggcctgccttctgtcccaggccccttgtgaccaagggcttacccttgaaagaaggcagtagggaggttgggacggagccagaggtcagacgcctaggctcaggtcggggctggggactcagagggcagggtcagggcctaagctcgattgcctgtgggttgggggtccccaccaattctggaatgagcccaaactgagacgcaggggacctgagttctaggcctggctctgccgtggcttgctgaccttggagaattggagaagcttgtgccctgctggaaagtgggatggcagtacccgcttcatctagtagtcggggagatcaagagaggtatgggacctgaagaggatggcagactgtgcagtgcggtgcacaccggtctccaggttgttttcaccctcctntctcctcccaggagctaacgtataaagctgaggctcggccagggactgtgatatacccacatccccggaactaggtgatcgcggtgcaggaaccaggtgtgccttcgcgggatccatgccttgaggcccaggaacgccccgccgccagcatgccgtgggacgcgcggcggcctgggggtggcgcggacggcgggcccgaggcctcgggcgcggcgcgctcgcgagcgcagaagcagtgccgcaagtcgtcgttcgccttctaccaggcggtgcgcgacctgctacccgtgtggctgctggaggatatgcgcgccagcgaggccttccactgggacgagcgcgggcgcgccgccgcctactcgccctctgaggcgctgctctacgcgctcgtgcacgaccaccaagcgtacgcgcattacctgctggccacgttcccgcggcgcgcgctcgcaccgcccagtgccggcttccgctgctgcgcggctcccgggccgcacgtggcgctggcagtgcgctacaaccgcgtgggcattctgcgccgcatcctgcgcaccttgcgcgacttcccggccgaggagcgggcgcgcgtgctggaccggcgtggctgcagccgcgtggagggcggtggcacgtcgctgcacgtggcctgtgagctggcgcgccccgagtgcctcttcctgctgctgggccacggcgcctcgcccggtctgcgggacggcggcggcctcacgcctctcgagtgctgctggacctcctggcgctgtacacccccgtgggtgccgccggctcggcccgccaggagctgctgggcgaccggccgcgctggcagcggctgctgggtgaggacaagttccagtggctggcgggcctggcgccgccctcgctcttcgcgcgcgccatgcaggtgctggtcaccgccatctctccaggccgcttccccgaggccctggacgagctgccgctgcccccattcctgcagccgttggacctcactggcaaaggctaggcccggagcaccctaggcgctggattttgggacaaaactatttttcagagcgttgtaccggcactttatatatattgatctctgtacggcaaaaaa

SEQ ID NO: 75610 - DNA, 427 bp, Homo sapiens
aacatttttttaaaaaacagtaattatgggaagaaaggtgtatacgcatgctggacagccaaatgggtggattgtagggaacatgtgcctttttttcttggctgatgagcattcaaactcctatttagaggaaatgccctttgttttactgaaaataagagctctacctcttcttacagaaagcaagggactctagacattctcttttcctaggagagttagccattattcaaagctgaggagttgagagtctgcgttggtgacatatagcaaaacccaaactaatgttcctgtggtgtgaccctgactgtgttctctatcctgacttcttttgttttctgctcattttctaagtctgattctcccatcttcctgacagttatgtgagatactaaatattcttccaataaatttcgcttaagataag

SEQ ID NO: 75611 - DNA, 672 bp, Homo sapiens
ggcacgacacacttaggctaggtacgaggcatggtggttaatcggccgaggcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggttggggccacggtgggctccatcgagccaaaggttgccggtgagggaggtatccccggacccgtcattcattgaaccaccctttcaggcggtccgttggcccttcaacccctaaaggtgtcaa

SEQ ID NO: 75612 - DNA, 691 bp, Homo sapiens
agactgagtgcatcccacgggctgcaggaattcggcacgagggcaacgcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagaggttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgaaaaaaaaaaaaaaacaaagaaacaaagaaacaacaagaacacaagaaaacaaaaaaacaacaaaaaacccgcgaggcgggtcattttctgcggcggcggcggagaaaaagagggggccaagaaagggcggccggggcgagcaaggggagggaccaggacgcccagagtagtgggagacaaaggggggaaaaacgggggaggaccacaaaaagggggggggaaaaacatcgagaaacgcgaggaacacgggataagagacgggagaaaagg

SEQ ID NO: 75613 - DNA, 627 bp, Homo sapiens
ggcactctgcgcgcccgctcttctgctgctgtttgtctacttcctcctgcttccccgccgccgccgccgccatcatgagggaaatcgtgcacttgcaggccgggcagtgcggcaaccaaatcggcgccaagtttgggaggtgatcagcgatgagcacggcatcgaccccacgggcacctaccacggggacagcgacctgcagctggaacgcatcaacgtgtactacaatgaggccaccggcggcaagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagaggttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgaaaaaaaa

SEQ ID NO: 75614 - DNA, 428 bp, Homo sapiens
agactgagtgcatcccacgggctgcaggaattcggcacgagggcaacgcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagaggttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgaaaaaaaa

SEQ ID NO: 75615 - DNA, 1752 bp, Homo sapiens
  misc_feature (4)..(5): n is a, c, g, or t
  misc_feature (15)..(16): n is a, c, g, or t
  misc_feature (31)..(32): n is a, c, g, or t
gatnnccttaattannaattaatcctccccnncccccccccccccccggagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatctcgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagataccctt

SEQ ID NO: 75616 - DNA, 2305 bp, Homo sapiens
  misc_feature (4)..(5): n is a, c, g, or t
  misc_feature (15)..(16): n is a, c, g, or t
  misc_feature (31)..(32): n is a, c, g, or t
  misc_feature (1815)..(1815): n is a, c, g, or t
gatnnccttaattannaattaatcctccccnncccccccccccccccggagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatctcgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagatacccttaaaaaaaaaaaaaaaaaaaaaaaaaaaaaaaaaaaaaaaaaaaaaaaaaaaaaaaaaaaaaanaaaaggggggcgcgccgccctcatagatattcctctccccgggggggcccccgtgttctcccgcctccccccgtcttttgctgtctccacagggggccccccatattgtgggctgcgctttttttatcacctcgtccgcggcgcgccgccccgctctttttatcacacccgcttctcccgcgggggcacaacaggtggcctcccctgcggcgcccctccctgtgtggcgagccggcccccctctcctctcgcgggcgggcgctcacccctctcgtgggcacaccccttctccctcctcgggcgcttttacactccacccccacgcgctatccctcccccccccccttctccccccgcgtgctacccccccccgcccctccccccccccccgcctcccctctctctccccccgccccgccccgcccccccttctcggctccccctcgcccctctccttccccctgcccaccctttcttttcccccgcgcct

SEQ ID NO: 75617 - DNA, 1978 bp, Homo sapiens
  misc_feature (4)..(5): n is a, c, g, or t
  misc_feature (15)..(16): n is a, c, g, or t
  misc_feature (31)..(32): n is a, c, g, or t
  misc_feature (1815)..(1815): n is a, c, g, or t
gatnnccttaattannaattaatcctccccnncccccccccccccccggagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatctcgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagatacccttaaaaaaaaaaaaaaaaaaaaaaaaaaaaaaaaaaaaaaaaaaaaaaaaaaaaaaaaaaaaaanaaaaaaaaaaaaaaaaaaaaaaaaaaaaaaaaaaaaacaatcactgggccggtgtttaacaacgttgtgatattggaaaacctttgggttaccccaattaaattccttggaacaaaattcctcttttccaagttggcgtaccggccccaccttttgcctttcc

SEQ ID NO: 75618 - DNA, 1836 bp, Homo sapiens
  misc_feature (4)..(5): n is a, c, g, or t
  misc_feature (15)..(16): n is a, c, g, or t
  misc_feature (31)..(32): n is a, c, g, or t
gatnnccttaattannaattaatcctccccnncccccccccccccccggagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatctcgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagatacccttaaagtagttcaacaaatcaaaaacgaaagactaataacatagaggataagggctttaaaggcggggggggaaaaaacatcgctc

SEQ ID NO: 75619 - DNA, 1603 bp, Homo sapiens
  misc_feature (4)..(5): n is a, c, g, or t
  misc_feature (15)..(16): n is a, c, g, or t
  misc_feature (31)..(32): n is a, c, g, or t
gatnnccttaattannaattaatcctccccnncccccccccccccccggagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggatgagcaaatgcttaatgtccaaaacaaaaacagcagctattttgttgagtggatccccaacaatgtgaaaacggctgtctgtgacatcccaccccgcggcctcaagatgtcctccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgaaaaaaaa

SEQ ID NO: 75620 - DNA, 1697 bp, Homo sapiens
  misc_feature (4)..(5): n is a, c, g, or t
  misc_feature (15)..(16): n is a, c, g, or t
  misc_feature (31)..(32): n is a, c, g, or t
gatnnccttaattannaattaatcctccccnncccccccccccccccggagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatctcgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagataccctt

SEQ ID NO: 75621 - DNA, 2024 bp, Homo sapiens
  misc_feature (4)..(5): n is a, c, g, or t
  misc_feature (15)..(16): n is a, c, g, or t
  misc_feature (31)..(32): n is a, c, g, or t
gatnnccttaattannaattaatcctccccnncccccccccccccccggagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagaggaatgacggggaggaagcttttgaggatgaggaagaggagatcgatggatagtcggaatagagccgccccaactcagatcctacaacacgcaagttccttcttgaaccctggtgcctcctaccctatggccctgaatggtgcactggtttaattgtgttggtgtcggcccctcacaaatgcagccaagtcatgtaattagtcatctggaacaaagactaaaaacagcagagaattgcgggttctacccagtcagaagatcacaccatggagactttctactagaggacttgaaagagaactgaggggccacaaaataaacttcaccttccattaagtgttcaagcatgtctgcaaattaggagggagttagaaacagtctttttcatcctttgtgatgaagcctgaaattgtgccgtgttgccttatatgaatatgcagtatgggactttgaaataatgattcatataaatactaaaaaaaaaagaggggggggcggttaagtttcgggggagcaagttaggaaccgttttgaaagagggccaaggggagaaaaagaggggggggtaaagggggggaaaaggggggttggagacctgtgggaggaaccaaaagggaaaa

SEQ ID NO: 75622 - DNA, 1824 bp, Homo sapiens
  misc_feature (4)..(5): n is a, c, g, or t
  misc_feature (15)..(16): n is a, c, g, or t
  misc_feature (31)..(32): n is a, c, g, or t
  misc_feature (1661)..(1661): n is a, c, g, or t
gatnnccttaattannaattaatcctccccnncccccccccccccccggagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagaggttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgaaaaaaaaaaaaaaaaaaaaaaaaaaaaaaaaaaaaaaaaaaaaaaaaaaaaaaaaaaaaaaaaaaaaaanaaaaaaaaaaaaaaaaaaaaaaaaaaaaaaaaaaaaacaatcactgggccggtgtttaacaacgttgtgatattggaaaacctttgggttaccccaattaaattccttggaacaaaattcctcttttccaagttggcgtaccggccccaccttttgcctttcc

SEQ ID NO: 75623 - DNA, 1861 bp, Homo sapiens
  misc_feature (4)..(5): n is a, c, g, or t
  misc_feature (15)..(16): n is a, c, g, or t
  misc_feature (31)..(32): n is a, c, g, or t
gatnnccttaattannaattaatcctccccnncccccccccccccccggagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagaggttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgaaaaaaaaaaaaaaacaaagaaacaaagaaacaacaagaacacaagaaaacaaaaaaacaacaaaaaacccgcgaggcgggtcattttctgcggcggcggcggagaaaaagagggggccaagaaagggcggccggggcgagcaaggggagggaccaggacgcccagagtagtgggagacaaaggggggaaaaacgggggaggaccacaaaaagggggggggaaaaacatcgagaaacgcgaggaacacgggataagagacgggagaaaagg

SEQ ID NO: 75624 - DNA, 1598 bp, Homo sapiens
  misc_feature (4)..(5): n is a, c, g, or t
  misc_feature (15)..(16): n is a, c, g, or t
  misc_feature (31)..(32): n is a, c, g, or t
gatnnccttaattannaattaatcctccccnncccccccccccccccggagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagaggttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgaaaaaaaa

SEQ ID NO: 75625 - DNA, 1595 bp, Homo sapiens
  misc_feature (4)..(5): n is a, c, g, or t
  misc_feature (15)..(16): n is a, c, g, or t
  misc_feature (31)..(32): n is a, c, g, or t
gatnnccttaattannaattaatcctccccnncccccccccccccccggagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagaggttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgttgtctgctgcagggggatcctcaagagcagccagcac

SEQ ID NO: 75626 - DNA, 1653 bp, Homo sapiens
  misc_feature (4)..(5): n is a, c, g, or t
  misc_feature (15)..(16): n is a, c, g, or t
  misc_feature (31)..(32): n is a, c, g, or t
  misc_feature (1407)..(1407): n is a, c, g, or t
gatnnccttaattannaattaatcctccccnncccccccccccccccggagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagaggncgaacaaggggagttcgaggaggaggagggcgaggacgaggcttaaaaacttctcagatcaatcgtgcatccttagtgaacttctgttgtcctcaagcatggtctttctacttgtaaactatggtgctcagttttgcctctgttagaaattcacactgttgatgtaatgatgtggaactcctctaaaaattacagtattgtctgtgaaggtatctatactaataaaaaaagcatgtgtagaaaaaa

SEQ ID NO: 75627 - DNA, 1805 bp, Homo sapiens
gggcatctcttgagaacaaagagatgcccctccctgccccacagtgtgctcgtgtggctgctgtggggcagggaggggcatctcttgagaacaaaagatccatttctcgactttccaaagctggagagcttcttgagagaaaagagagagacaggtacaggtccacgccacccacacacagccctgtgcacacagaccggacacaggcgtccacagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatctcgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagataccctt

SEQ ID NO: 75628 - DNA, 1887 bp, Homo sapiens
aggagctggctgccctgaggctgcaaaacttcttccctcgtggagacagggaggcacctcagacactcaccccggactcccttgaacagggacagggaggaaccccaggcagctagaccccagcagcagccacacgagcacactgtggggcagggaggggcatctcttgagaacaaaagatccatttctcgactttccaaagctggagagcttcttgagagaaaagagagagacaggtacaggtccacgccacccacacacagccctgtgcacacagaccggacacaggcgtccacagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatctcgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagataccctt

SEQ ID NO: 75629 - DNA, 1629 bp, Homo sapiens
cctgtccactctgagatgcctggaagggggctcagtgcagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatctcgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagataccctt

SEQ ID NO: 75630 - DNA, 2005 bp, Homo sapiens
  misc_feature (4)..(5): n is a, c, g, or t
  misc_feature (15)..(16): n is a, c, g, or t
  misc_feature (31)..(32): n is a, c, g, or t
gatnnccttaattannaattaatcctccccnncccccccccccccccggagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttagacagtctcgatatgttgcccaggctggtctcgaactcctggactcaagcgatccacctgccttggcctcccaaagtgttgggagtgcagacacgagcccctgcatctggtggacgtctgactgaatcctgcctgtcctgctccgtcctgtcctgctccgtccttaaacacagtgaggcttaagggtgaagaaagttgctgaagcttgcctttggtccaggactctgacttcagagtacaggctcttaggatctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatctcgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagataccctt

SEQ ID NO: 75631 - DNA, 1695 bp, Homo sapiens
  misc_feature (4)..(5): n is a, c, g, or t
  misc_feature (15)..(16): n is a, c, g, or t
  misc_feature (31)..(32): n is a, c, g, or t
gatnnccttaattannaattaatcctccccnncccccccccccccccggagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggatgagcaaatgcttaatgtccaaaacaaaaacagcagctattttgttgagtggatccccaacaatgtgaaaacggctgtctgtgacatcccaccccgcggcctcaagatgtcctccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgaaaaaaaatgtggtttcgctttgcccattccttccagtaggccctccgggtgctgttgccgaatgtcagggggtagttgtcctgcatggctgcggggaga

SEQ ID NO: 75632 - DNA, 1998 bp, Homo sapiens
  misc_feature (4)..(5): n is a, c, g, or t
  misc_feature (15)..(16): n is a, c, g, or t
  misc_feature (31)..(32): n is a, c, g, or t
gatnnccttaattannaattaatcctccccnncccccccccccccccggagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttgcacatccagctggtagatgccaactcgcatccagcccccagctgccagggattctggggtggctgtttgggctcctggcactgccagtcggaaggaaggtatgctggagcaggagggctgatccattcacccaggatcccctcaggaggcagagcctcgctctgctgtgaccccaagttctcaagaccctgtccagagccctcgtcctgagcactcagcagcatcggctcagggaagccacggcgggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatctcgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagataccctt

SEQ ID NO: 75633 - DNA, 1711 bp, Homo sapiens
  misc_feature (4)..(5): n is a, c, g, or t
  misc_feature (15)..(16): n is a, c, g, or t
  misc_feature (31)..(32): n is a, c, g, or t
gatnnccttaattannaattaatcctccccnncccccccccccccccggagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatctcgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagataccctt

SEQ ID NO: 75634 - DNA, 1764 bp, Homo sapiens
  misc_feature (4)..(5): n is a, c, g, or t
  misc_feature (15)..(16): n is a, c, g, or t
  misc_feature (31)..(32): n is a, c, g, or t
  misc_feature (395)..(395): n is a, c, g, or t
  misc_feature (398)..(398): n is a, c, g, or t
  misc_feature (401)..(401): n is a, c, g, or t
  misc_feature (405)..(405): n is a, c, g, or t
  misc_feature (408)..(411): n is a, c, g, or t
  misc_feature (421)..(421): n is a, c, g, or t
  misc_feature (425)..(425): n is a, c, g, or t
  misc_feature (431)..(437): n is a, c, g, or t
  misc_feature (440)..(440): n is a, c, g, or t
  misc_feature (446)..(446): n is a, c, g, or t
  misc_feature (454)..(454): n is a, c, g, or t
  misc_feature (519)..(519): n is a, c, g, or t
gatnnccttaattannaattaatcctccccnncccccccccccccccggagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttgcaaaatggggcnggnaanaaanaannnnaaagatcacnaaanaggaannnnnnnaanaaatgnattcggtnctaagaaaataataaaagaaaaagaaaaaaaaaaacataaaaaataaaaaaaaaaagctatccangctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatctcgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagataccctt

SEQ ID NO: 75635 - DNA, 1606 bp, Homo sapiens
  misc_feature (4)..(5): n is a, c, g, or t
  misc_feature (15)..(16): n is a, c, g, or t
  misc_feature (31)..(32): n is a, c, g, or t
gatnnccttaattannaattaatcctccccnncccccccccccccccggagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatctcgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagataccctt

SEQ ID NO: 75636 - DNA, 1244 bp, Homo sapiens
aggaattacggctagtacgagccgggatgtaatcgagcgagcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatctcgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagataccctt

SEQ ID NO: 75637 - DNA, 1465 bp, Homo sapiens
  misc_feature (4)..(5): n is a, c, g, or t
  misc_feature (15)..(16): n is a, c, g, or t
  misc_feature (31)..(32): n is a, c, g, or t
gatnnccttaattannaattaatcctccccnncccccccccccccccggagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggacgagcagatgctggccatccagagcaagaacagcagctacttcgtggagtggatccccaacaacgtgaaggtggccgtgtgtgacatcccgccccgcggcctcaagatgtcctccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatctcgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagataccctt

SEQ ID NO: 75638 - DNA, 1562 bp, Homo sapiens
  misc_feature (4)..(5): n is a, c, g, or t
  misc_feature (15)..(16): n is a, c, g, or t
  misc_feature (31)..(32): n is a, c, g, or t
gatnnccttaattannaattaatcctccccnncccccccccccccccggagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatggtgcccttcccgcgcctgcacttcttcatgcccggcttcgcccccctcacagcccggggcagccagcagtaccgggccctgaccgtgcccgagctcacccagcagatgttcgatgccaagaacatgatggccgcctgcgacccgcgccacggccgctacctgacggtggccaccgtgttccggggccgcatgtccatgaaggaggtggatgagcaaatgcttaatgtccaaaacaaaaacagcagctattttgttgagtggatccccaacaatgtgaaaacggctgtctgtgacatcccaccccgcggcctcaagatgtcctccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgaaaaaaaa

SEQ ID NO: 75639 - DNA, 630 bp, Homo sapiens
gctcaagatgtcctccaccttcatcgggaggccgcggggcgggatgtcacacacggcccgcggcctcaagatgtcctccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacgacgaggaggagtcggaggcccagggccccaagtgaagctgctcgcagctggagtgagaggcaggtggcggccggggccgaagccagcagtgtctaaacccccggagccatctcgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcagataccctt

SEQ ID NO: 75640 - DNA, 1105 bp, Homo sapiens
  misc_feature (4)..(5): n is a, c, g, or t
  misc_feature (15)..(16): n is a, c, g, or t
  misc_feature (31)..(32): n is a, c, g, or t
  misc_feature (713)..(713): n is a, c, g, or t
  misc_feature (732)..(732): n is a, c, g, or t
gatnnccttaattannaattaatcctccccnncccccccccccccccggagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtcagagtggggccggcaacaactgggccaagggtcactacacggagggggcggagctggtggattcggtcctggatgtggtgcggaaggagtgtgaaaactgcgactgcctgcagggcttccagctgacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggagaacacggatgagacctactggcaanttttcccccggggaaaaanccaaaaaaccccgggaaaaggggccccggggcccctccctttaaacgggaaacccaaaatctgcttccgcaccctcaagctggccacgcccacctacggggacctcaaccacctggtatcggccaccatgagcggagtcaccacctccttgcgcttcccgggccagctcaacgctgacctgcgcaagctggccgtcaacatgggtgggccccccccttttttttttttttttctcccccccaccccccaccccccccccgggggggggggggcccccccgggggggccccccccccccctttttttgggggcccccaaaaaaaaccccttttttcttccttttccatggccccgggcttcgccccccctcaca

SEQ ID NO: 75641 - DNA, 956 bp, Homo sapiens
  misc_feature (4)..(5): n is a, c, g, or t
  misc_feature (15)..(16): n is a, c, g, or t
  misc_feature (31)..(32): n is a, c, g, or t
gatnnccttaattannaattaatcctccccnncccccccccccccccggagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttgctgggcattggaggcccagagaaagggttctgtggggagaacagaaaccactcatgcatttcaagtggaatgaagtgtaaagcagacagaagcttacagaattgctagagagctggtgagacagaacggggcctccagaggactccggggtccaggagcacgaggccttgctgcggtcaagagatcaggacgttcccatgcctgtgtcctggggttgggccgtggatgccacgttcccacgtctgtgtcctggggcggggccgtggatgccacgttcccacgtctgtgtcctggggcggggccgtggatgccacgttcccacgtctgtgtcctggggcggggccgtggatgccacgttcccacgcctgtgtcctggggcggggccgtggatgccacgttcccacgcctgtgtcctggggcggggccgtggatgccacgttcccatgcctgtgtcctggggcggggccgtggatgccacgttcccatgcctgtgtcctggggcggggccgtggatgccacgttcccatgtctgtgtcctggggcggggccgtggacgcgccacagaaacaggag

SEQ ID NO: 75642 - DNA, 1101 bp, Homo sapiens
  misc_feature (4)..(5): n is a, c, g, or t
  misc_feature (15)..(16): n is a, c, g, or t
  misc_feature (31)..(32): n is a, c, g, or t
gatnnccttaattannaattaatcctccccnncccccccccccccccggagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaaccatggacagtgtccgctcaggggcctttggacatctcttcaggcctgacaatttcatctttggtaagttccccctgctccaagctctgatggcagaccccatcacaggcaagcccaggtcggtggacggggacggctgtgagaaacaaggaatggtcagctcctcacatgatcctgaatggtgggaactcatctctccattttacagctgggcattggaggcccagagaaagggttctgtggggagaacagaaaccactcatgcatttcaagtggaatgaagtgtaaagcagacagaagcttacagaattgctagagagctggtgagacagaacggggcctccagaggactccggggtccaggagcacgaggccttgctgcggtcaagagatcaggacgttcccatgcctgtgtcctggggttgggccgtggatgccacgttcccacgtctgtgtcctggggcggggccgtggatgccacgttcccacgtctgtgtcctggggcggggccgtggatgccacgttcccacgtctgtgtcctggggcggggccgtggatgccacgttcccacgcctgtgtcctggggcggggccgtggatgccacgttcccacgcctgtgtcctggggcggggccgtggatgccacgttcccatgcctgtgtcctggggcggggccgtggatgccacgttcccatgcctgtgtcctggggcggggccgtggatgccacgttcccatgtctgtgtcctggggcggggccgtggacgcgccacagaaacaggag

SEQ ID NO: 75643 - DNA, 388 bp, Homo sapiens
aataagccttctcactgacttatgccccaatcccttgagtacttttaatgttaaagtcaagaataaaatgcctttgaaaaaataaaattgaactattctttagttagacaactcattagtacatttactcttatctcccccaccattatatttaggtgttgcattatccctgggatcttttctgcataattgtcttagtagatgctattcttaagtataaggatgcataaataatattggtacaatggaatgaatttaagtgatttaaattctaaatgtacattattttcacaactaagcaaaatatataacgtatccttaaacttgtatttgacaactttttcaactcaagtggatattttacaataaaaatgtgttacctggatct

SEQ ID NO: 75644 - DNA, 725 bp, Homo sapiens
gcaattactaaatacagaattacttgtctctaaaatataaattttataaaagtctaagaccatgactgaaactaggtttccaaatcgctttgcccataaacaaaaagtactttataattgaaaaactacataaaagaatattttgaaaattagaactgtgtctcatacataaagtaactgcttttcaccagattatttggttaaccggtatacccatgttgcccactgtttcttgtagcagaaatttacttaaattaactactttttttaattgtaaaacattctcttatttttaaacaaacattattagctatatgctgcatattgttaaatactggagacgaaacatgattaacatccattcattcccatttcttggactttcccaaatttatacatttcaaaaacaccaaaattacctggtctagtaatcatggacatgaagatgtgtaacgaatccctttttatatgctgggcacagtgtgaggcactttacagacattgactcatttaatccttaatcccttcacaaatgccagtgttaatttcttcactttactgttcaggaagctgagacttcagttaatatgtttaaggttacggtgagattgactcctaggtctgtatgattataaagtccacaatgtgtatcatatatttatcatcagtttgcctagaattgtattgaaatactttttcaaaataaaatgagcacatctggaaaa

SEQ ID NO: 75645 - DNA, 351 bp, Homo sapiens
cttggtagaaaggataatggtttggagacagagttctattcctgccagcattgacactgtgtctgaaaagccagcatcgacactgtgtctgcaaatccctcagctattctgagtctccgttttctccctgtgagatggagatcataaaatccgcctcatccttaggattattctcctgaagctacaataaggcctgaggcattgtacgctggaagaaacgtgtattaatagcaacttctgtcccaccccatcccccaacacgtcgatcccctccggagcataaaactttcccccagcatctgacctgcccaggccaccctagcacctaggagcgtgaattcctgatgcggg

SEQ ID NO: 75646 - DNA, 458 bp, Homo sapiens
ttcatcagcaaactatcatttatacctctgtatattcctgtaatctgtccctttctttccatctattattaccttagtctaaggaatcatcatattttccctggatcatcatcataacctcctgctaattcctaaattttttaacatgccacatcagactcaaatcctttaaaaacataacaaatcactaaatttccctgcataatatctgtctatctgtctataattccccccttatcttctgcatagcatacaattatgatcaagatcattttcatttattcatgttcccactaaaatgtgtatgtagccaggcatgaaggcacatacatgtagtcacagctacttgggaggctgaggcaggagaatggtgtgaacccaggaggcggagcttgcagtgagccgagatcgcgccactccactccagcctgggcgacacagcgaaactcgttctcaaa

SEQ ID NO: 75647 - DNA, 701 bp, Homo sapiens
acagggaggatttggatatatcacagaaaccaacatccagttgatgtgacgactcttctagagtccttcccacaaggaagattgtgacatttcactggtcctgaacccactcaggtgaagtgactttgctttcttctccttgacaacaggtgatgtggtgccaaatacctgagaccaaatcaaaggccttatgatgactcttgtacctggagccaggaggagcaggctggtgactctcatccctgattatttccatgggtgttattgtgacatttacctttgcccacctgttgagtgatttgataatttttcctagtaatagcccacagatgacattttaaattatacctgggtcaaaaacctcacttattttactcttgtgtcttaacagtgtcctcaaataggattctaacatatctttggacccatcatctaggttatgtgactctcctctcctgcatgaacactgcttccaatgaagagtgtagagtttgtaagcactgaatccaaatggcctgattttattgtctaggcctttcaacaggaggcaatgtgacatacgtctggcaccatcatttaggtgatatgactctcttctcctgcctggacagtctccacaagaagcattatgtcatacagctgggcccagtgcccaagttttgtgacttttctattacacgtctgtaaagaaaatattggaa

SEQ ID NO: 75648 - DNA, 544 bp, Homo sapiens
cctatctagcagggactgagtgagatggtacattgtatatttatcaaaagatgcttccagtttcaccttggcctgggcaactgcagacagtcttcttggatgatgcttgtgactcttcccgcaacacctgagtggcccctcatggttgggtacatgggtcccaaagctgagcctgaagtcgatgctgggaactgagtcaccaagggcatggatgcttccatcaaggcagacaagatttaaaaacctagtttcagtggcactaatgagaccaatagcaaacccaacctgggacgtcttaggagactggtcacaatttccatttctctctctgctcggcgtttttgcacaatcatgaagagtttggagagcaggaggaggcctcaaaaaggacatcctgagcttcttgatagtgtgtccgttgaaggcctcatcacttaattataaagaaaagttttgttattaatttgtctcctaagattaaatggatcatatttatcattaggtgctttttaaaaaataaaatttactcctatttattttgatt

SEQ ID NO: 75649 - DNA, 166 bp, Homo sapiens
ccccctctctctcttcctcctgctctggccacgtaagatgtgcctgcctccccttcaccttctgccatgattgtaagtttcttgaggcctccccaggagcagaagctgctatgcttcctgtatagcccatggaaccatgaaccaattaaaacctcttttctttatg

SEQ ID NO: 75650 - DNA, 442 bp, Homo sapiens
tggggcagtgtgagatgacgggaccagagcacgttcctggctgcagaggccacaagtcacgctgtctctgagagtggaatgtcaccatcgcccaggtggggatttttgtgtgttttgttcactgctgtacacccagcccccagcacagcgcctgtccaggacaagtgcccagtaaacacttgggaagcaatgcaagcgtcctcccagcagctcctgcaaacagacccccgacccaagcccttccttctgcctccactgccaccactgctgctcatctctgctggcacagaagtctcttccctggtcttccagaaatcccctctccacactcagccagagggagctattaaaactgcgggccagcccacatcagtccacagcaaagtcctctctaagggatctctgttgcttggagaataaaccctcggattccttccttggc

SEQ ID NO: 75651 - DNA, 378 bp, Homo sapiens
gtaattaccacttaccctggtcaatgggtccgagagattccccttgtaggcagggctgtggccagggtgctcacctggcccccaggaggtcccatgggcactgtctggccgggcttcatggctgacattccaggtcctcccagcagctcctgcaaacagacccccgacccaagcccttccttctgcctccactgccaccactgctgctcatctctgctggcacagaagtctcttccctggtcttccagaaatcccctctccacactcagccagagggagctattaaaactgcgggccagcccacatcagtccacagcaaagtcctctctaagggatctctgttgcttggagaataaaccctcggattccttccttggc

SEQ ID NO: 75652 - DNA, 1819 bp, Homo sapiens
tggggcagtgtgagatgacgggaccagagcacgttcctggctgcagaggccacaagtcacgctgtctctgagagtggaatgtcaccatcgcccaggtggggatttttgtgtgttttgttcactgctgtacacccagcccccagcacagcgcctgtccaggacaagtgcccagtaaacacttgggaagcaatgcaagcgtcctcccagcagctcctgcaaacagacccccgacccaagcccttccttctgcctccactgccaccactgctgctcatctctgctggcacagaagtctcttccctggtcttccagaaatcccctctccacactcagccagagggagctattaaaactgcgggccagcccacatcagtccacagcaaagtcctctctaagggatctctgttgcttggagaataaaccctcggattccttccttggctctcggggcctcctctctgacctccctctgtctcctctcccagccttcctcctcactcaccctccagccatgctggcttcctccttgctcctgaaacagcctgaggcccacactgccccgggccctttgcactggctgtttcctctgcctggagcacttctcctaggcatccacagggctccctcccacaactccttcgggtgcccacatgggaagccatccctgaccacccccccgacttccttctgagcaaggtagggtctttctacctagtcatgagggcagggatttttgtctgttgtgttctctgtgtgcccccagtgccatcccagtgcctggcagatggtaagtgctcgacacacattggctgactgcctgaatgaacaactctatgagccgatggcagataaggacactgaggtcctctggggtaggtgaccagcccaaggccacacagctggtctgagattaggccaggagaggagcccgggttggtcacatcctggagttggcgtcttggaaactgcatcaggagaataacaaagatgagacgcaggctctaacaagtggataccagtgactctcgccccgccagccccagccctgcagccttgggcccttccaggagtcatggtctgcctgcctggggcattccaggcttcgacccaggtcctgcactttctattttgagcctcttagtcctgaggactgtgtgttcccagcaggcggcgcgggccagaggctgagcctgggtgtggctgtcaccctatctggggccagagacccagattcccgggcccttaacctgttggctgctgagggctctggcataagccctgttccctgcttgattgtctccccttcaagcccctgccctggtatcgtatcggcccatctcaccttggattatatccctgtttggccccatttgaatcctggctctgcccctttccagcaatgtgaccttgggcaagtcacttcatctctctgggtctcagtttcttcatctgggaaatggggacaataagagtacctgtctctggccatgtgtggtgactcatgcctgtaaccccagcgctttgggaagccgaggcgagagaattgcttgagaccaggagtttgagatcagccctgggcaacatagtgagacccctgtctctacaaaattctaaaaaaattagccgggtgtggtggtgtgtgcctgtagtcccagctattctagaggctgaggcgggaggattgcttgagcccaggagtttgaggctgcagtgagctatgattatgcccctgcacatcagcctgggtgatagattgaggccccatctctaaaaataacaatactaataataaataaaaatgaaaatgagtacctgtctt

SEQ ID NO: 75653 - DNA, 813 bp, Homo sapiens
tggggcagtgtgagatgacgggaccagagcacgttcctggctgcagaggccacaagtcacgctgtctctgagagtggaatgtcaccatcgcccaggtggggatttttgtgtgttttgttcactgctgtacacccagcccccagcacagcgcctgtccaggacaagtgcccagtaaacacttgggaagcaatgcaagcgtcctcccagcagctcctgcaaacagacccccgacccaagcccttccttctgcctccactgccaccactgctgctcatctctgctggcacagaagtctcttccctggtcttccagaaatcccctctccacactcagccagagggagctattaaaactgcgggccagcccacatcagtccacagcaaagtcctctctaagggatctctgttgcttggagaataaaccctcggattccttccttggctctcggggcctcctctctgacctccctctgtctcctctcccagccttcctcctcactcaccctccagccatgctggcttcctccttgctcctgaaacagcctgaggcccacactgccccgggccctttgcactggctgtttcctctgcctggagcacttctcctaggcatccacagggctccctcccacaactccttcgggtgcccacatgggaagccatccctgaccacccccccgacttccttctgagcaaggtagggtctttctacctagtcatgagggcagggatttttgtctgttgtgttctctgtgtgcccccactggattacaatagccatctaattgggatccctgtgccagcagagatgagc

SEQ ID NO: 75654 - DNA, 533 bp, Homo sapiens
cacagctgggatgtggcagagctggggttccagctcctgttcccattgctggacagctgccacatctggcacccaatttaggaccccgcggggaggcccaagccccgggggtggcgggggatcctagaggaaagtggcaaggccaggaccctggagcagagccagtggaatgtcaccatcgcccaggtggggatttttgtgtgttttgttcactgctgtacacccagcccccagcacagcgcctgtccaggacaagtgcccagtaaacacttgggaagcaatgcaagcgtcctcccagcagctcctgcaaacagacccccgacccaagcccttccttctgcctccactgccaccactgctgctcatctctgctggcacagaagtctcttccctggtcttccagaaatcccctctccacactcagccagagggagctattaaaactgcgggccagcccacatcagtccacagcaaagtcctctctaagggatctctgttgcttggagaataaaccctcggattccttccttggc

SEQ ID NO: 75655 - DNA, 1783 bp, Homo sapiens
acagtcacatcctactgaacatcatcctgttctctgggtggaatgtcaccatcgcccaggtggggatttttgtgtgttttgttcactgctgtacacccagcccccagcacagcgcctgtccaggacaagtgcccagtaaacacttgggaagcaatgcaagcgtcctcccagcagctcctgcaaacagacccccgacccaagcccttccttctgcctccactgccaccactgctgctcatctctgctggcacagaagtctcttccctggtcttccagaaatcccctctccacactcagccagagggagctattaaaactgcgggccagcccacatcagtccacagcaaagtcctctctaagggatctctgttgcttggagaataaaccctcggattccttccttggctctcggggcctcctctctgacctccctctgtctcctctcccagccttcctcctcactcaccctccagccatgctggcttcctccttgctcctgaaacagcctgaggcccacactgccccgggccctttgcactggctgtttcctctgcctggagcacttctcctaggcatccacagggctccctcccacaactccttcgggtgcccacatgggaagccatccctgaccacccccccgacttccttctgagcaaggtagggtctttctacctagtcatgagggcagggatttttgtctgttgtgttctctgtgtgcccccagtgccatcccagtgcctggcagatggtaagtgctcgacacacattggctgactgcctgaatgaacaactctatgagccgatggcagataaggacactgaggtcctctggggtaggtgaccagcccaaggccacacagctggtctgagattaggccaggagaggagcccgggttggtcacatcctggagttggcgtcttggaaactgcatcaggagaataacaaagatgagacgcaggctctaacaagtggataccagtgactctcgccccgccagccccagccctgcagccttgggcccttccaggagtcatggtctgcctgcctggggcattccaggcttcgacccaggtcctgcactttctattttgagcctcttagtcctgaggactgtgtgttcccagcaggcggcgcgggccagaggctgagcctgggtgtggctgtcaccctatctggggccagagacccagattcccgggcccttaacctgttggctgctgagggctctggcataagccctgttccctgcttgattgtctccccttcaagcccctgccctggtatcgtatcggcccatctcaccttggattatatccctgtttggccccatttgaatcctggctctgcccctttccagcaatgtgaccttgggcaagtcacttcatctctctgggtctcagtttcttcatctgggaaatggggacaataagagtacctgtctctggccatgtgtggtgactcatgcctgtaaccccagcgctttgggaagccgaggcgagagaattgcttgagaccaggagtttgagatcagccctgggcaacatagtgagacccctgtctctacaaaattctaaaaaaattagccgggtgtggtggtgtgtgcctgtagtcccagctattctagaggctgaggcgggaggattgcttgagcccaggagtttgaggctgcagtgagctatgattatgcccctgcacatcagcctgggtgatagattgaggccccatctctaaaaataacaatactaataataaataaaaatgaaaatgagtacctgtctt

SEQ ID NO: 75656 - DNA, 928 bp, Homo sapiens
caggcaaaagctcctacggacgggagctagccctcagtccgcccgagctgtggttgtgggcgctggacaagtccaaggcgcctcctcccaatatggacagccgctacaacagcactgcgggcatcggggacttgaaccagctgagcgctgccatcccggccacgcgggtggaggtgtccgtgtcctgcagaaatcttcttgacagagacacattttctaaatctgatccaatttgtgtcttatatgtacaaggagttggaaataaagaatggagagagtttggaagaactgaagtaattgataatactttaaatcctgattttgtaagaaagtttattctggactacttttttgaagaaagagagaatcttcgttttgacttgtatgatgttgattcaaagagccccaacttatccaaacatgactttctgggacaagtgttttgtacattgggagagatcgttggttcacagggaagtcgcctggaaaaaccaatagtaggaattccagggaagaaatgtggtacaatcatacttacagcagaggaattaaactgttgcagggatgccgttttgatgcaattttgtgcgaacaaattggacaagaaggacttctttggaaaatcagatcctttccttgtattttatcgaagtaatgaagatggcagttttacaatttgtcacaagacagaagttgtcaaaaacactctaaatccagtatggcaagcattcaagatctcagtcagagcattatgtaatggagactatgacagaacaatcaaagtagaggtgtatgactgggaccgagatggaagtcatgatttcattggagaatttacaacaagctatagggaactttctagagggcagtcacaattcaacgtatatgaggtgtgatcccaaaagaaaggaaaaaaaggggtcctcta

SEQ ID NO: 75657 - DNA, 1127 bp, Homo sapiens
caggcaaaagctcctacggacgggagctagccctcagtccgcccgagctgtggttgtgggcgctggacaagtccaaggcgcctcctcccaatatggacagccgctacaacagcactgcgggcatcggggacttgaaccagctgagcgctgccatcccggccacgcgggtggaggtgtccgtgtcctgcagaaatcttcttgacagagacacattttctaaatctgatccaatttgtgtcttatatgtacaaggagttggaaataaagaatggagagagtttggaagaactgaagtaattgataatactttaaatcctgattttgtaagaaagtttattctggactacttttttgaagaaagagagaatcttcgttttgacttgtatgatgttgattcaaagagccccaacttatccaaacatgactttctgggacaagtgttttgtacattgggagagatcgttggttcacagggaagtcgcctggaaaaaccaatagtaggaattccagggaagaaatgtggtacaatcatacttacagcagaggaattaaactgttgcagggatgccgttttgatgcaattttgtgcgaacaaattggacaagaaggacttctttggaaaatcagatcctttccttgtattttatcgaagtaatgaagatggcagttttacaatttgtcacaagacagaagttgtcaaaaacactctaaatccagtatggcaagcattcaagatctcagtcagagcattatgtaatggagactatgacagaacaatcaaagtagaggtgtatgactgggaccgagatggaagtcatgatttcattggagaatttacaacaagctatagggaactttctagagggcagtcacaattcaacgtatatgagagtgcttgttcctcaaattatctggaagaattgcggaattcttcaaatctcaagatcaaacattacctttctcctccaaacaacctgctccatatttaatagaataaccattgaaccatctgaaaaatttgtgatcttgccagtgacgcccaacatccttactggtgcatgttttcctgtagaatttgttcaattagggctttctgaaatacacaataaataatacgtggaatgaat

SEQ ID NO: 75658 - DNA, 556 bp, Homo sapiens
  misc_feature (456)..(456): n is a, c, g, or t
  misc_feature (518)..(518): n is a, c, g, or t
  misc_feature (539)..(539): n is a, c, g, or t
caggcaaaagctcctacggacgggagctagccctcagtccgcccgagctgtggttgtgggcgctggacaagtccaaggcgcctcctcccaatatggacagccgctacaacagcactgcgggcatcggggacttgaaccagctgagcgctgccatcccggccacgcgggtggaggtgtccgtgtcctgcagaaatcttcttgacagagacacattttctaaatctgatccaatttgtgtcttatatgtacaaggagttggaaataaagaatggagagagtttggaagaactgaagtaattgataatactttaaatcctgattttgtaagaaagtttattctggactacttttttgaagaaagagagaatcttcgttttgacttgatgatgttgattcaaagagccccaacttatccaacatgacttttggacaaagtgtttgtcttggagagatcgntggttacaggggaagtcgctggaaaccaatagtaggacttttgctgggtccgactcgaatcnaatatggcatagctgttctgntgaaatgtatccgtaca

SEQ ID NO: 75659 - DNA, 418 bp, Homo sapiens
cctcaagcccccaaattctgtatgccttaacaaatactggaaattactctaaggaaatgaatagaataagactcagactactgcttggagcaatcagcatctctgctctttctggctatttgagtgcactggtacgggctgtcctttcttctcccaacttcccttagagcctctgaattattttctcacgaacctcatggaaatagattgctctgttaaatacattgcttaggttttagcacattaaaacataccctgttctatatgatccatgatgcaagctaaattggtgctccttctccaaagacataaaactgttttcaaagttcttaagggagacagagtgaaacagtccttgtctctgtgttttcagcgaagttgccaccatgctaccagcaagaagccatctgtgttatgt

SEQ ID NO: 75660 - DNA, 3047 bp, Homo sapiens
ggaaggaggcgggaggaggagttgccgagaggagaaggcgagcgcggcagtcgcgccggcgctgggcgaggaagcggagccgggccgcctccggaaaatggctccaaaggttaaatgaagcaggaaaaatacatagatgcagccttgcagcctctccagatgtttggggataatattccagatagaaatattgatcccttggattaggtaactagtcataatgaagaaaattagtcttaaaaccttacggaaatcttttaacttgaataaaagtaaagaagaaactgatttcatggtagtacaacaaccatcgctagccagtgactttggaaaagatgattccttatttggtagctgctatggtaaagatatggccagctgcgatatcaacggtgaagatgaaaaaggcggaaaaaacagatcaaaaagcgagagcctgatgggtacgctaaaaaggcggctttctgcaaaacagaagtcaaaaggcaaggcgggcacaccctctgggagctctgccgacgaggacaccttctcctcctcctcagcacccatagtctttaaagacgtgagagctcagaggccgataaggtccacgtcgctccgcagccatcactacagtcccgcgccgtggcctctgcggcccacaaactccgaggagacctgcatcaagatggaggtgagagtcaaggccttggttcactcttccagcccgagtccagccctgaatggcgtccggaaggatttccacgacctccagtctgagaccacgtgccaggagcaagccaattcactgaagagctcggcttctcataatggagacctgcatcttcacctggatgaacatgtgcctgtcgttattggacttatgcctcaggactacattcagtatactgtgcctttagatgaggggatgtatcctttggaaggatcacggagctattgtctggacagctcttctcccatggaagtctctgcggttcctcctcaagtgggagggcgcgctttccccgaggatgagagtcaggtagaccaggacctagttgtcgccccagagatcttcgtggatcagtccgtgaatggcttgttgattggcaccacgggagtcatgttgcagagcccgagagcgggtcacgatgatgtccctccactctcaccattgctacctccaatgcagaataatcaaatccaaaggaacttcagtggactcactggcacagaagcccacgtggctgaaagtatgcgctgtcatttgaattttgatccgaactctgctcctggggttgcaagagtttatgactcagtgcaaagtagtggtcccatggttgtgacaagccttacagaggagctgaaaaaacttgcaaagcaaggatggtactggggaccaatcacacgttgggaggcagaagggaagctagcaaacgtgccagatggttcttttcttgttcgggacagttctgacgaccgttaccttttaagcttgagctttcgctcccatggtaaaacacttcacactagaattgagcactcaaatggtaggtttagcttttatgaacagccagatgtggaaggacatacgtccatagttgatctaattgagcattcaatcagggactctgaaaatggagctttttgttattcaaggtctcggctgcctggatctgcaacttaccccgtcagactgaccaacccagtgtcccggttcatgcaggtgcgctcgttgcagtacctgtgtcgttttgttatacgtcagtataccagaatagacttaattcagaaactgcctttgccaaacaaaatgaaggattatttacaggagaagcactactgaaagattgagaaccctgcatcttgcactttgggaataagaacaagagattgaaatacagtttacaaactttcattgccatcaaaatcttttgctgccataactatttcagttttatgtgtaaaagagtcatcagtttgtttaggggtggggaagtgtcagcaaggtgtcttgggtttattttggttctttaaaaaagggaagtcttgaggttttagaggtgtgaattatgtttcatcaatgtgcagaataatcacaatgtgaattatcaaattctcctcaatgccccccccgcccagtcctttgctgctatccactgtgatttttatgcattaaaagcacatttcatgtgtattcaaccctaagtaaagttgaatgaaacttaacagaatggaaattgctatgtctttttaaatggtccattttcaaaagacagtgttgaataaacatacctgtgtgataaaacacagaatttacatatacactgaagatgagtttttaatctcttactttaaaaagatttatttagaatcgtgaattgacataatcttgggtaatggaacggagatctgcaacatatcttttaacaacacttttttctaaattatttctaaggttgtgctaattcttttggttgtgaaaagttgaatttttctgttgccttcgttttcatcttctagtttgtctattttaataaatggccttacattaaaaaattgtaaagaaatgtataccaccaatttagaaattgttgccttttctgtaattaaactcgggtacaaattggcataacatgaaaacctatggaactagaattattattaaagaaatattagatgatcatagcttcctgtgatagcatttttttgtgtgttacctatccttttggtaaaatgttttatctgtgatttctttagcttagtcaacattttcttgggtgaacttgattgtcaactaattttcataaatggactggattctcttgcaacattaatgtttataaaaagttttaaattgatttgaatagaaagaaaacattgttttaaagttggatttatatttttcttctatgtagttactataaaagtgtgctggatttgaccaatccttacccccactataaagagaacccgtgatgactttagtttaaaaattgtggaaattgtggagcaatttttctcacaatgtgagaaaaattctaaaccatattagataatgtgga

SEQ ID NO: 75661 - DNA, 3003 bp, Homo sapiens
gcttgcagtgagccgagatcacgccactgcactccagcctgggcgaaagaaaaatggctccaaaggttaaatgaagcaggaaaaatacatagatgcagccttgcagcctctccagatgtttggggataatattccagatagaaatattgatcccttggattaggtaactagtcataatgaagaaaattagtcttaaaaccttacggaaatcttttaacttgaataaaagtaaagaagaaactgatttcatggtagtacaacaaccatcgctagccagtgactttggaaaagatgattccttatttggtagctgctatggtaaagatatggccagctgcgatatcaacggtgaagatgaaaaaggcggaaaaaacagatcaaaaagcgagagcctgatgggtacgctaaaaaggcggctttctgcaaaacagaagtcaaaaggcaaggcgggcacaccctctgggagctctgccgacgaggacaccttctcctcctcctcagcacccatagtctttaaagacgtgagagctcagaggccgataaggtccacgtcgctccgcagccatcactacagtcccgcgccgtggcctctgcggcccacaaactccgaggagacctgcatcaagatggaggtgagagtcaaggccttggttcactcttccagcccgagtccagccctgaatggcgtccggaaggatttccacgacctccagtctgagaccacgtgccaggagcaagccaattcactgaagagctcggcttctcataatggagacctgcatcttcacctggatgaacatgtgcctgtcgttattggacttatgcctcaggactacattcagtatactgtgcctttagatgaggggatgtatcctttggaaggatcacggagctattgtctggacagctcttctcccatggaagtctctgcggttcctcctcaagtgggagggcgcgctttccccgaggatgagagtcaggtagaccaggacctagttgtcgccccagagatcttcgtggatcagtccgtgaatggcttgttgattggcaccacgggagtcatgttgcagagcccgagagcgggtcacgatgatgtccctccactctcaccattgctacctccaatgcagaataatcaaatccaaaggaacttcagtggactcactggcacagaagcccacgtggctgaaagtatgcgctgtcatttgaattttgatccgaactctgctcctggggttgcaagagtttatgactcagtgcaaagtagtggtcccatggttgtgacaagccttacagaggagctgaaaaaacttgcaaagcaaggatggtactggggaccaatcacacgttgggaggcagaagggaagctagcaaacgtgccagatggttcttttcttgttcgggacagttctgacgaccgttaccttttaagcttgagctttcgctcccatggtaaaacacttcacactagaattgagcactcaaatggtaggtttagcttttatgaacagccagatgtggaaggacatacgtccatagttgatctaattgagcattcaatcagggactctgaaaatggagctttttgttattcaaggtctcggctgcctggatctgcaacttaccccgtcagactgaccaacccagtgtcccggttcatgcaggtgcgctcgttgcagtacctgtgtcgttttgttatacgtcagtataccagaatagacttaattcagaaactgcctttgccaaacaaaatgaaggattatttacaggagaagcactactgaaagattgagaaccctgcatcttgcactttgggaataagaacaagagattgaaatacagtttacaaactttcattgccatcaaaatcttttgctgccataactatttcagttttatgtgtaaaagagtcatcagtttgtttaggggtggggaagtgtcagcaaggtgtcttgggtttattttggttctttaaaaaagggaagtcttgaggttttagaggtgtgaattatgtttcatcaatgtgcagaataatcacaatgtgaattatcaaattctcctcaatgccccccccgcccagtcctttgctgctatccactgtgatttttatgcattaaaagcacatttcatgtgtattcaaccctaagtaaagttgaatgaaacttaacagaatggaaattgctatgtctttttaaatggtccattttcaaaagacagtgttgaataaacatacctgtgtgataaaacacagaatttacatatacactgaagatgagtttttaatctcttactttaaaaagatttatttagaatcgtgaattgacataatcttgggtaatggaacggagatctgcaacatatcttttaacaacacttttttctaaattatttctaaggttgtgctaattcttttggttgtgaaaagttgaatttttctgttgccttcgttttcatcttctagtttgtctattttaataaatggccttacattaaaaaattgtaaagaaatgtataccaccaatttagaaattgttgccttttctgtaattaaactcgggtacaaattggcataacatgaaaacctatggaactagaattattattaaagaaatattagatgatcatagcttcctgtgatagcatttttttgtgtgttacctatccttttggtaaaatgttttatctgtgatttctttagcttagtcaacattttcttgggtgaacttgattgtcaactaattttcataaatggactggattctcttgcaacattaatgtttataaaaagttttaaattgatttgaatagaaagaaaacattgttttaaagttggatttatatttttcttctatgtagttactataaaagtgtgctggatttgaccaatccttacccccactataaagagaacccgtgatgactttagtttaaaaattgtggaaattgtggagcaatttttctcacaatgtgagaaaaattctaaaccatattagataatgtgga

SEQ ID NO: 75662 - DNA, 514 bp, Homo sapiens
atggtcctgttagaaaaggaaaacttctgttatatttctaattgtatctctggtagagtagagtagggctaagtgcaaagtggcacaaatttgcaacagaaaaggaactattttacgttcttttgaataggtaatgcattcacatggttcaaaattgggaaaataaaaatgtctcttatccttgcctcccaggtactcagttcccttccatggaggcaaggtagtcttttgtgtcaccttccagagctattctataaacatataagcaaaaaagaaaatgattaggctgggtgtggtagctcacgcctgtaatcctagcactttgggaggctgatacgggaggattgcttgagaccaggagtttgagaccagcctgggtgacagacatagtgagactgtctcttaaaaaaaaaaaagaaagaaaagaaaaaacaattaaaaaaaattatatctcaataaagcagttttgtaaaaaaaaaaaaaaaaaaaaaacccaaactatttctatagtata

SEQ ID NO: 75663 - DNA, 465 bp, Homo sapiens
agatcaaggtgctgatctggtgtctggggagggcctgctttctggttcagagatagtgtcttcttgcagtggcctcacatggcagaaggggtgagctgactcccttgggtctctttcataaaggcactaatactattcataagagttccactctcatgacctgatcacctctcaaaagttcccatctacaaatactatcacattgggggtaaggtctcaacatataaattttgtggggacacagacattcaaaccatagcagggtgcaaaataaaataatcataacaagaaagggattttggctatgaaaaagcagaatagttgaaagtaagtattcaaaagaaaagatagaaaataattgatgaccatagtacaaaaagatggaaaaatgtgagagagaggaaaatctgaggattcattctgaaagtccaacatccagcaagaatggagggcaggaaattatca

SEQ ID NO: 75664 - DNA, 685 bp, Homo sapiens
cctccccagtggacccaaaccagcgcatacttggtgtgtggagatgggagacaaaggacagatctaggagccttgaaggatcaccagccaccgaccctccatcagggccaactgggcaggaaagggaacattgcagacctgatttcccgacgatgtcaccctgtcctccctccttgcttcttgctctgctaactcaactctgccttcctctttttcattcttctactctgccctatatggaggacaaatggacaccaggggtgctaaccttattggtgcctgccccagcctaccccaggtgccagcagactctcgtgcacaggaggctcccacagttatggagccaggaaagaatttctctgcactggatggactgtatattgagattaaaaattatattccttatattcctgcttatatcaatgctctctctgtaaaacctcttcctagcctcatttctctcaactgatcttgtttaggcgttgtattccttttatttactctttgcttgactgcttcctcctaaccctctacccactagcactctacttcctaaagctgttgtgtcattaactctgttggatcaactctctgggaaaagattctgttaatgtaagtgcacttactccctggatgttgtcactagtctagtggcttttgctaaataaacctttcttatttctag

SEQ ID NO: 75665 - DNA, 1037 bp, Homo sapiens
tgattcctgtgcctcagcctcctgagtagctgggattacaggcgcacatcaccatgcctggctaatttttgtgttttcagtagagacgggattttgccatgttggccaggctggtctggaactcctgacctcaagtgatccagctgctccagcctcccaaagtgctgggattacaggcgtgagccaccacacccggcctagcacccgttttttaataggagaattatagaatcatttgctctgcttactttattcaaatgttcttctgaagcaataaacccattcattttgtcaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaaaaaaaaagaaaggagggggggggcggcgaaaactcccccgcgggggggccaacccccctatttaacaggcgccctccaataagtgagtctattaatttaactaagccagcgcggcgcggtcataacaaacagacgtgctgagaaggcaaacacacaccccaagccagctaggtcgtgtgatgaaaggccaccaccacctatgcgggggggatgacacagtagggacccccaaccatacagtagtaactaccagcacggggaaaaaaaaaagcaagtatgtatgtgggtacaaaacccgccctaatgagtcgagtggacacaaagtctggctgtggctttatttttctcttatactatcttctagcgtgcttctgtctccattatacataagccccttagccactactaacaggactaagtcgaatagcagacgaatgcacacgtagacacagactgagaacggtagtaacgatcaatatcagtaagaaaaactgaaacacacaaggaggcaagaaataacatatcacgaccgcatagaacaagctgaacactcaagacacaacaaaaacatcagactatgacgtacagtacaaatagctaaagtaaacgcatgagagatacgagaacag

SEQ ID NO: 75666 - DNA, 458 bp, Homo sapiens
tgattcctgtgcctcagcctcctgagtagctgggattacaggcgcacatcaccatgcctggctaatttttgtgttttcagtagagacgggattttgccatgttggccaggctggtctggaactcctgacctcaagtgatccagctgctccagcctcccaaagtgctgggattacaggcgtgagccaccacacccggcctagcacccgttttttaataggagaattatagaatcatttgctctgcttactttattcaaatgttcttctgaagcaataaacccattcattttgtcaaccaaattgttgaaattagttctaccagaaccaattgttttattgatatgaaaggaaagtttggttttttttccccctttttttttgagacagagcctcactctgtcacccaggctatggtacagtattgcaatctcagctcactgcaacctctgcctcctgag

SEQ ID NO: 75667 - DNA, 396 bp, Homo sapiens
cccttgctttcgtctcccctgttgtgcttgaattttcctagagactcctgacatagggactgaggcttgcaattctttgagctgtaatcccttgttatttacttggagcatcgttgctgtgttggtactgtgtcgggggagagaaagaattctacagccctgtgattagatctgtctttcagtgagcctgagttgggtatttccctttcccaggtcgatgaggcccctggtaaaacccccgtgggatgggttcttgtaaagtattttcccttgaaggaaatccttcttaaggagaacagagagctctgggcttattccaacacggctatttctccgccccaacccctcaaccccaaagggaaagaggagaggatttttcttcaggttccatagtgg

SEQ ID NO: 75668 - DNA, 508 bp, Homo sapiens
tcgattaccctcccaagagtgaaagtgatccacacgggcatgatttgcttggattttggcgcaatgcctgcatttcagagaagcatgagcacaaacaaggtctggagacaatagttcctgttctgagtgaaccatgaacttaaaaaaaaaaaaatactgtctctctcagagcctcagtttccatgtctgtgaaatgggagcagtggtcataataggtggtgagcatcaaaagaagccatgtgggctgggcacagtggctcacgcatataatcccagaactttgggaggccatggcggcagggtcgcttgagcccaggagttccaacatcagccctggaaacagagcaagaccccatctctacaaaaaacaaacaaaattagccaggcatggtggtgtgtgcctgtaatcccagcaacttggaaggctgagtttggaggattacttgaacctgagagttcaaggctatagtgagacatgatcatgccactgcactccagcctgggcaac

SEQ ID NO: 75669 - DNA, 519 bp, Homo sapiens
gatgtcatgtcacttataacccaatgtcctttgaaagatctctttttttaagttctgtgggtttgaatatttcccactggaggagggtctctggaaacctcaggagtctaaggaataactccgcctgattcttaaaagctagtcacgtgtgctaacattggtttccagaactcagcgtcttgactcattggacaggcattttccctctgtgtgtctgtggagactgttgtgaaggaggatccccttaggatttgtgattatttttattttattaatttaatttaatttttttcatttttaaaatttattttattatttattatttactttattttctttgagacctagtttcactctgtcacccagactggggtgcagtggtgcaatcttggctcactgcaacttttgccccccaggagaatcgcttgaacctgggaggcgtaggttgcagtgagccgagatcacaccactgtactccagcctgggctacaagagcgaaactccatttcaaaaaaaaaa

SEQ ID NO: 75670 - DNA, 407 bp, Homo sapiens
caaaacaaacacagttagtaagtaaaatgagtgcatgtgattttttttaaaggaaactatcaaattattctaaatataaaaattttaaacgaaatttaaaacagtgagacttggccgggcactgtggctcacacctgtcatcccagcactttgggaggccgaggcaggtgtatcacttgaggtcagaagtttgagaccagcctggccaacatggtgaaaccccatctctactaaaaatacaaaaaaattagccgggcgtggtggtgggtgcctgtaatcccagctactcgggaagctcaggcaggagaatcgcttgaacctgggaggcgtaggttgcagtgagccgagatcacaccactgtactccagcctgggctacaagagcgaaactccatttcaaaaaaaaaa

SEQ ID NO: 75671 - DNA, 800 bp, Homo sapiens
ttggttgggtgggtgggttttctaaataggtatcaagacaatgggtcaggtaacatttggttcaaatgaatacaagtatataaaagggtttattctggaaacactgcccactgtatcccttaacagaagtattttacaaaatctggtccacggaccacctacttcagaatcagcagtgaaaaatgtagattcctgggcccaaccccaggtgtagtgaatcagaatctctggggatagaacaaagcttttgctatttaacaactctaaataattctgcatactctgatgttccaaaacaaccaggaggtggggatatttgtctcttcctctgcctaccttatctttgcatgtcaaattctgcagctcctattacctaccatactttctctttaggcctctgagaaaaccttgaaacagggtcagtaagtaggcaagggtttgaggttttaaggagctcccaatccctctattgtttggagggcatttggtccatcagaaccaggttgccactccttgtttacctgtcttacgttgcccgtcatggcaaagcagtagacgtcagagactccaggcaagtggaacactaaaaatataacaaacatggaaaactacaagccacttaatatttgcaaaacaaattgatgttctttgaaaggaaaatatccattgtagaagatgagaagtaaacattctgtacagtgtttataatagaccacctatggctacaatggtcatgatctcaccctacgtttctccgggaaataacattaccaggatatgctaagtattatgtggatggg

SEQ ID NO: 75672 - DNA, 362 bp, Homo sapiens
aaagatgttgttccactgtcttctggtctccattatttttctgatgagaagacatcaatcattcaaatcacaattcccttatatgtaatgtgtcatttttctctgacagctttcaaaatatctttagttttctgcaacttgctgacaatgtgccaggtgtgtgcaatgcaattctgacattacctagagtgaggtcaaatttcacaagttaagggtacagtcttccataagagctcccttattttgttataggtagttaggcatgagtggggcacgtgagggctctcccccagccactaggaatgtcaggtgatggttcagcaattatcacattgactctctaaaagtgacaaattggtagc

SEQ ID NO: 75673 - DNA, 403 bp, Homo sapiens
gactattacatattttggaaatatttttaaacaattaagaaaaaagtgataaaaaatttccttattaaattagcaaagatccaaaatgaaagattatcccaatatttttgttaaatagatactttttttgttagacactgctggtgggaatataaatacaatgtttcttagtataatgtttctaaagggcaaattgttagagaagtctgagaacaaatgctctgccttttttaagaattgacagataaaatggtatgtatttttcatgtacaacatgatgttttaaagtatttgcacattgtggaatggttaaatttagccagttacctcacagaggtttttttgtgtgtgaaaacacttaatatccactttctttgcatttttcaagaatacagtatattgt

SEQ ID NO: 75674 - DNA, 276 bp, Homo sapiens
  misc_feature (206)..(206): n is a, c, g, or t
  misc_feature (219)..(219): n is a, c, g, or t
aaattaacaagataaacctcagaaacgttacaaatatatgaaaattaaaatacagactgctgaacaactaatgtgtaagtgaagaaattgaaaggaaaattaaaaaaaacaagacaaagataaaaacaaacaaaattcgtcgggcgtagtaatgcatatctgtaatccccgctactcgggaggctgaggcaggcgaatcgctggancctgcgaggtganggttgccttgagccaagatagcaccactgcactctgccttcaaaaacagaaccaaca

SEQ ID NO: 75675 - DNA, 877 bp, Homo sapiens
accgggcaagtctctgcggggtgggaccctgtcccaggacgcaggattggcgctgagctcgggatctctgtgtgcacctgcatcgctggtaggaggacgcccaggaaccaaggagtgaggcaggagcagcccccggcatcatcactcccagtgacccaggaagggatttgtgcttttttccctgcggctctgggcactgcagagttagaggtcctggtccccggggatggagggagggggtatatcagcgggcacagagcatgtccagtgacgcacaaaccacggctgccctctggtgcgtcgggttccttgtggggggatcaccaggcaggagagagcaccaccgtcctggcaggtacaacagaccccagccagagggtggaggcggggccgcggctgcacagggggcatgtggggaattcaggtgatctgcgtggacacctcatggtggccctggccagctgtcactaaatgggcagctacggcaggccccgctggacatggcatggtggcagggtgccagagccctcggtaggaaggactgggtcacagcactaagtgaactgctgttgtctgcagagacataactgagggtgagggtccgggctgggtaatggaaggagggggaaacggctcaagggggctagcatgggcgcagcagccactgcactggggccatgatcacagagtcattgcccagaagcatagctccggggcactgggccatgctcgtgacttggtgaatgagtgaatgggtgagtgaatgagcttcacagatttccacagtgaagagaacccttagagtgtctgatccgcccctccatttgcaaagcacagatctggaaactggacggccccaaactgagtccaagtcctg

SEQ ID NO: 75676 - DNA, 318 bp, Homo sapiens
  misc_feature (307)..(307): n is a, c, g, or t
aggtagacactaaaaataacttctgagcatttatattaactttaccctacctataacatggttatcctgcaatatgtaaatatactatttctttacacagaattaaaggccatctcatttgtaattagagccaaaaagagcaaagtaattttacatataatttggtacacatccttacagctataaatactgaaaaggaattagtagtgtctacctagaaaaataacttctgagaagatgatttctatgaagataaacattaaggaaatcttcagaaaagggaaaaccctgtcctactttatggtgntggaattctct

SEQ ID NO: 75677 - DNA, 479 bp, Homo sapiens
tgattgcctgtctcaccaccagtttctctccttactactgcagctgggtatttaagtagctctttatttaaaaaatggaaatgaacagatatagtctttcttttccctgggcagttgctgactctggattcctctgtggaatattatactcttaagaactatctgtagatgactctccttttgcaaaggcaaagcagaaattaattaaccattaaccaaataatcacattggcatcatccacagaattgtaatattctctggggcacaggatacttcttttttcatccccacgcccattataaataccttttatacatgcatgcagaatgaaaaaggaccatgggcccatgtcagtattttcagcttcacccaacactaaaatagcaactatttccagtcattttttgcatacaaaagacacacatacacagtaaatttggggggagcaggttgttgcttttataaactgcatggtatg

SEQ ID NO: 75678 - DNA, 403 bp, Homo sapiens
aatcttagttcagttatcaccacatgataatctgattctcagtcagcctgtgtcttcacctcttccactaagtggtggcaagttttcaacactactgcagaatttaggccctgaaaatgctgtgacactactggtgtttgcagtaacagaacataaaattcttatccattccctacggccatccgtgcttactagtgtgacagaagcattagtgtctatgattttccctttccactggccatgcccgtatgttcctctctgcccactggctttagcagatgtcttgagtgcaccatgtccattcatagtagggattgattcaagatactttgatctctatgatcctccaccagatgtcagttgtgttgatgtagataccaacactatttctcagattggtaca

SEQ ID NO: 75679 - DNA, 204 bp, Homo sapiens
atttttaaaagcagtttgcttaaaatagagtatgtaagccagatttactttgtgactgttttttaaatgcagaataaaacatgccattactgaagaacatggacaaactgctccagagtatatgttcttcgtttacagaatggaaagctaaagcaggaacatgcaatatgaatttatattataaataaacaaattactgctttt

SEQ ID NO: 75680 - DNA, 273 bp, Homo sapiens
cacaaatcatctaacccctgaagaaaagcatttcctcccaggggcatctttccatctctgagtcctgttgtgcctgctgacactagcaaactctcattccccatctgaatgaggcatttttatttttgaagatggcctatttggaaaatccctaaaacagtgtttcccaaacccaggatctgtggcccactgagggtttgttgttatattcttaagtgtctacaagaagtttatatgtacgttcatattcctaagcttttaaaaaacaaacag

SEQ ID NO: 75681 - DNA, 387 bp, Homo sapiens
tttttgtgttgtgtgtagagactgggttttgccatgtgcccaggctggtcttgaactcctcggcttaagcgatcctcctgccttgacttcacaaagtgcttgagttacaggtgtgagctaccacgcctggccatgttttcttgtgtgaaggatctgtttagttttatatctttctgtggctcatatctaatttagttgacagtacctgtgggtcactaggtagacattgctagcagacgtttagaaatgaaatactagagcttgggaaaaagttgatatttgagatagagacttgaagaacattagcagagagttggtagttaaggtctgtgagctggtgagcaattcaaataaaagcagaagagaagaggaagacaagggtcaaac

SEQ ID NO: 75682 - DNA, 318 bp, Homo sapiens
aaaaaagtgcaagacttatatattgaaaactgcaagatactgttgaaagaaattgttaaagacctaaacgaatggaaagacatcctgtattcatgaaatggaagatttagcattgttcaaatggcaatatctttgcaaagcaatctgtagattaagtacaatctctatagaattcaacctgtcttttttgcagaaatgaatagggaacccagaatagccaaaataatttttttaaagatttcttatttcaaaacttactacagagctatagtaaccaaaatgttgtgatacaggcataaagacagacataaagaccaa

SEQ ID NO: 75683 - DNA, 1350 bp, Homo sapiens
  misc_feature (18)..(18): n is a, c, g, or t
  misc_feature (75)..(75): n is a, c, g, or t
  misc_feature (90)..(90): n is a, c, g, or t
  misc_feature (328)..(328): n is a, c, g, or t
  misc_feature (332)..(333): n is a, c, g, or t
ggcgcacccaccccagangccgcctggcaccaagcgcaccgccgctgccgcactttccacttgtattgatcaccnctcagccccgcgcancggctcgcccgagcggaccgcggccagcgcgccacccttggcagccccggagcagtcgggctccgggaggaaacaccttgggagcgccctgtccggggtgccctctgcgctctgcagtgtctttctttctgcctgggaggaggaggaggaggaggaagaggaggaggaggaggaggaggaggaggaggaagaggaggaggaggaggaggacgtctggtcccggctgggaggtggacancggnngcagcagcagccgccgccgccgccgccgctgccgccgccgccggaaagggagaggcaggagagcccgagacttggaaaccccaaagtgtccgcgaccctgcacggcaggctcccttccagcttcatgggcaaagtgtggaaacagcagatgtaccctcagtacgccacctactattacccccagtatctgcaagccaagcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggtgagacttactggaatgacacttacttacgacccaactacagctgctatacaaaacggattttatccttcaccatacagtattgctacaaaccgaatgatcactcaaacttctattacaccctatatgtatctcctgtatctgcc

SEQ ID NO: 75684 - DNA, 914 bp, Homo sapiens
aggaaggattacactgttccagtttttagggagaaaggtttaccaaaccgatggccttaaatgattttcgctccttgatattatcatcttgaaggacagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggtgagacttactggaatgacacttacttacgacccaactacagctgctatacaaaacggattttatccttcaccatacagtattgctacaaaccgaatgatcactcaaacttctattacaccctatatgtatctcctgtatctgcc

SEQ ID NO: 75685 - DNA, 3207 bp, Homo sapiens
atttctcaggagaacttatggcttcagaatcacagctcggtttttaagatggacataacctgtacgaccttctgatgggctttcaactttgaactggatgtggacacttttctctcagatgacagaattactccaacttcccctttgcagttgcttcctttccttgaaggtagctgtatcttattttctttaaaaagctttttcttccaaagccacttgccatgccgaccgtcattagcgcatctgtggctccaaggacagcggctgagccccggtccccagggccagttcctcacccggcccagagcaaggccactgaggctgggggtggaaacccaagtggcatctattcagccatcatcagccgcaattttcctattatcggagtgaaagagaagacattcgagcaacttcacaagaaatgtctagaaaagaaagttctttatgtggaccctgagttcccaccggatgagacctctctcttttatagccagaagttccccatccagttcgtctggaagagacctccggaaatttgcgagaatccccgatttatcattgatggagccaacagaactgacatctgtcaaggagagctaggggactgctggtttctcgcagccattgcctgcctgaccctgaaccagcaccttcttttccgagtcataccccatgatcaaagtttcatcgaaaactacgcagggatcttccacttccagttctggcgctatggagagtgggtggacgtggttatagatgactgcctgccaacgtacaacaatcaactggttttcaccaagtccaaccaccgcaatgagttctggagtgctctgctggagaaggcttatgctaagctccatggttcctacgaagctctgaaaggtgggaacaccacagaggccatggaggacttcacaggaggggtggcagagttttttgagatcagggatgctcctagtgacatgtacaagatcatgaagaaagccatcgagagaggctccctcatgggctgctccattgatgatggcacgaacatgacctatggaacctctccttctggtctgaacatgggggagttgattgcacggatggtaaggaatatggataactcactgctccaggactcagacctcgaccccagaggctcagatgaaagaccgacccggacaatcattccggttcagtatgagacaagaatggcctgcgggctggtcagaggtcacgcctactctgtcacggggctggatgaggtcccgttcaaaggtgagaaagtgaagctggtgcggctgcggaatccgtggggccaggtggagtggaacggttcttggagtgatagatggaaggactggagctttgtggacaaagatgagaaggcccgtctgcagcaccaggtcactgaggatggagagttctggatgtcctatgaggatttcatctaccatttcacaaagttggagatctgcaacctcacggccgatgctctgcagtctgacaagcttcagacctggacagtgtctgtgaacgagggccgctgggtacggggttgctctgccggaggctgccgcaacttcccagatactttctggaccaaccctcagtaccgtctgaagctcctggaggaggacgatgaccctgatgactcggaggtgatttgcagcttcctggtggccctgatgcagaagaaccggcggaaggaccggaagctaggggccagtctcttcaccattggcttcgccatctacgaggtagatgcacgggaacaagcagcacctgcagaaggacttcttcctgtacaacgcctccaaggccaggagcaaaacctacatcaacatgcgggaggtgtcccagcgcttccgcctgcctcccagcgagtacgtcatcgtgccctccacctacgagccccaccaggagggggaattcatcctccgggtcttctctgaaaagaggaacctctctgaggaagttgaaaataccatctccgtggatcggccagtgcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctgggcctcatccaaagccatgcaggatcactccaggatttcagtttcaccctctatttccaaagccatttacctcaaaggacccagcagctacacccctacaggcttccaggcacctcatcagtcatgttcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggtc

SEQ ID NO: 75686 - DNA, 2949 bp, Homo sapiens
atttctcaggagaacttatggcttcagaatcacagctcggtttttaagatggacataacctgtacgaccttctgatgggctttcaactttgaactggatgtggacacttttctctcagatgacagaattactccaacttcccctttgcagttgcttcctttccttgaaggtagctgtatcttattttctttaaaaagctttttcttccaaagccacttgccatgccgaccgtcattagcgcatctgtggctccaaggacagcggctgagccccggtccccagggccagttcctcacccggcccagagcaaggccactgaggctgggggtggaaacccaagtggcatctattcagccatcatcagccgcaattttcctattatcggagtgaaagagaagacattcgagcaacttcacaagaaatgtctagaaaagaaagttctttatgtggaccctgagttcccaccggatgagacctctctcttttatagccagaagttccccatccagttcgtctggaagagacctccggaaatttgcgagaatccccgatttatcattgatggagccaacagaactgacatctgtcaaggagagctaggggactgctggtttctcgcagccattgcctgcctgaccctgaaccagcaccttcttttccgagtcataccccatgatcaaagtttcatcgaaaactacgcagggatcttccacttccagttctggcgctatggagagtgggtggacgtggttatagatgactgcctgccaacgtacaacaatcaactggttttcaccaagtccaaccaccgcaatgagttctggagtgctctgctggagaaggcttatgctaagctccatggttcctacgaagctctgaaaggtgggaacaccacagaggccatggaggacttcacaggaggggtggcagagttttttgagatcagggatgctcctagtgacatgtacaagatcatgaagaaagccatcgagagaggctccctcatgggctgctccattgatacaatcattccggttcagtatgagacaagaatggcctgcgggctggtcagaggtcacgcctactctgtcacggggctggatgaggtcccgttcaaaggtgagaaagtgaagctggtgcggctgcggaatccgtggggccaggtggagtggaacggttcttggagtgatagatggaaggactggagctttgtggacaaagatgagaaggcccgtctgcagcaccaggtcactgaggatggagagttctggatgtcctatgaggatttcatctaccatttcacaaagttggagatctgcaacctcacggccgatgctctgcagtctgacaagcttcagacctggacagtgtctgtgaacgagggccgctgggtacggggttgctctgccggaggctgccgcaacttcccagatactttctggaccaaccctcagtaccgtctgaagctcctggaggaggacgatgaccctgatgactcggaggtgatttgcagcttcctggtggccctgatgcagaagaaccggcggaaggaccggaagctaggggccagtctcttcaccattggcttcgccatctacgaggtagatgcacgggaacaagcagcacctgcagaaggacttcttcctgtacaacgcctccaaggccaggagcaaaacctacatcaacatgcgggaggtgtcccagcgcttccgcctgcctcccagcgagtacgtcatcgtgccctccacctacgagccccaccaggagggggaattcatcctccgggtcttctctgaaaagaggaacctctctgaggaagttgaaaataccatctccgtggatcggccagtgccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctgggcctcatccaaagccatgcaggatcactccaggatttcagtttcaccctctatttccaaagccatttacctcaaaggacccagcagctacacccctacaggcttccaggcacctcatcagtcatgttcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggtc

SEQ ID NO: 75687 - DNA, 3258 bp, Homo sapiens
cggaggcagaggtttcagtgagccaagattgcaccagtgcactgcagcctggcgacagagtgagactccgtctcaaaaaaatacctatctatctatctgtctatctactgttattcttacctggtcatttcctttttgtttcacaggaaatttgcgagaatccccgatttatcattgatggagccaacagaactgacatctgtcaaggagagctaggggactgctggtttctcgcagccattgcctgcctgaccctgaaccagcaccttcttttccgagtcataccccatgatcaaagtttcatcgaaaactacgcagggatcttccacttccagttctggcgctatggagagtgggtggacgtggttatagatgactgcctgccaacgtacaacaatcaactggttttcaccaagtccaaccaccgcaatgagttctggagtgctctgctggagaaggcttatgctaagctccatggttcctacgaagctctgaaaggtgggaacaccacagaggccatggaggacttcacaggaggggtggcagagttttttgagatcagggatgctcctagtgacatgtacaagatcatgaagaaagccatcgagagaggctccctcatgggctgctccattgatgatggcacgaacatgacctatggaacctctccttctggtctgaacatgggggagttgattgcacggatggtaaggaatatggataactcactgctccaggactcagacctcgaccccagaggctcagatgaaagaccgacccggacaatcattccggttcagtatgagacaagaatggcctgcgggctggtcagaggtcacgcctactctgtcacggggctggatgaggtcccgttcaaaggtgagaaagtgaagctggtgcggctgcggaatccgtggggccaggtggagtggaacggttcttggagtgatagatggaaggactggagctttgtggacaaagatgagaaggcccgtctgcagcaccaggtcactgaggatggagagttctggatgtcctatgaggatttcatctaccatttcacaaagttggagatctgcaacctcacggccgatgctctgcagtctgacaagcttcagacctggacagtgtctgtgaacgagggccgctgggtacggggttgctctgccggaggctgccgcaacttcccagatactttctggaccaaccctcagtaccgtctgaagctcctggaggaggacgatgaccctgatgactcggaggtgatttgcagcttcctggtggccctgatgcagaagaaccggcggaaggaccggaagctaggggccagtctcttcaccattggcttcgccatctacgaggtgttcccaaagaggtatagcagcagcagcggccagcagttgtgtgcagcactacccagggggccccgagtctgtctgtggctcgtcgagaagcttcctggtggggtttgtgggcaggactgtgataggagagggccttgcctgtgttatttccactgcagagcaggtgcctcagggcattgcatgacccatgactaccacccccaggatgtgcactttctccctcgcaccagacactgcacgtcacacacatgcctttgcacactcaccctcctccacgcttacagccacacacacagtcacacagacgcgttctgagggtggctgcccgcttgggatggaggaatcacttccctcagaacccagccaagtcctctaggcctccttgggggtccttccagcctgaggggcttcggagctgaggagcagctgttctgagatgcacgggaacaagcagcacctgcagaaggacttcttcctgtacaacgcctccaaggccaggagcaaaacctacatcaacatgcgggaggtgtcccagcgcttccgcctgcctcccagcgagtacgtcatcgtgccctccacctacgagccccaccaggagggggaattcatcctccgggtcttctctgaaaagaggaacctctctgaggaagttgaaaataccatctccgtggatcggccagtgcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctgggcctcatccaaagccatgcaggatcactccaggatttcagtttcaccctctatttccaaagccatttacctcaaaggacccagcagctacacccctacaggcttccaggcacctcatcagtcatgttcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggtc

SEQ ID NO: 75688 - DNA, 1875 bp, Homo sapiens
atttctcaggagaacttatggcttcagaatcacagctcggtttttaagatggacataacctgtacgaccttctgatgggctttcaactttgaactggatgtggacacttttctctcagatgacagaattactccaacttcccctttgcagttgcttcctttccttgaaggtagctgtatcttattttctttaaaaagctttttcttccaaagccacttgccatgccgaccgtcattagcgcatctgtggctccaaggacagcggctgagccccggtccccagggccagttcctcacccggcccagagcaaggccactgaggctgggggtggaaacccaagtggcatctattcagccatcatcagccgcaattttcctattatcggagtgaaagagaagacattcgagcaacttcacaagaaatgtctagaaaagaaagttctttatgtggaccctgagttcccaccggatgagacctctctcttttatagccagaagttccccatccagttcgtctggaagagacctccggaaatttgcgagaatccccgatttatcattgatggagccaacagaactgacatctgtcaaggagagctaggggactgctggtttctcgcagccattgcctgcctgaccctgaaccagcaccttcttttccgagtcataccccatgatcaaagtttcatcgaaaactacgcagggatcttccacttccagttctggcgctatggagagtgggtggacgtggttatagatgactgcctgccaacgtacaacaatcaactggttttcaccaagtccaaccaccgcaatgagttctggagtgctctgctggagaaggcttatgctaagctccatggttcctacgaagctctgaaaggtgggaacaccacagaggccatggaggacttcacaggaggggtggcagagttttttgagatcagggatgctcctagtgacatgtacaagatcatgaagaaagccatcgagagaggctccctcatgggctgctccattgatgatggcacgaacatgacctatggaacctctccttctggtctgaacatgggggagttgattgcacggatggtaaggaatatggataactcactgctccaggactcagacctcgaccccagaggctcagatgaaagaccgacccggacaatcattccggttcagtatgagacaagaatggcctgcgggctggtcagaggtcacgcctactctgtcacggggctggatgaggtcccgttcaaaggtgagaaagtgaagctggtgcggctgcggaatccgtggggccaggtggagtggaacggttcttggagtgatagatggaaggactggagctttgtggacaaagatgagaaggcccgtctgcagcaccaggtcactgaggatggagagttctggatgtcctatgaggatttcatctaccatttcacaaagttggagatctgcaacctcacggccgatgctctgcagtctgacaagcttcagacctggacagtgtctgtgaacgagggccgctgggtacggggttgctctgccggaggctgccgcaacttcccaggtgggagatgctcttgatggggggagggtctaagccgaaaaagttccaggcagaagaagcctaactagtgcttattaagtctctctgttccagacgtccactatcttattaaaccttccctgttttactgagaaggaaaccaccatgctgagaagtttgcaatagggagctggtagcaactttgaagcaggaaactgtgggaacaatgcagatgctgcttgacttacgatgaggttatgtccagataagcccatccatctttgaaaataccctaagtgaaaagtgcattcaatatgccta

SEQ ID NO: 75689 - DNA, 406 bp, Homo sapiens
tcccccgaagctcataacggcaggatgttcctgagaaaattgcctcttagaagatagagaggagatggccaagccctaagttaggcagactcaggaggaaaggtctgacccaccccctgccattccccagcacacttgtgattaatctccttggccagagccaggcagaacaccctcgcgtaagagatttgccccccagccccgtcccagccctcagcaagacagaagattccctttccagagaggctgcagagcatgagagctctttctgtgtgcttaaggtcccgttcaaaggtgagaaagtgaagctggtgcggctgcggaatccgtggggccaggtggagtggaacggttcttggagtgataggtaggtgaggggaccccacgggattggcggtggcgggga

SEQ ID NO: 75690 - DNA, 783 bp, Homo sapiens
atttctcaggagaacttatggcttcagaatcacagctcggtttttaagatggacataacctgtacgaccttctgatgggctttcaactttgaactggatgtggacacttttctctcagatgacagaattactccaacttcccctttgcagttgcttcctttccttgaaggtagctgtatcttattttctttaaaaagctttttcttccaaagccacttgccatgccgaccgtcattagcgcatctgtggctccaaggacagcggctgagccccggtccccagggccagttcctcacccggcccagagcaaggccactgaggctgggggtggaaacccaagtggcatctattcagccatcatcagccgcaattttcctattatcggagtgaaagagaagacattcgagcaacttcacaagaaatgtctagaaaagaaagttctttatgtggaccctgagttcccaccggatgagacctctctcttttatagccagaagttccccatccagttcgtctggaagagacctccggtgagtagcttcctgcttgctggctgggttttccccccacggaggagtcctctcactcagcactccggcagctcagctgtgcacatgggcactgggggaaggatcctggcagcagctctgctgggctctgtctttaagtgtgaagcagggaggagaggaacaggtctcagatatttcaccaaatctcagcaaaatccagagggagagcgcaggaggtggggctgattcttatgctctggctctttctctctga

SEQ ID NO: 75691 - DNA, 3642 bp, Homo sapiens
atttctcaggagaacttatggcttcagaatcacagctcggtttttaagatggacataacctgtacgaccttctgatgggctttcaactttgaactggatgtggacacttttctctcagatgacagaattactccaacttcccctttgcagttgcttcctttccttgaaggtagctgtatcttattttctttaaaaagctttttcttccaaagccacttgccatgccgaccgtcattagcgcatctgtggctccaaggacagcggctgagccccggtccccagggccagttcctcacccggcccagagcaaggccactgaggctgggggtggaaacccaagtggcatctattcagccatcatcagccgcaattttcctattatcggagtgaaagagaagacattcgagcaacttcacaagaaatgtctagaaaagaaagttctttatgtggaccctgagttcccaccggatgagacctctctcttttatagccagaagttccccatccagttcgtctggaagagacctccggaaatttgcgagaatccccgatttatcattgatggagccaacagaactgacatctgtcaaggagagctaggggactgctggtttctcgcagccattgcctgcctgaccctgaaccagcaccttcttttccgagtcataccccatgatcaaagtttcatcgaaaactacgcagggatcttccacttccagttctggcgctatggagagtgggtggacgtggttatagatgactgcctgccaacgtacaacaatcaactggttttcaccaagtccaaccaccgcaatgagttctggagtgctctgctggagaaggcttatgctaagctccatggttcctacgaagctctgaaaggtgggaacaccacagaggccatggaggacttcacaggaggggtggcagagttttttgagatcagggatgctcctagtgacatgtacaagatcatgaagaaagccatcgagagaggctccctcatgggctgctccattgatgatggcacgaacatgacctatggaacctctccttctggtctgaacatgggggagttgattgcacggatggtaaggaatatggataactcactgctccaggactcagacctcgaccccagaggctcagatgaaagaccgacccggacaatcattccggttcagtatgagacaagaatggcctgcgggctggtcagaggtcacgcctactctgtcacggggctggatgaggtcccgttcaaaggtgagaaagtgaagctggtgcggctgcggaatccgtggggccaggtggagtggaacggttcttggagtgatagatggaaggactggagctttgtggacaaagatgagaaggcccgtctgcagcaccaggtcactgaggatggagagttctggatgtcctatgaggatttcatctaccatttcacaaagttggagatctgcaacctcacggccgatgctctgcagtctgacaagcttcagacctggacagtgtctgtgaacgagggccgctgggtacggggttgctctgccggaggctgccgcaacttcccagatactttctggaccaaccctcagtaccgtctgaagctcctggaggaggacgatgaccctgatgactcggaggtgatttgcagcttcctggtggccctgatgcagaagaaccggcggaaggaccggaagctaggggccagtctcttcaccattggcttcgccatctacgaggtgttcccaaagaggtatagcagcagcagcggccagcagttgtgtgcagcactacccagggggccccgagtctgtctgtggctcgtcgagaagcttcctggtggggtttgtgggcaggactgtgataggagagggccttgcctgtgttatttccactgcagagcaggtgcctcagggcattgcatgacccatgactaccacccccaggatgtgcactttctccctcgcaccagacactgcacgtcacacacatgcctttgcacactcaccctcctccacgcttacagccacacacacagtcacacagacgcgttctgagggtggctgcccgcttgggatggaggaatcacttccctcagaacccagccaagtcctctaggcctccttgggggtccttccagcctgaggggcttcggagctgaggagcagctgttctgagatgcacgggaacaagcagcacctgcagaaggacttcttcctgtacaacgcctccaaggccaggagcaaaacctacatcaacatgcgggaggtgtcccagcgcttccgcctgcctcccagcgagtacgtcatcgtgccctccacctacgagccccaccaggagggggaattcatcctccgggtcttctctgaaaagaggaacctctctgaggaagttgaaaataccatctccgtggatcggccagtgcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctgggcctcatccaaagccatgcaggatcactccaggatttcagtttcaccctctatttccaaagccatttacctcaaaggacccagcagctacacccctacaggcttccaggcacctcatcagtcatgttcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggtc

SEQ ID NO: 75692 - DNA, 3528 bp, Homo sapiens
atttctcaggagaacttatggcttcagaatcacagctcggtttttaagatggacataacctgtacgaccttctgatgggctttcaactttgaactggatgtggacacttttctctcagatgacagaattactccaacttcccctttgcagttgcttcctttccttgaaggtagctgtatcttattttctttaaaaagctttttcttccaaagccacttgccatgccgaccgtcattagcgcatctgtggctccaaggacagcggctgagccccggtccccagggccagttcctcacccggcccagagcaaggccactgaggctgggggtggaaacccaagtggcatctattcagccatcatcagccgcaattttcctattatcggagtgaaagagaagacattcgagcaacttcacaagaaatgtctagaaaagaaagttctttatgtggaccctgagttcccaccggatgagacctctctcttttatagccagaagttccccatccagttcgtctggaagagacctccggaaatttgcgagaatccccgatttatcattgatggagccaacagaactgacatctgtcaaggagagctaggggactgctggtttctcgcagccattgcctgcctgaccctgaaccagcaccttcttttccgagtcataccccatgatcaaagtttcatcgaaaactacgcagggatcttccacttccagttctggcgctatggagagtgggtggacgtggttatagatgactgcctgccaacgtacaacaatcaactggttttcaccaagtccaaccaccgcaatgagttctggagtgctctgctggagaaggcttatgctaagctccatggttcctacgaagctctgaaaggtgggaacaccacagaggccatggaggacttcacaggaggggtggcagagttttttgagatcagggatgctcctagtgacatgtacaagatcatgaagaaagccatcgagagaggctccctcatgggctgctccattgatgatggcacgaacatgacctatggaacctctccttctggtctgaacatgggggagttgattgcacggatggtaaggaatatggataactcactgctccaggactcagacctcgaccccagaggctcagatgaaagaccgacccggacaatcattccggttcagtatgagacaagaatggcctgcgggctggtcagaggtcacgcctactctgtcacggggctggatgaggtcccgttcaaaggtgagaaagtgaagctggtgcggctgcggaatccgtggggccaggtggagtggaacggttcttggagtgatagatggaaggactggagctttgtggacaaagatgagaaggcccgtctgcagcaccaggtcactgaggatggagagttctggatgtcctatgaggatttcatctaccatttcacaaagttggagatctgcaacctcacggccgatgctctgcagtctgacaagcttcagacctggacagtgtctgtgaacgagggccgctgggtacggggttgctctgccggaggctgccgcaacttcccagatactttctggaccaaccctcagtaccgtctgaagctcctggaggaggacgatgaccctgatgactcggaggtgatttgcagcttcctggtggccctgatgcagaagaaccggcggaaggaccggaagctaggggccagtctcttcaccattggcttcgccatctacgaggtgttcccaaagaggtatagcagcagcagcggccagcagttgtgtgcagcactacccagggggccccgagtctgtctgtggctcgtcgagaagcttcctggtggggtttgtgggcaggactgtgataggagagggccttgcctgtgttatttccactgcagagcaggtgcctcagggcattgcatgacccatgactaccacccccaggatgtgcactttctccctcgcaccagacactgcacgtcacacacatgcctttgcacactcaccctcctccacgcttacagccacacacacagtcacacagacgcgttctgagggtggctgcccgcttgggatggaggaatcacttccctcagaacccagccaagtcctctaggcctccttgggggtccttccagcctgaggggcttcggagctgaggagcagctgttctgagatgcacgggaacaagcagcacctgcagaaggacttcttcctgtacaacgcctccaaggccaggagcaaaacctacatcaacatgcgggaggtgtcccagcgcttccgcctgcctcccagcgagtacgtcatcgtgccctccacctacgagccccaccaggagggggaattcatcctccgggtcttctctgaaaagaggaacctctctgaggaagttgaaaataccatctccgtggatcggccagtgccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctgggcctcatccaaagccatgcaggatcactccaggatttcagtttcaccctctatttccaaagccatttacctcaaaggacccagcagctacacccctacaggcttccaggcacctcatcagtcatgttcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggtc

SEQ ID NO: 75693 - DNA, 3122 bp, Homo sapiens
gccttgtgtagcgggagggggagctaggaagcagctgagggcagaatccaggagggcctggctgcgggggaatgaagcctccgccttcgcaggcaaaagcctttaaatacgggctcaggcccgggactcagagtgtaacgcgtggcagcctgagggaggggcgtgcgccgagagggagctcagatcgagcggggcgcgggtggagaagctgcggcggcgcggcccgtaggaaggtgctgtccgaacgatcgggataggagcggtccctgcgcttgctgctgggaagtggtacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatgagccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaatttacaggtgctgtccaaccctgagtttctggcagagggaacagccatcaaggacctaaagaacccagacagagtactgattggaggggatgaaactccagagggccagagagctgtgcaggccctgtgtgctgtatatgagcactgggttcccagagaaaagatcctcaccactaatacttggtcttcagagctttccaaactggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttgggtttggtgggagctgtttccaaaaggatgttctgaatttggtttatctctgtgaggctctgaatttgccagaagtagctcgttattggcagcaggtcatagacatgaatgactaccagaggaggaggtttgcttcccggatcatagatagtctgtttaatacagtaactgataagaagatagctattttgggatttgcattcaaaaaggacactggtgatacaagagaatcttctagtatatatattagcaaatatttgatggatgaaggtgcacatctacatatatatgatccaaaagtacctagggaacaaatagttgtggatctttctcatccaggtgtttcagaggatgaccaagtgtcccggctcgtgaccatttccaaggatccatatgaagcatgtgatggtgcccatgctgttgttatttgcactgagtgggacatgtttaaggaattggattatgaacgcattcataaaaaaatgctaaagccagcctttatcttcgatggacggcgtgtcctggatgggctccacaatgaactacaaaccattggcttccagattgaaacaattggcaaaaaggtgtcttcaaagagaattccatatgctccttctggtgaaattccgaagtttagtcttcaagatccacctaacaagaaacctaaagtgtagagattgccatttttatttgtgattttttttttttttttggtacttcaggatagcaaatatctatctgctattaaatggtaaatgaaccaagtgtttttttttgttttttttttgagacagagtctcactgttgcccaggctggagtgcagtggtgcaatctcggctcactgcaagctctgcttcccaggttcacgccattctcctggctcagcctcccaagtagctgggactacaggcacccgccacagtgcctggctaattttttgtatttttagtagagacagggtttcaccatgtgagccaggatggtctcaatctcctgaccttgtgaaccacccgtctcggcctcccaaagtgctgggattacaggtgtgagccaccacgcctggcccatgaaccaagtgtttttaaggaaacaaaactatttttttaatcatcagatttatactagctatatggatattagcatatctggtaattatgaatctagaatttttttacatatttttataatactgttagctcagttattggatgagtgaaagataatcatgttggttttaatagtgtcaatttttgtaaaataaaaattaaacttcaaactctttactttataaattgtccataggccacactttaatatcacattataaagggaaggacagtcttcattcctcctggttattggtttgtttgtcattaaagatatattttgaatccatgaaattgctatgctaaacagcctttacatgtatggtctggttaaagttcctttgttccttttgttttaataaaatgtgtcactgattttttagctcaaaatcatcactgttaatttccagtcaccccaaatatggttaaaagattttttttttaatcatgaagagaaaattagtagcatttctttctctccccattatttattggttttcctcactaatcttttttttttagtccaaaagccaaaaatatttatcttggttttacattttaatttccattcttaattgtaatttttttctttaaataaggaaaccaatataatctcatgtataaaaacttaaatattttacaagttacatatagcatcattctaaaataagaattttttttgttttctgtctgcttttttcttatgtctcttgttgagttttatattttcagtggttatttttgcttgtgttagatcattattgcattaaacatcccaggtctcatccttcaggaattttgcagttcaatgagaagagggagacaaatataaagatgaggacagaagcatctctacagatgaaaattacataaataaaacattctccatcaacaaataaaaggtgtaa

SEQ ID NO: 75694 - DNA, 2014 bp, Homo sapiens
gaggatcccgcgtgatccggtacagctcgtatggggagaggtcatagacatgaatgactaccagaggaggaggtttgcttcccggatcatagatagtctgtttaatacagtaactgataagaagatagctattttgggatttgcattcaaaaaggacactggtgatacaagagaatcttctagtatatatattagcaaatatttgatggatgaaggtgcacatctacatatatatgatccaaaagtacctagggaacaaatagttgtggatctttctcatccaggtgtttcagaggatgaccaagtgtcccggctcgtgaccatttccaaggatccatatgaagcatgtgatggtgcccatgctgttgttatttgcactgagtgggacatgtttaaggaattggattatgaacgcattcataaaaaaatgctaaagccagcctttatcttcgatggacggcgtgtcctggatgggctccacaatgaactacaaaccattggcttccagattgaaacaattggcaaaaaggtgtcttcaaagagaattccatatgctccttctggtgaaattccgaagtttagtcttcaagatccacctaacaagaaacctaaagtgtagagattgccatttttatttgtgattttttttttttttttggtacttcaggatagcaaatatctatctgctattaaatggtaaatgaaccaagtgtttttttttgttttttttttgagacagagtctcactgttgcccaggctggagtgcagtggtgcaatctcggctcactgcaagctctgcttcccaggttcacgccattctcctggctcagcctcccaagtagctgggactacaggcacccgccacagtgcctggctaattttttgtatttttagtagagacagggtttcaccatgtgagccaggatggtctcaatctcctgaccttgtgaaccacccgtctcggcctcccaaagtgctgggattacaggtgtgagccaccacgcctggcccatgaaccaagtgtttttaaggaaacaaaactatttttttaatcatcagatttatactagctatatggatattagcatatctggtaattatgaatctagaatttttttacatatttttataatactgttagctcagttattggatgagtgaaagataatcatgttggttttaatagtgtcaatttttgtaaaataaaaattaaacttcaaactctttactttataaattgtccataggccacactttaatatcacattataaagggaaggacagtcttcattcctcctggttattggtttgtttgtcattaaagatatattttgaatccatgaaattgctatgctaaacagcctttacatgtatggtctggttaaagttcctttgttccttttgttttaataaaatgtgtcactgattttttagctcaaaatcatcactgttaatttccagtcaccccaaatatggttaaaagattttttttttaatcatgaagagaaaattagtagcatttctttctctccccattatttattggttttcctcactaatcttttttttttagtccaaaagccaaaaatatttatcttggttttacattttaatttccattcttaattgtaatttttttctttaaataaggaaaccaatataatctcatgtataaaaacttaaatattttacaagttacatatagcatcattctaaaataagaattttttttgttttctgtctgcttttttcttatgtctcttgttgagttttatattttcagtggttatttttgcttgtgttagatcattattaaaatatatccaatgtccctttgatacttgtgctctgctgagaatgtacagtttgcattaaacatcccaggtctcatccttcaggaattttgcagttcaatgagaagagggagacaaatataaagatgaggacagaagcatctctacagatgaaaattacataaataaaacattctccatcaacaaataaaaggtgtaa

SEQ ID NO: 75695 - DNA, 514 bp, Homo sapiens
ctaaggaaggttttactttgattctttactttctaaatattaggtcattataatctttgtggctccccttcagtaatatcagttactgtaattatttccatatgtttcatgctagtgcagctgagaacaggctaggtcatccaattggaatgttattttttaaatcactatttccataattcctcagagcgaatgtaggaaatctttccagatatctgtcaccttgacagtttttataaagtataattaatgtacaatattatttctttaaattttctgttttcaatactagaacagtcttactgttttccttctagtacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatgaggtaaacatattaaacatctctttgtttt

SEQ ID NO: 75696 - DNA, 386 bp, Homo sapiens
gtggcacataattgactactttgagggagtcaggtgtggggaatggcaggagtgagaaagtctagatatgaatattacgatggagtacagattaattctaggaacaaaaaatagggaagaaaccaaagatctctcatagcaactcagacaacttgagaatccttttctaagaaaaaaatctagattccccctgctcccatttcagtacattataaattcttacacttatataattgttaatagttctcttaaattttatttttttttcagattgaaacaattggcaaaaaggtgtcttcaaagagaattccatatgctccttctggtgaaattccgaagtttagtcttcaagatccacctaacaagaaacctaaagtgtagagatt

SEQ ID NO: 75697 - DNA, 3176 bp, Homo sapiens
gccttgtgtagcgggagggggagctaggaagcagctgagggcagaatccaggagggcctggctgcgggggaatgaagcctccgccttcgcaggcaaaagcctttaaatacgggctcaggcccgggactcagagtgtaacgcgtggcagcctgagggaggggcgtgcgccgagagggagctcagatcgagcggggcgcgggtggagaagctgcggcggcgcggcccgtaggaaggtgctgtccgaacgatcgggataggagcggtccctgcgcttgctgctgggaagtggtacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatgagccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaatttacaggtgctgtccaaccctgagtttctggcagagggaacagccatcaaggacctaaagaacccagacagagtactgattggaggggatgaaactccagagggccagagagctgtgcaggccctgtgtgctgtatatgagcactgggttcccagagaaaagatcctcaccactaatacttggtcttcagagctttccaaactggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttgggtttggtgggagctgtttccaaaaggatgttctgaatttggtttatctctgtgaggctctgaatttgccagaagtagctcgttattggcagcaggtcatagacatgaatgactaccagaggaggaggtttgcttcccggatcatagatagtctgtttaatacagtaactgataagaagatagctattttgggatttgcattcaaaaaggacactggtgatacaagagaatcttctagtatatatattagcaaatatttgatggatgaaggtgcacatctacatatatatgatccaaaagtacctagggaacaaatagttgtggatctttctcatccaggtgtttcagaggatgaccaagtgtcccggctcgtgaccatttccaaggatccatatgaagcatgtgatggtgcccatgctgttgttatttgcactgagtgggacatgtttaaggaattggattatgaacgcattcataaaaaaatgctaaagccagcctttatcttcgatggacggcgtgtcctggatgggctccacaatgaactacaaaccattggcttccagattgaaacaattggcaaaaaggtgtcttcaaagagaattccatatgctccttctggtgaaattccgaagtttagtcttcaagatccacctaacaagaaacctaaagtgtagagattgccatttttatttgtgattttttttttttttttggtacttcaggatagcaaatatctatctgctattaaatggtaaatgaaccaagtgtttttttttgttttttttttgagacagagtctcactgttgcccaggctggagtgcagtggtgcaatctcggctcactgcaagctctgcttcccaggttcacgccattctcctggctcagcctcccaagtagctgggactacaggcacccgccacagtgcctggctaattttttgtatttttagtagagacagggtttcaccatgtgagccaggatggtctcaatctcctgaccttgtgaaccacccgtctcggcctcccaaagtgctgggattacaggtgtgagccaccacgcctggcccatgaaccaagtgtttttaaggaaacaaaactatttttttaatcatcagatttatactagctatatggatattagcatatctggtaattatgaatctagaatttttttacatatttttataatactgttagctcagttattggatgagtgaaagataatcatgttggttttaatagtgtcaatttttgtaaaataaaaattaaacttcaaactctttactttataaattgtccataggccacactttaatatcacattataaagggaaggacagtcttcattcctcctggttattggtttgtttgtcattaaagatatattttgaatccatgaaattgctatgctaaacagcctttacatgtatggtctggttaaagttcctttgttccttttgttttaataaaatgtgtcactgattttttagctcaaaatcatcactgttaatttccagtcaccccaaatatggttaaaagattttttttttaatcatgaagagaaaattagtagcatttctttctctccccattatttattggttttcctcactaatcttttttttttagtccaaaagccaaaaatatttatcttggttttacattttaatttccattcttaattgtaatttttttctttaaataaggaaaccaatataatctcatgtataaaaacttaaatattttacaagttacatatagcatcattctaaaataagaattttttttgttttctgtctgcttttttcttatgtctcttgttgagttttatattttcagtggttatttttgcttgtgttagatcattattaaaatatatccaatgtccctttgatacttgtgctctgctgagaatgtacagtttgcattaaacatcccaggtctcatccttcaggaattttgcagttcaatgagaagagggagacaaatataaagatgaggacagaagcatctctacagatgaaaattacataaataaaacattctccatcaacaaataaaaggtgtaa

SEQ ID NO: 75698 - DNA, 3072 bp, Homo sapiens
gccttgtgtagcgggagggggagctaggaagcagctgagggcagaatccaggagggcctggctgcgggggaatgaagcctccgccttcgcaggcaaaagcctttaaatacgggctcaggcccgggactcagagtgtaacgcgtggcagcctgagggaggggcgtgcgccgagagggagctcagatcgagcggggcgcgggtggagaagctgcggcggcgcggcccgtaggaaggtgctgtccgaacgatcgggataggagcggtccctgcgcttgctgctgggaagtggtacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatgagccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaatttacaggtgctgtccaaccctgagtttctggcagagggaacagccatcaaggacctaaagaacccagacagagtactgattggaggggatgaaactccagagggccagagagctgtgcaggccctgtgtgctgtatatgagcactgggttcccagagaaaagatcctcaccactaatacttggtcttcagagctttccaaactggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttgggtttggtgggagctgtttccaaaaggatgttctgaatttggtttatctctgtgaggctctgaatttgccagaagtagctcgttattggcagcaggtcatagacatgaatgactaccagaggaggaggtttgcttcccggatcatagatagtctgtttaatacagtaactgataagaagatagctattttgggatttgcattcaaaaaggacactggtgatacaagagaatcttctagtatatatattagcaaatatttgatggatgaaggtgcacatctacatatatatgatccaaaagtacctagggaacaaatagttgtggatctttctcatccaggtgtttcagaggatgaccaagtgtcccggctcgtgaccatttccaaggatccatatgaagcatgtgatggtgcccatgctgttgttatttgcactgagtgggacatgtttaaggaattggattatgaacgcattcataaaaaaatgctaaagccagcctttatcttcgatggacggcgtgtcctggatgggctccacaatgaactacaaaccattggcttccagattgaaacaattggcaaaaaggtgtcttcaaagagaattccatatgctccttctggtgaaattccgaagtttagtcttcaagatccacctaacaagaaacctaaagtgtagagattgccatttttatttgtgattttttttttttttttggtacttcaggatagcaaatatctatctgctattaaatggtaaatgaaccaagtgtttttttttgttttttttttgagacagagtctcactgttgcccaggctggagtgcagtggtgcaatctcggctcactgcaagctctgcttcccaggttcacgccattctcctggctcagcctcccaagtagctgggactacaggcacccgccacagtgcctggctaattttttgtatttttagtagagacagggtttcaccatgtgagccaggatggtctcaatctcctgaccttgtgaaccacccgtctcggcctcccaaagtgctgggattacaggtgtgagccaccacgcctggcccatgaaccaagtgtttttaaggaaacaaaactatttttttaatcatcagatttatactagctatatggatattagcatatctggtaattatgaatctagaatttttttacatatttttataatactgttagctcagttattggatgagtgaaagataatcatgttggttttaatagtgtcaatttttgtaaaataaaaattaaacttcaaactctttactttataaattgtccataggccacactttaatatcacattataaagggaaggacagtcttcattcctcctggttattggtttgtttgtcattaaagatatattttgaatccatgaaattgctatgctaaacagcctttacatgtatggtctggttaaagttcctttgttccttttgttttaataaaatgtgtcacctgaagaaaaaaaaaaaaaaaaaaaaaaaaaaaaaaacaacaaaaaaaacaacaacaaagcaacaaaacaagaaacaacaacaacaaaaaacaaagaacaaagaacaaacacacaaaaagacaacaacacacagaggcgagccgcgcacacccaccattaacgaaacacgggggggcgggccccctcattataaaggcgggcgggacgcatcatatgatcgccgacaaatcacatagataggaggagagagcgctcccaaccaaggctgatgatcgtcgataaagcagcagcgaccctgcttcataaatcaacaacaagaacaaccaacatagctgaatctaaggatacgaaaaaacaccaaatgatgggggggaggcctgaggaaaaaccacccagagtacgatgcgacaggaacaacaatcgtggggagaggaacaacaaccggaaaaatgagagcattaaaaaaccaggaaaaaaaaagcaga

SEQ ID NO: 75699 - DNA, 906 bp, Homo sapiens
acaccctgaagactgctaatttttgcatgcatatgattttcacatgaatggatgaaaatactaaaatctcttccccctggaattgtctaattgccccgaccctactctaacagcaactagtgggtgggggcggtggagactcctgccattctctgtggcaccccacttccctggaagctcagtcggcctccgtctgctcacgtattggcacggttgtcttccaaacccatcgatgccggaacatgggtcaggaagaacacagtcagctctctggtgctttccatagcgttcctttttgccaggcttctgagatttttaaataacggaagcaacatctgcctctgaattagctgacaatgggaaacacacattgcagagattatcttaatgtatagcaaatcaaggaaaacaaaactttgacttaaccattggtttcagcttcctatcccaccaagccaccaacttcgtttcacttctctttcttctctctctggccccatgtgctcccttggtggagacatgaaggagcaggcaagtggcctgcagggggaccccgggatgctttgcccacttgacaggtagaggagctaaggccctcagcatggaacaggttcccaggctcacagaggaaggtggtggcaacacggagacttctcggtcacctggaacacaccccgctgtggacaccccctctgggactttttttctgcctctccccttaggattttgcaattcttttcaaaccagtgtcacaaaactttaaaaaaaaaaaaaaaaacaaaaaggatttcacaactcttagctgtcagagtttccttctacttcttctactttctctttttcttcgctcagtagacatgtatgaggcagaaggccagggctgggcgctgtgggagattcagagag

SEQ ID NO: 75700 - DNA, 547 bp, Homo sapiens
agcaattgataactgatacagaagccaccgaaaggagcaagctaagtcctagggaaaaatgttgccaggcgttcggtcttctcagagtgatagctgcttattagaaagaaaccaactttgactgtcaccttctctgccacttgcactccgttaaacccagagactggcagatgcctttcagcacagccgcactctgcctcccctcccttcctcccagactcctgtctgagacagaacagtatctttgagaacccgagggcaaaatcctctgcaggagtaggaggcggctcttaaacagccccaggcgatgtggaaggtgggcggaggctgagctattgcactgctccccaaatcccagtgcctggctgcacccccacacctgaaacctgcctaccctggtttaagcctcccccagccttcctggtgaagacccctcatggattcttgttactctcaggattgtgcaataaacccttctccttcacgcagagtagacgtgacgggaaagtctatttctggcctgactgtattgcatcttgtttgacac

SEQ ID NO: 75701 - DNA, 417 bp, Homo sapiens
tttctgggctttagctagggttacttttctcactgcagaatcccctgtggccatggccctgtagggccctcaaagatcctgcaccctggattcagaatccagtgaattcatctgggtagggtccccaggacacattggtagggaatatccccagagaggacctaagagttccaaagtggtaggagtactctaagcctggtagttcgtagagctgggcccaagtccggttttggccactgaatggcaatggaacaattgatgagtaccattgttctctctgtgcctcaatttctatatctgtaacatgaggggatttgaccatatggtctttttacatctctttcaactctgctatttgattccccttcagtgtgccacacatctcacaacctcactttccatcccaagattgagctt

SEQ ID NO: 75702 - DNA, 826 bp, Homo sapiens
ctcaccccactttagtccttagtccttaactgctggcaaccactaatctcttgtccatgtttataatattgtcatttcaagaatattataaaaacggaaccattagcatgtagctttttaggattggcctttttttttcactcagcacaagtgtctgaagactcattcaggttgttgtgcatatcaatagtgtatccctttttattgctgagcagtattctatggtatgaatgtatgatggttcggacatatgggttgtttcctattttaggctgttatgaatgaagctgctctgaacattcatgtatagatttttgtgtatacaggtattttttagaaaatagagataagccaggcatggtgatgtgtacctatagtcccagctactctggaggctgaggcaggagaatctcttgagcccaggggttcaagatgagcctgggcaacattttggagatcctgtctacaaaaaaaaaaagatggaggtagttttttgtaatggcaagattgtacattagaagatagaaaagtaggttttgcatcttactagggaagatacatgtatatttctctccctttggactgatcatttaagttgtttcaatttccttatcaagaaactggcataatatatgttctgcctacatcccagggtggttgtatagataaactgagataatatatggcctcctcccaagtaactgggattataggtgcgtgccaccacgctgggccaatttttgtattttcagtagagacggggtttcactgtgttggccaggctggtcttgaactcctgacctcaagtgatcttcccaccttggcc

SEQ ID NO: 75703 - DNA, 803 bp, Homo sapiens
agcggtgatacggtgttcatgacattctaagtacaaagaacatttatataaagtactctgagagcaaatgttattagagtactttaaatacatttaaagcatgggttgcatatgttattatgcagctctgcttactaaaatagaatgtgattttatatatataaccaattgtggcagacactgttgccagctcacccgtttcccatgccccatcctcattcccttttcttcctgactaaagaggctagaagagctaaatgcatgttttcccaggcttcattgcagtagaggtggcactgtgacactgttctgcagataagatgtaaacagaagtcagctgggatggtttctgagggtgctatgcttttcctatcagagaggtttgttctagttactattgctgcatgaaaaactatccaaaacacgcatttactgtggcacaaaaggtcaattttattatacccttggatcctgtaggtaagaaattcaggcttggcctggtggctcacacctgtaatcccagcactttgggaggccaaggagggcggaccacttgaggttaggagttcgagaccagcctggccaacatagcaaaaccccctctctactaaaaatacaaaaaaattagccaggcatggtggtttgtgcctgtaatcccagctactcaggaagctgaggcaggagaatgacttgaacccaggaggcaaaggttgcagtgagccaagatagcatcactgcactccagcctgggtgacagagagagattccgtcttaaaaaaaaaaaaaaattcagacagggcaca

SEQ ID NO: 75704 - DNA, 391 bp, Homo sapiens
agccctccagtgtcctgcagagaggcactcttgccaagtgtcattgatgacgcagctgaaaaccagaaacatttcactttccagccacgagactgcagcaatctgctctttggactgcacttagggaaaccgaggcccagataactgacccctcaaaagcccccaggacggcaaaatcaaaggggctgaggtgctctgaacagccccagcaaattaaaccacctaactttgcgctactcccactgccctgaagcagcctgtggtgggaggtgggggtggatacagtgttacaaagagaaacctgagttgtagccatagattgctaatcagtaacaaaatatccctctaaacccagtcctgccttgaacccacaggctcaggatggtaaata

SEQ ID NO: 75705 - DNA, 330 bp, Homo sapiens
ggaccaggagcctgctgtctggctctggctgccctgtttgtcgggtttcctcacggtatggcagctgccttcctaagaagatgcccctcctccatggagagtctcacgtgggcaggaaccaaggcctgagattcccagccaaattccacttggcagccgtgtgaacgaacactccagtcgagccacaggggcaaaccgtctccaccgagctctgcccaagttacagattcatgagctagactgtggtgattttaagccactaagttttgggtggttgtttgcagcaacagccaccaggctccggctttcaccttctgttactgcagggtg

SEQ ID NO: 75706 - DNA, 901 bp, Homo sapiens
ttcaattctttgtttagaatgtttacattcttactcagtagctgaggaagatctgactcttagagaacaggatattttggtcttgcaactgatttccagggtggaagttaagatggtcccagtataactgagttattgattattaatggtaggaagatataggagatggcgcaattattaagggaaagcattatatttattttttggtagaggtggggtctcactatttgcccaggctggtcttgagttcccgagctcaagccttcttcccatcttggcctctcaaagtgctgggattactagcattgcattttagaatggcatatcagaaataggaattctagtagtgtgtatctgtgggaaacgggggagtattctaagagtaggaaatcggatgccaggaaaacacctcaggatacagccccggaggaaggtatccagctgttcttcgggtgaaaaagatgaagaaacagtcctttgggaacaggctgatggatatagcaacttgaagtcatggaaacagcgctccattgatccttctctcagccctgcctcagtttagtatgtgtttttctttggttgtctgagccagttttttaatatctcactatttctcatttctgtaacttcctcttaatcagcttgttcacaggaggagggcagtggtggtgtgggggttgagggcagggaagtggagggttaggattagagagatcagagtaggatcaacagtggtaggagcaggaccacactccagtggagcagtgcagggccagccaggctgctgatgtcatgaattggatggaatgtaaagctggtgttcctacaaagcactctggttaagatggcagtttatgtggacagagactggaaagcgccccttccatctactctccctccc

SEQ ID NO: 75707 - DNA, 781 bp, Homo sapiens
tcaggctggtctcgaactcctgacctcaggtggtcctcccgcctcggcctcacaaagtgctgggataacaggcgtgagccaccgggcccggccctgcaaacaaatatttgaaaattgcagtttggattgcgttttccccacatattggtaaattttgcttgaggaaacgaaagacttaggattcaggaaaaatttatttcatgacattctggtgcatcagtattgcaatttggaatgtctgatcctggttaaatctcaaatcggctccagcaaagcatgttttgtttcagaatagtttgcttttttacctgtggattttaatatgctttttgtgggtttgcttatgcctgccgagttaccaggcttcaaatcgtaataggatgaagctaaaactagtaattggtgtaacataaaatgccttgtaagagacagtgaatgtggtgtttggagttgttgggaatgatcactagtttaaaccgaaattattccttccttcaaattttactttagtttttaaggaacctgtctaatgtgttttcccggctactcaggcagaaatgaaagacaaatgtaatagacacatgtaaatttaattgaaaatcttattctcggcttcagagaagttgaaagttttaccaaacgtcttcagtccggtgtctggcacatagtagtgccaaatatttgtacaataaataaaagaccaatcacaccttattgtttaaacatcttgttttgcggaaagcttctttaatttcttaataaacaaatttacttttgaaat

SEQ ID NO: 75708 - DNA, 555 bp, Homo sapiens
catgatatggagactgagctgaaaggatttcctcctctatgttcatcatagcttttaatttaattttactcaccttactttggctcgagaccctcagtcacctctgttcaggaggcagagcagttctttaccatcaattgtgataggcacggggaaccaggctgagagaatgaagtgcctcctacagctactttgaaaagtaagtatcttagaacttgattatttaaaataatagtaattttaaatactttgatgttgattttaatatccctttcttacaatatatgttccaatattttattatctaaatattcatattatataaattatacttataattactgtataaataattaatgttcattaacagcaaactttttattatggcaaaatctaataacgactcttgccaacacattaagttgtagtcattctatttttaagtagctattaaattctttaaaaaagattttttaataaaggagagctctaaaagtttatattaacttaattttaaccaatacaaaagataactttgtaaaaaaagaaaaagtc

SEQ ID NO: 75709 - DNA, 1650 bp, Homo sapiens
gagcctgaaaacctccgcgccaccgctgcgctctttacaaaggccccgggcgcgagaggacgtgctctgccagccagtgggaaggcaggccgcgcgcgcgggagcgcgggaggatcggcggctcgcggtcactggtccctggctcggttccccgcaccccggggctcacacttacccgcgcggaggagcagcggccgggtgtccacccccatcctgcgcccagtctcctcgattcccctcgctctgagccgggagagccgaacagctgaagagagttcactgactccccagccccaggtgggccttgtgcacatcatgaccagttttgaagatgctgacacagaagagacagtaacttgtctccagatgacggtttaccatcctggccagttgcagtgtggaatatttcagtcaataagttttaacagagagaaactcccttccagcgaagtggtgaaatttggccgaaattccaacatctgtcattatacttttcaggacaaacaggtttcccgagttcagttttctctgcagctgtttaaaaaattcaacagctcagttctctcctttgaaataaaaaatatgagtaaaaagaccaatctgatcgtggacagcagagagctgggctacctaaataaaatggacctgccatacaggtgcatggtcagattcggagagtatcagtttctgatggagaaggaagatggcgagtcattggaattttttgagactcaatttattttatctccaagatcactcttgcaagaaaacaactggccaccacacaggcccataccggagtatggcacttactcgctctgctcctcccaaagcagttctccgacagaaatggatgaaaatgagtcatgaacacagaaagtctaagaggagaaatatgatggatgaagagctctgtagatgctgtatagacactaaataagagttgattagggtagtatattatagtcatctgttatgctgtgaaatttggaattcagtattatcattttgaagtctgtaaattgtgttagtcattaacttagtcacctgttgtattctggatctacacaaaattattttaactgctcttattaatctgtgaggattaatatacaaaaagtatcctttgagatgaagtcgtgttctcaaaataaggttatattattttctttttctgcttgattttcatcttgtgttttgctttgtttttgtaaggaaccatctcttggtttggtcacatcagttcacaacagccatttgttttcaaggtcaaggctccaggcaggttgttactggtgtttgcagcctgtcagtacttgcagtactggaataggttctaggctagtgtctgcgcgtcactgtggttttagcatgggaggacttatttgagaaatactaccttacttttctatgatttctttttacagagttatagtgtgtttactcctaagatgacagttctctttgtctatattcagcatctaagacaaatatttaaacattttaaagaaccactgtgttaagtttaggattatttacttaccaaattagaagtttgacttttatgtgttatacacaatcttaaaatttcacgaattcacctttttaatagtatccatgtacataataaaatcaaagtttaattagcca

SEQ ID NO: 75710 - DNA, 2713 bp, Homo sapiens
gagcctgaaaacctccgcgccaccgctgcgctctttacaaaggccccgggcgcgagaggacgtgctctgccagccagtgggaaggcaggccgcgcgcgcgggagcgcgggaggatcggcggctcgcggtcactggtccctggctcggttccccgcaccccggggctcacacttacccgcgcggaggagcagcggccgggtgtccacccccatcctgcgcccagtctcctcgattcccctcgctctgagccgggagagccgaacagctgaagagagttcactgactccccagccccaggtgggccttgtgcacatcatgaccagttttgaagatgctgacacagaagagacagtaacttgtctccagatgacggtttaccatcctggccagttgcagtgtggaatatttcagtcaataagttttaacagagagaaactcccttccagcgaagtggtgaaatttggccgaaattccaacatctgtcattatacttttcaggacaaacaggtttcccgagttcagttttctctgcagctgtttaaaaaattcaacagctcagttctctcctttgaaataaaaaatatgagtaaaaagaccaatctgatcgtggacagcagagagctgggctacctaaataaaatggacctgccatacaggtgcatggtcagattcggagagtatcagtttctgatggagaaggaagatggcgagtcattggaattttttgagactcaatttattttatctccaagatcactcttgcaagaaaacaactggccaccacacaggcccataccggagtatggcacttactcgctctgctcctcccaaagcagttctccgacagaaatggatgaaaatgagtcatgaacacagaaagtctaagaggagaaatatgatggatgaagagctctgtagatgctgtatagacactaaataagagttgattagggtagtatattatagtcatctgttatgctgtgaaatttggaattcagtattatcattttgaagtctgtaaattgtgttagtcattaacttagtcacctgttgtattctggatctacacaaaattattttaactgctcttattaatctgtgaggattaatatacaaaaagtatcctttgagatgaagtcgtgttctcaaaataaggttatattattttctttttctgcttgattttcatcttgtgttttgctttgtttttgtaaggaaccatctcttggtttggtcacatcagttcacaacagccatttgttttcaaggtcaaggctccaggcaggttgttactggtgtttgcagcctgtcagtacttgcagtactggaataggttctaggctagtgtctgcgcgtcactgtggttttagcatgggaggacttatttgagaaatactaccttacttttctatgatttctttttacagagttatagtgtgtttactcctaagatgacagttctctttgtctatattcagcatctaagacaaatatttaaacattttaaagaaccactgtgttaagtttaggattatttacttaccaaattagaagtttgacttttatgtgttatacacaatcttaaaatttcacgaattcacctttttaatagtatccatgtacataataaaatcaaagtttaattagccattttctttgaatttttttctaaataagggaaataactgttcttgggccactttacagagataaatgtatgtgaatgtttatgataaacgcttaaatatttctaaaatgttaacttcaaaaaagtctttttcagttcttaaataaaaatttttttatttaagatacttattcgacttatcttaactaaggtagctatgaatgttaagtagatgaggtaaccattcagttaagttaaattgtagcattgccaggtagtgaggctcactgtacaattttccaggtaaatgaaatttcctgtagtaagaggtccgtatttttgtaacagccttttaaaaatgcttttgggaaccctccagcctcttaccaaaagaggctttaaacctcatcttgattcagactgtcagtctattcctgggcagtagtatgtgatgtccagcaccctaaccccgactccccagccctgggactattccagtagagtgaaatatttgtccctgtacaaagtggcctgaatgactgttggagttcctgtgtctggttttcctgtttattccctgtgatgcccagagtaatggcccatccaaagatgtccagatgtccatgtgctagtctccagaacttgtaactgtgttgttatgtggcaaaggggaatgaaggctgcagatggaagtaaaatagattatgctggattatctgggtgtgcccaattgatcaccggatccgtaaaagtggaagagaggcagatcaggatgtcagcgtgatgaggtgtgagacagacttgacttgctgttgctgggaggaaggggaggtcatgagccaaggaatgtggacagtctcttgaagctggaaagtgtgcattggacatctggaagccagaaaagacaaagaaatatccagaaaggaacaaagtcttgtggacaccttgattttggtccagtgagaatatgtttgacttgttaacctacaaaactttatgatgataaatttgtgttggtcgtaagccactaaatcacagtaatttgttatagcagcagatagaaaactaatatactccctttaatat

SEQ ID NO: 75711 - DNA, 4201 bp, Homo sapiens
gagcctgaaaacctccgcgccaccgctgcgctctttacaaaggccccgggcgcgagaggacgtgctctgccagccagtgggaaggcaggccgcgcgcgcgggagcgcgggaggatcggcggctcgcggtcactggtccctggctcggttccccgcaccccggggctcacacttacccgcgcggaggagcagcggccgggtgtccacccccatcctgcgcccagtctcctcgattcccctcgctctgagccgggagagccgaacagctgaagagagttcactgactccccagccccaggtgggccttgtgcacatcatgaccagttttgaagatgctgacacagaagagacagtaacttgtctccagatgacggtttaccatcctggccagttgcagtgtggaatatttcagtcaataagttttaacagagagaaactcccttccagcgaagtggtgaaatttggccgaaattccaacatctgtcattatacttttcaggacaaacaggtttcccgagttcagttttctctgcagctgtttaaaaaattcaacagctcagttctctcctttgaaataaaaaatatgagtaaaaagaccaatctgatcgtggacagcagagagctgggctacctaaataaaatggacctgccatacaggtgcatggtcagattcggagagtatcagtttctgatggagaaggaagatggcgagtcattggaattttttgagactcaatttattttatctccaagatcactcttgcaagaaaacaactggccaccacacaggcccataccggagtatggcacttactcgctctgctcctcccaaagcagttctccgacagaaatggatgaaaatgagtcatgaacacagaaagtctaagaggagaaatatgatggatgaagagctctgtagatgctgtatagacactaaataagagttgattagggtagtatattatagtcatctgttatgctgtgaaatttggaattcagtattatcattttgaagtctgtaaattgtgttagtcattaacttagtcacctgttgtattctggatctacacaaaattattttaactgctcttattaatctgtgaggattaatatacaaaaagtatcctttgagatgaagtcgtgttctcaaaataaggttatattattttctttttctgcttgattttcatcttgtgttttgctttgtttttgtaaggaaccatctcttggtttggtcacatcagttcacaacagccatttgttttcaaggtcaaggctccaggcaggttgttactggtgtttgcagcctgtcagtacttgcagtactggaataggttctaggctagtgtctgcgcgtcactgtggttttagcatgggaggacttatttgagaaatactaccttacttttctatgatttctttttacagagttatagtgtgtttactcctaagatgacagttctctttgtctatattcagcatctaagacaaatatttaaacattttaaagaaccactgtgttaagtttaggattatttacttaccaaattagaagtttgacttttatgtgttatacacaatcttaaaatttcacgaattcacctttttaatagtatccatgtacataataaaatcaaagtttaattagccattttctttgaatttttttctaaataagggaaataactgttcttgggccactttacagagataaatgtatgtgaatgtttatgataaacgcttaaatatttctaaaatgttaacttcaaaaaagtctttttcagttcttaaataaaaatttttttatttaagatacttattcgacttatcttaactaaggtagctatgaatgttaagtagatgaggtaaccattcagttaagttaaattgtagcattgccaggtagtgaggctcactgtacaattttccaggtaaatgaaatttcctgtagtaagaggtccgtatttttgtaacagccttttaaaaatgcttttgggaaccctccagcctcttaccaaaagaggctttaaacctcatcttgattcagactgtcagtctattcctgggcagtagtatgtgatgtccagcaccctaaccccgactccccagccctgggactattccagtagagtgaaatatttgtccctgtacaaagtggcctgaatgactgttggagttcctgtgtctggttttcctgtttattccctgtgatgcccagagtaatggcccatccaaagatgtccagatgtccatgtgctagtctccagaacttgtaactgtgttgttatgtggcaaaggggaatgaaggctgcagatggaagtaaaatagattatgctggattatctgggtgtgcccaattgatcaccggatccgtaaaagtggaagagaggcagatcaggatgtcagcgtgatgaggtgtgagacagacttgacttgctgttgctgggaggaaggggaggtcatgagccaaggaatgtggacagtctcttgaagctggaaagtgtgcattggacatctggaagccagaaaagacaaagaaatatccagaaaggaacaaagtcttgtggacaccttgattttggtccagtgagaatatgtttgacttgttaacctacaaaactttatgatgataaatttgtgttggtcgtaagccactaaatcacagtaatttgttatagcagcagatagaaaactaatatactccctttaatataaggttatctactattgattctttctaggattttagcttctggtctgatgtgggtttacagccagatcacccggcttgaattgcttacagtgtgtagtctcatggtaaaggcgttctatgagtgaagtgtatatactttaatgtgtgtatactgtcacattttgactattttggaagactttcacctctgtttcttgtctttgaggctgatgaatgtgtttctaagttataaatttaatattaagggattcatgtattattgttattggatccaaacaatgtgttaagtaatatttagggccagaaaaatcttgtacagaataatgatttctcctaatgtaaatcttggaaagggttttgttcaacttgagaaatattaaattttttgttctattttcttttcttcaaagattggcaaaggagagagtgggttgctaaaagtttatattgttctccaaagaatagaaacactttccatagcccaactccggtagtaaataataatgaacgctttaataatgaaagagcaattggttagtattagaattgttttgattacaaagttagcatctctgcctgagctacccaaccccaaagcggggttgttagaggaaagctaccatatttcatagaaccgaggaaggaatgcagcagacctcaggtgagattcgaatgctctggctctgaccctcaatgcatattggctccatggccacctgtagctcccaagttttacacgttattgatcccccaaagagacctgatctcttgatttcagttccagggacgggtcagcttgggtcaggtgcccaccccttcaccaatcaacttgtctcaggtaacgcagtcacattatataatggctgctctggtcagtgatcatgtggatagatacagcattttctcaaaaaaatggtcacaggggtgggggtggggcaaacaaaaatattggtgtttgatacaaggtactgaagctaagatgtgaaaccttccatatacactttaaggacttctttgtccctggaaagtgatttttctggggctccttaggtagagaggtgtattaatggtgccagtgttagaatccttggcagtctcttcttgaacctgcaactccagtggttaaatctcataggccatataaccattttctagagaattctgttcctactatctaatgcagtaactgacttaaaagtaagtattactgttagactctaacataagtggtggtatttgttttaatggaggtgggatcaggtatgtgttcacttaagctttacattaaaaaaaaatttatatgtgtaaataaatatatatgccttgtagaaaaattagccataatcttactaccagaagagaactactgttaactttgtgtgtgtgtatatgtggtggatggttttatgttacctcctggctctttttatgtttccaattctctaacacttgtttaattaattacttatattattaagataacaggct

SEQ ID NO: 75712 - DNA, 1447 bp, Homo sapiens
agactgagctgctccttgtgggaactgctgatgttttgacaaaagaaagagggaaggtggaactacacagtggcttttaagtttctgcttggaagtgggccttgtgcacatcatgaccagttttgaagatgctgacacagaagagacagtaacttgtctccagatgacggtttaccatcctggccagttgcagtgtggaatatttcagtcaataagttttaacagagagaaactcccttccagcgaagtggtgaaatttggccgaaattccaacatctgtcattatacttttcaggacaaacaggtttcccgagttcagttttctctgcagctgtttaaaaaattcaacagctcagttctctcctttgaaataaaaaatatgagtaaaaagaccaatctgatcgtggacagcagagagctgggctacctaaataaaatggacctgccatacaggtgcatggtcagattcggagagtatcagtttctgatggagaaggaagatggcgagtcattggaattttttgagactcaatttattttatctccaagatcactcttgcaagaaaacaactggccaccacacaggcccataccggagtatggcacttactcgctctgctcctcccaaagcagttctccgacagaaatggatgaaaatgagtcatgaacacagaaagtctaagaggagaaatatgatggatgaagagctctgtagatgctgtatagacactaaataagagttgattagggtagtatattatagtcatctgttatgctgtgaaatttggaattcagtattatcattttgaagtctgtaaattgtgttagtcattaacttagtcacctgttgtattctggatctacacaaaattattttaactgctcttattaatctgtgaggattaatatacaaaaagtatcctttgagatgaagtcgtgttctcaaaataaggttatattattttctttttctgcttgattttcatcttgtgttttgctttgtttttgtaaggaaccatctcttggtttggtcacatcagttcacaacagccatttgttttcaaggtcaaggctccaggcaggttgttactggtgtttgcagcctgtcagtacttgcagtactggaataggttctaggctagtgtctgcgcgtcactgtggttttagcatgggaggacttatttgagaaatactaccttacttttctatgatttctttttacagagttatagtgtgtttactcctaagatgacagttctctttgtctatattcagcatctaagacaaatatttaaacattttaaagaaccactgtgttaagtttaggattatttacttaccaaattagaagtttgacttttatgtgttatacacaatcttaaaatttcacgaattcacctttttaatagtatccatgtacataataaaatcaaagtttaattagcca

SEQ ID NO: 75713 - DNA, 1809 bp, Homo sapiens
gagcctgaaaacctccgcgccaccgctgcgctctttacaaaggccccgggcgcgagaggacgtgctctgccagccagtgggaaggcaggccgcgcgcgcgggagcgcgggaggatcggcggctcgcggtcactggtccctggctcggttccccgcaccccggggctcacacttacccgcgcggaggagcagcggccgggtgtccacccccatcctgcgcccagtctcctcgattcccctcgctctgagccgggagagccgaacagctgaagagagttcactgactccccagccccaggtgggccttgtgcacatcatgaccagttttgaagatgctgacacagaagagacagtaacttgtctccagatgacggtttaccatcctggccagttgcagtgtggaatatttcagtcaataagttttaacagagagaaactcccttccagcgaagtggtgaaatttggccgaaattccaacatctgtcattatacttttcaggacaaacaggtttcccgagttcagttttctctgcagctgtttaaaaaattcaacagctcagttctctcctttgaaataaaaaatatgagtaaaaagaccaatctgatcgtggacagcagagagctgggctacctaaataaaatggacctgccatacaggtgcatggtcagattcggagagtatcagtttctgatggagaaggaagatggcgagtcattggaattttttgagactcaatttattttatctccaagatcactcttgcaagaaaacaactggccaccacacaggcccataccggagtatggcacttactcgctctgctcctcccaaagcagttctccgacagaaatggatgaaaatgagtcatgaacacagaaagtctaagaggagaaatatgatggatgaagagctctgtagatgctgtatagacactaaataagagttgattagggtagtatattatagtcatctgttatgctgtgaaatttggaattcagtattatcattttgaagtctgtaaattgtgttagtcattaacttagtcacctgttgtattctggatctacacaaaattattttaactgctcttattaatctgtgaggattaatatacaaaaagtatcctttgagatgaagtcgtgttctcaaaataaggttatattattttctttttctgcttgattttcatcttgtgttttgctttgtttttgtaaggaaccatctcttggtttggtcacatcagttcacaacagccatttgttttcaaggtcaaggctccaggcaggttgttactggtgtttgcagcctgtcagtacttgcagtactggaataggttctaggctagtgtctgcgcgtcactgtggttttagcatgggaggacttatttgagaaatactaccttacttttctatgatttctttttacagagttatagtgtgtttactcctaagatgacagttctctttgtctatattcagcatctaagacaaatatttaaacattttaaagaaccactgtgttaagtttaggattatttacttaccaaattagaagtttgacttttatgtgttatacacaatcttaaaatttcacgaattcacctttttaatagtatccatgtacataataaaatcaaagtttaattagccattttctttgaatttttttctaaataagggaaataactgttcttgggccactttacagagataaatgtatgtgaatgtttatgataaacgcttaaatatttctaaaatgttaacttcaaaaaagtctttttcagttcttaaataaaaatttttttattta

SEQ ID NO: 75714 - DNA, 556 bp, Homo sapiens
gtcacatcttacatggatggcagcaggcaaagagagagcctgtgcatggaaactcccccttataaaaccatcagatcttgtgatacttattcactatcacaagaacagcatgggaaagacctatccccatgattcaattacctcctatcaggtcccttccacaacatgtgggactcgtgggagctataattcaagatgagattggggtggggacacagccaaaccatatcactgtcagagtttgctgtggttttataccttcataagataggtgaatgcatccatcagctcaggctctgatatagtgcagtaacaaatgacctaaaaaatctcagtggcttattggaagaagggttggtttttttgctaatattaactgtcctttatgtatctgtcttcggctcttccctctgggacccagactgagctgctccttgtgggaactgctgatgttttgacaaaagaaagagggaaggtggaactacacagtggcttttaagtttctgcttggaagtaagtcactgccattcatgtttcattgacatggttgttaatg

SEQ ID NO: 75715 - DNA, 402 bp, Homo sapiens
gagcagctcctaaggaagccgacttggcttctgttcctgggaaaagcggatcaagaaactcgctgaagaccactatttacagatgagccacagcagagctgcttaattcactcaataacaaaccttaattgctcaaaacaaagcagctaagtctctttagagtgcttcaaaggcccttcacattgtaacttgcagtataaaatgtatgcaatatttccaaaaaagaaaaaaaattcagaatcaaggataaagttagaactttaccttaatcttcttttaaagagtttttttccccatctccccctctaattaggtcaaaatttagatgttattatgatctaactacaatctgtttattttactgcctttttaaaagaaaagagacatttgtgccttaatcct

SEQ ID NO: 75716 - DNA, 476 bp, Homo sapiens
ccctatgagagagatggtatcattgtcctcacatcacagaagctggaaaagaggctttgaaatttagtaatatctatattcaaaaccaactggactccaaaggtcacacttaactagtgcatttacctagaaaaaacttaattaataggtagtgaataattaactgaattaatctgtgcagaaagagtaatcttgctcttcaccatcataatgtgtattttataccatctgccatagatattgaacataccatcagcacaattctactcaaaaacaaacagaaaacataatgcttataataaaaaggacttccaaaatcaaccgaaggcctgaaacctggtaagcacagtctataagaagtgccagtatattgtcttaattttcaataagtagcacagcgcaaaggtattgcaagccatatggattttgacaaccgtgctttaataactttggaaaagccttactacttgttaaaa

SEQ ID NO: 75717 - DNA, 834 bp, Homo sapiens
  misc_feature (56)..(56): n is a, c, g, or t
  misc_feature (185)..(185): n is a, c, g, or t
  misc_feature (827)..(827): n is a, c, g, or t
gattccacctacctcctaagtgaaggcttccgtccctggagaggaggcggcgcctngtatcggccttcgtcctccgcgggactgcggcgccaagatgagtggagaggagaacccagccagcaagcccacgccggtgcaggacgtacagggcgacgggcgctggatgtccctgcaccatcggttcntggctgacagcaaagataaggaacccgaagtcgtcttcatcggggactccttggtccagctcatgcaccagtgcgagatctggcgcgagtctttctctcctctgcatgcacttaactttggcattggtggtgacggcacacagcatgtactgtggcggctggagaatggggagctggaacacatccggcccaagattgtggtggtctgggtgggcaccaacaaccacggacacacagcagagcaggtgactggtggcatcaaggccattgtgcaactggtgaatgagcgacagcccaggcccgggttgtggtgctgggcctgcttccgcgaggccaacatcccaacccacttcgggagaagaaccgacaggtgaacgagctggtacgggcggcactggctggccaccctcgggcccacttcctagatgccgaccctggctttgtgcactcagatggcaccatcagccatcatgacatgtatgattacctgcatctgagccgcctgggctacacacctgtttgccggctctgcactccctgcttctgcgtctgctgcccaagaccagggccaaggtgctcccctgctggagcccgcaccctaacatcctgctgccttcccacaacattaaactctccttcctnagtgaaa

SEQ ID NO: 75718 - DNA, 761 bp, Homo sapiens
  misc_feature (56)..(56): n is a, c, g, or t
  misc_feature (185)..(185): n is a, c, g, or t
  misc_feature (754)..(754): n is a, c, g, or t
gattccacctacctcctaagtgaaggcttccgtccctggagaggaggcggcgcctngtatcggccttcgtcctccgcgggactgcggcgccaagatgagtggagaggagaacccagccagcaagcccacgccggtgcaggacgtacagggcgacgggcgctggatgtccctgcaccatcggttcntggctgacagcaaagataaggaacccgaagtcgtcttcatcggggactccttggtccagctcatgcaccagtgcgagatctggcgcgagtctttctctcctctgcatgcacttaactttggcattggtggtgacggcacacagcatgtactgtggcggctggagaatggggagctggaacacatccggcccaagattgtggtggtctgggtgggcaccaacaaccacggacacacagcagagcagcctgcttccgcgaggccaacatcccaacccacttcgggagaagaaccgacaggtgaacgagctggtacgggcggcactggctggccaccctcgggcccacttcctagatgccgaccctggctttgtgcactcagatggcaccatcagccatcatgacatgtatgattacctgcatctgagccgcctgggctacacacctgtttgccggctctgcactccctgcttctgcgtctgctgcccaagaccagggccaaggtgctcccctgctggagcccgcaccctaacatcctgctgccttcccacaacattaaactctccttcctnagtgaaa

SEQ ID NO: 75719 - DNA, 2372 bp, Homo sapiens
tccggcgtggtgcgcaggcgcggtatcccccctcccccgccagctcgaccccggtgtggtgcgcaggcgcagtctgcgcagggactggcgggactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcacagggaggaatcaatgctgctctggggaacatggaggaggacaactggaggtggcatttctacgacaccgtgaagggctccgactggctgggggaccaggatgccatccactacatgacggagcaggcccccgccgccgtggtcgagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggaaggtctctgcgatatgataccagctattttgtggagtattttgccttggatctcctgatggagaatggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccccacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtccatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacggacctggtggagaccctggagctgcagaacctgatgctgtgtgcgctgcagaccatctacggagcagaggcacggaaggagtcacggggcgcgcatgccagggaagactacaaggtgcggattgatgagtacgattactccaagcccatccaggggcaacagaagaagccctttgaggagcactggaggaagcacaccctgtcctatgtggacgttggcactgggaaggtcactctggaatatagacccgtgatcgacaaaactttgaacgaggctgactgtgccaccgtcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgaacaaa

SEQ ID NO: 75720 - DNA, 911 bp, Homo sapiens
tccggcgtggtgcgcaggcgcggtatcccccctcccccgccagctcgaccccggtgtggtgcgcaggcgcagtctgcgcagggactggcgggactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcacagggaggaatcaatgctgctctggggaacatggaggaggacaactggaggtggcatttctacgacaccgtgaagggctccgactggctgggggaccaggatgccatccactacatgacggagcaggcccccgccgccgtggtcgagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggaaggtctctgcgatatgataccagctattttgtggagtattttgccttggatctcctgatggagaatggggagtgccgtggtgtcatcgcactgtgcatagaggacgggtccatccatcgcataagagcaaagaacactgttgttgccacagggtaggaatctcatttctactttattt

SEQ ID NO: 75721 - DNA, 2414 bp, Homo sapiens
  misc_feature (2388)..(2388): n is a, c, g, or t
tccggcgtggtgcgcaggcgcggtatcccccctcccccgccagctcgaccccggtgtggtgcgcaggcgcagtctgcgcagggactggcgggactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcacagggaggaatcaatgctgctctggggaacatggaggaggacaactggaggtggcatttctacgacaccgtgaagggctccgactggctgggggaccaggatgccatccactacatgacggagcaggcccccgccgccgtggtcgagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggaaggtctctgcgatatgataccagctattttgtggagtattttgccttggatctcctgatggagaatggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccccacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtccatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacggacctggtggagaccctggagctgcagaacctgatgctgtgtgcgctgcagaccatctacggagcagaggcacggaaggagtcacggggcgcgcatgccagggaagactacaaggtgcggattgatgagtacgattactccaagcccatccaggggcaacagaagaagccctttgaggagcactggaggaagcacaccctgtcctatgtggacgttggcactgggaaggtcactctggaatatagacccgtgatcgacaaaactttgaacgaggctgactgtgccaccgtcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgaacaaaaaaaaaagaaaaaaanagaaggaataattcaggtgcgaaaaa

SEQ ID NO: 75722 - DNA, 2764 bp, Homo sapiens
tccggcgtggtgcgcaggcgcggtatcccccctcccccgccagctcgaccccggtgtggtgcgcaggcgcagtctgcgcagggactggcgggactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcacagggaggaatcaatgctgctctggggaacatggaggaggacaactggaggtggcatttctacgacaccgtgaagggctccgactggctgggggaccaggatgccatccactacatgacggagcaggcccccgccgccgtggtcgagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggaaggtctctgcgatatgataccagctattttgtggagtattttgccttggatctcctgatggagaatggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccccacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtccatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacggacctggtggagaccctggagctgcagaacctgatgctgtgtgcgctgcagaccatctacggagcagaggcacggaaggagtcacggggcgcgcatgccagggaagactacaaggtgcggattgatgagtacgattactccaagcccatccaggggcaacagaagaagccctttgaggagcactggaggaagcacaccctgtcctatgtggacgttggcactgggaaggtcactctggaatatagacccgtgatcgacaaaactttgaacgaggctgactgtgccaccgtcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgaacaaactttcttttatttccaaatccatttgaaatattttactgttgtgactttagtcatatttgttgacctaaaaatcaaatgtaatctttgtattgtgttacatcaaaatccagatattttgtatagtttcttttttctttttcttttcttttttttttttgagacaggatcggtgcagtagtacaatcacagctcactgcagcctcaaactcctgggcagctcaggtgatcttcctgactcagccttctgagtagttggggctacaggtgtgcaccaccatgcccagctcatttattttgtaattgtagggacagggtctcactgtgttgcctaggctggtctcaagtgatcctccctccttggcctcccaaggtgctggaattataggtgtga

SEQ ID NO: 75723 - DNA, 2318 bp, Homo sapiens
tccggcgtggtgcgcaggcgcggtatcccccctcccccgccagctcgaccccggtgtggtgcgcaggcgcagtctgcgcagggactggcgggactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcacagggaggaatcaatgctgctctggggaacatggaggaggacaactggaggtggcatttctacgacaccgtgaagggctccgactggctgggggaccaggatgccatccactacatgacggagcaggcccccgccgccgtggtcgagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggaaggtctctgcgatatgataccagctattttgtggagtattttgccttggatctcctgatggagaatggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccccacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtccatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacggacctggtggagaccctggagctgcagaacctgatgctgtgtgcgctgcagaccatctacggagcagaggcacggaaggagtcacggggcgcgcatgccagggaagactacaaggtgcggattgatgagtacgattactccaagcccatccaggggcaacagaagaagccctttgaggagcactggaggaagcacaccctgtcctatgtggacgttggcactgggaaggtcactctggaatatagacccgtgatcgactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgaacaaa

SEQ ID NO: 75724 - DNA, 1545 bp, Homo sapiens
tccggcgtggtgcgcaggcgcggtatcccccctcccccgccagctcgaccccggtgtggtgcgcaggcgcagtctgcgcagggactggcgggactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcacagggaggaatcaatgctgctctggggaacatggaggaggacaactggaggtggcatttctacgacaccgtgaagggctccgactggctgggggaccaggatgccatccactacatgacggagcaggcccccgccgccgtggtcgagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggaaggtctctgcgatatgataccagctattttgtggagtattttgccttggatctcctgatggagaatggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccccacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtccatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtgatggtgctggctcctcccccacagctggaaagaaggctgggacgacggggcccacctcgcagttgtctctttagatcttacaggaaaagatagatgtttccttcaagaaagtactgtattgttttctagattgcactttaaatttctattaccggaggatggagggg

SEQ ID NO: 75725 - DNA, 2310 bp, Homo sapiens
ggcgaggtgcaacccaagccaatcattgatcggggcgtcctgcgtcctgcttagccgcgctgtctgtggcgctcgagcgcctggtgctggaccatatggtcgtaggccagacagatgttgcagatagcaggaacccgaggtttacagattcagcgtgtggatgtgatgcgagagaggcatctgcttacagtttcatcatttccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcacagggaggaatcaatgctgctctggggaacatggaggaggacaactggaggtggcatttctacgacaccgtgaagggctccgactggctgggggaccaggatgccatccactacatgacggagcaggcccccgccgccgtggtcgagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggaaggtctctgcgatatgataccagctattttgtggagtattttgccttggatctcctgatggagaatggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccccacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtccatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacggacctggtggagaccctggagctgcagaacctgatgctgtgtgcgctgcagaccatctacggagcagaggcacggaaggagtcacggggcgcgcatgccagggaagactacaaggtgcggattgatgagtacgattactccaagcccatccaggggcaacagaagaagccctttgaggagcactggaggaagcacaccctgtcctatgtggacgttggcactgggaaggtcactctggaatatagacccgtgatcgacaaaactttgaacgaggctgactgtgccaccgtcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgaacaaa

SEQ ID NO: 75726 - DNA, 2190 bp, Homo sapiens
ccctgtgtctccaccacgcagatgaggagactgaggctaaggatggaatcactgggcgagtcggggaggggttgtgatctggaatctgtcgggtctcgctgctcctctgctgaggtcagccctcactgggagtcactgtgtgagtagttggctttctctgaatccccccagcgggtggatttgggcctggaagacaaagttggcgctcctgtttgtggcttgtaaggagtggttggtgtttccagggaggaatcaatgctgctctggggaacatggaggaggacaactggaggtggcatttctacgacaccgtgaagggctccgactggctgggggaccaggatgccatccactacatgacggagcaggcccccgccgccgtggtcgagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggaaggtctctgcgatatgataccagctattttgtggagtattttgccttggatctcctgatggagaatggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccccacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtccatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacggacctggtggagaccctggagctgcagaacctgatgctgtgtgcgctgcagaccatctacggagcagaggcacggaaggagtcacggggcgcgcatgccagggaagactacaaggtgcggattgatgagtacgattactccaagcccatccaggggcaacagaagaagccctttgaggagcactggaggaagcacaccctgtcctatgtggacgttggcactgggaaggtcactctggaatatagacccgtgatcgacaaaactttgaacgaggctgactgtgccaccgtcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgaacaaa

SEQ ID NO: 75727 - DNA, 2297 bp, Homo sapiens
tccggcgtggtgcgcaggcgcggtatcccccctcccccgccagctcgaccccggtgtggtgcgcaggcgcagtctgcgcagggactggcgggactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcacagggaggaatcaatgctgctctggggaacatggaggaggacaactggaggtggcatttctacgacaccgtgctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggaaggtctctgcgatatgataccagctattttgtggagtattttgccttggatctcctgatggagaatggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccccacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtccatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacggacctggtggagaccctggagctgcagaacctgatgctgtgtgcgctgcagaccatctacggagcagaggcacggaaggagtcacggggcgcgcatgccagggaagactacaaggtgcggattgatgagtacgattactccaagcccatccaggggcaacagaagaagccctttgaggagcactggaggaagcacaccctgtcctatgtggacgttggcactgggaaggtcactctggaatatagacccgtgatcgacaaaactttgaacgaggctgactgtgccaccgtcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgaacaaa

SEQ ID NO: 75728 - DNA, 2087 bp, Homo sapiens
gggcttgcaaattagtatttagcgtctatctgacagcccgtgttctaatcacgagccatgtgttcaccgatgctgtgtcctagctacgtcacacatctgttgctccaaaggcatgaatcactgctgctctgccgtagacctggcagcgaggcatgattgcgcaggcttggcaatatttctacggaccacttgcttgaaggcgcgtcctccgcaccctggcctagggcgagaccaggcgatgctcgatactactacatgacggagcaggcccccgccgccgtggtcgctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggaaggtctctgcgatatgataccagctattttgtggagtattttgccttggatctcctgatggagaatggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccccacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtccatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacggacctggtggagaccctggagctgcagaacctgatgctgtgtgcgctgcagaccatctacggagcagaggcacggaaggagtcacggggcgcgcatgccagggaagactacaaggtgcggattgatgagtacgattactccaagcccatccaggggcaacagaagaagccctttgaggagcactggaggaagcacaccctgtcctatgtggacgttggcactgggaaggtcactctggaatatagacccgtgatcgacaaaactttgaacgaggctgactgtgccaccgtcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgaacaaa

SEQ ID NO: 75729 - DNA, 1941 bp, Homo sapiens
tccggcgtggtgcgcaggcgcggtatcccccctcccccgccagctcgaccccggtgtggtgcgcaggcgcagtctgcgcagggactggcgggactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcacagggaggaatcaatgctgctctggggaacatggaggaggacaactggaggtggcatttctacgacaccgtgcagcactggcgacggcacggccatgatcaccagggcaggccttccttgccaggacctagagtttgttcagttccaccccacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtccatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacggacctggtggagaccctggagctgcagaacctgatgctgtgtgcgctgcagaccatctacggagcagaggcacggaaggagtcacggggcgcgcatgccagggaagactacaaggtgcggattgatgagtacgattactccaagcccatccaggggcaacagaagaagccctttgaggagcactggaggaagcacaccctgtcctatgtggacgttggcactgggaaggtcactctggaatatagacccgtgatcgacaaaactttgaacgaggctgactgtgccaccgtcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgaacaaa

SEQ ID NO: 75730 - DNA, 1274 bp, Homo sapiens
ggacgcgtgggtcgaccacgcgtcgctggcgtctagagatgtggtgtctcggtccatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacggacctggtggagaccctggagctgcagaacctgatgctgtgtgcgctgcagaccatctacggagcagaggcacggaaggagtcacggggcgcgcatgccagggaagactacaaggtgcggattgatgagtacgattactccaagcccatccaggggcaacagaagaagccctttgaggagcactggaggaagcacaccctgtcctatgtggacgttggcactgggaaggtcactctggaatatagacccgtgatcgacaaaactttgaacgaggctgactgtgccaccgtcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgaacaaa

SEQ ID NO: 75731 - DNA, 139 bp, Homo sapiens
attgcacaccttatatggaagggtaaggccgcccccgtccacctgagacaggacacgtagtgctggggcttatggtgacagtggggaatgggttagcgtgcccagtgagtcagccagagattacgtaaaaagcaacaga

SEQ ID NO: 75732 - DNA, 372 bp, Homo sapiens
agctgcagaacctgatgctgtgtgcgctgcagaccatctacggagcagaggcacggaaggagtcacggggcgcgcatgccagggaagactacaaggtgggccttctcaccacgcccacctgcacctgccttttcctgccacctggtgggactcagccccacccctgcattttctctgcattttctttcgttgccccaaaagtaaatccaaaaaatgcctttttcccccctggtaactttgatccctgggttctcgccatcttctggatcactgtgaccttttccttgctttgggtcggcatccactgatgccagcagtggcatctccaagccaatgtgctttgctgttagaaggccaaggttagaagtgcag

SEQ ID NO: 75733 - DNA, 496 bp, Homo sapiens
tccggcgtggtgcgcaggcgcggtatcccccctcccccgccagctcgaccccggtgtggtgcgcaggcgcagtctgcgcagggactggcgggactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcacaggtaagagaaaggtgccccactgtgctcccactccgtgcaggtcccgcgcagcctcgcactttctacctg

SEQ ID NO: 75734 - DNA, 2795 bp, Homo sapiens
tccggcgtggtgcgcaggcgcggtatcccccctcccccgccagctcgaccccggtgtggtgcgcaggcgcagtctgcgcagggactggcgggactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcacagggaggaatcaatgctgctctggggaacatggaggaggacaactggaggtggcatttctacgacaccgtgaagggctccgactggctgggggaccaggatgccatccactacatgacggagcaggcccccgccgccgtggtcgagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggaaggtctctgcgatatgataccagctattttgtggagtattttgccttggatctcctgatggagaatggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccccacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtccatgactctggagatccgagaaggaaggtgcgtgtgatttaccaccagcactgtctgagcgggcacacgggccggggttgcttctgtgagtttcagcaccgctcgccctcaccttcgtgtgcaggcgcatgtgcacagccacctctcttagctgccggcaggcgtctgttagtctgcgatattttcctaaagacctacattttgaaaattttagccagtttctttctcaaatctgtggaacagagtttctcttagtgtgtgtgagtatgtgacggagtatgggagagagagacacacacccaacctgaagtcggcatgtgagccttgggtgttgtgtctgatacccacagatgttttttggcagctttcaaagtgtgtgggttatttggctttcagtaaaacagtttgcagctctttcattgcctgaccctgttctttaatgtaatgacatttgctaaatatctgctggtatggcctttagaggttttacatttttatattaaaaaaacagagaagtcaggcgtgagccaccacgcctggcctacttccctctctctgacctgcagcacagacaccctgttggggaaggtgggctggtggaggcatgggcaccttgacatttcacctgaaatcttcctttccacaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacggacctggtggagaccctggagctgcagaacctgatgctgtgtgcgctgcagaccatctacggagcagaggcacggaaggagtcacggggcgcgcatgccagggaagactacaaggtgcggattgatgagtacgattactccaagcccatccaggggcaacagaagaagccctttgaggagcactggaggaagcacaccctgtcctatgtggacgttggcactgggaaggtcactctggaatatagacccgtgatcgacaaaactttgaacgaggctgactgtgccaccgtcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgaacaaa

SEQ ID NO: 75735 - DNA, 2129 bp, Homo sapiens
tccggcgtggtgcgcaggcgcggtatcccccctcccccgccagctcgaccccggtgtggtgcgcaggcgcagtctgcgcagggactggcgggactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcacagggaggaatcaatgctgctctggggaacatggaggaggacaactggaggtggcatttctacgacaccgtgaagggctccgactggctgggggaccaggatgccatccactacatgacggagcaggcccccgccgccgtggtcgagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggaaggtctctgcgatatgataccagctattttgtggagtattttgccttggatctcctgatggagaatggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccccacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtccatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaaggtgcggattgatgagtacgattactccaagcccatccaggggcaacagaagaagccctttgaggagcactggaggaagcacaccctgtcctatgtggacgttggcactgggaaggtcactctggaatatagacccgtgatcgacaaaactttgaacgaggctgactgtgccaccgtcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgaacaaa

SEQ ID NO: 75736 - DNA, 2156 bp, Homo sapiens
tccggcgtggtgcgcaggcgcggtatcccccctcccccgccagctcgaccccggtgtggtgcgcaggcgcagtctgcgcagggactggcgggactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcacagggaggaatcaatgctgctctggggaacatggaggaggacaactggaggtggcatttctacgacaccgtgaagggctccgactggctgggggaccaggatgccatccactacatgacggagcaggcccccgccgccgtggtcgagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggaaggtctctgcgatatgataccagctattttgtggagtattttgccttggatctcctgatggagaatggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccccacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtccatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaaggtaagagcctggactcgctctggagtgagcaggagggctgcatacctggccctgcactggttttgttttttaaaaactagatctagggggatgcaggtgcagttttgtgtggatgtactgggaggtggtggagtctgggcttttcatgtacccgtcacacaagtcgtgtgtgttgtacccagtaggtaattgttcaaccccacccctcccgctttttggagctcccagtctctgctactccactccatgtgtccatgtgtactcaccattcagcttccacttccaagtgagaatgtgtgacacttgaccttctgagtcacttcacttaggatagtgacctcctgttccatccgtgtggctgcagaagacatgattgcgttctttttttatggccgagtagtatttcatggtatatatgtaccacattttcttcatctggtcatccgttgatgggcacttaggttgattccatgactttgctgttgtgact

SEQ ID NO: 75737 - DNA, 1330 bp, Homo sapiens
tccggcgtggtgcgcaggcgcggtatcccccctcccccgccagctcgaccccggtgtggtgcgcaggcgcagtctgcgcagggactggcgggactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcacagggaggaatcaatgctgctctggggaacatggaggaggacaactggaggtggcatttctacgacaccgtgaagggctccgactggctgggggaccaggatgccatccactacatgacggagcaggcccccgccgccgtggtcgagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggaaggtctctgcgatatgataccagctattttgtggagtattttgccttggatctcctgatggagaatggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccccacagagagacactgatctaggacctacattaatatctcgtagggcttgggaacttagtattactatctttccattacagcaacgtcagttctctctacatttcactgaaatttatccctccaactctctgtaacttgcattcatttgtttctgactgtaccctctgggagctacacacggtttttctaacataatagcacccaggatttctttgccagcctaagtcacacagtcatctttccaaactaagtattcctttttccaagtactatgtttttccaaaataagtattcgaggaacaaacgggcaattcactttgcctat

SEQ ID NO: 75738 - DNA, 2228 bp, Homo sapiens
tccggcgtggtgcgcaggcgcggtatcccccctcccccgccagctcgaccccggtgtggtgcgcaggcgcagtctgcgcagggactggcgggactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcacagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggaaggtctctgcgatatgataccagctattttgtggagtattttgccttggatctcctgatggagaatggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccccacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtccatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacggacctggtggagaccctggagctgcagaacctgatgctgtgtgcgctgcagaccatctacggagcagaggcacggaaggagtcacggggcgcgcatgccagggaagactacaaggtgcggattgatgagtacgattactccaagcccatccaggggcaacagaagaagccctttgaggagcactggaggaagcacaccctgtcctatgtggacgttggcactgggaaggtcactctggaatatagacccgtgatcgacaaaactttgaacgaggctgactgtgccaccgtcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgaacaaa

SEQ ID NO: 75739 - DNA, 1834 bp, Homo sapiens
acccacgctgtcgggcccccgccgccgtggtcgctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggaaggtctctgcgatatgataccagctattttgtggagtattttgccttggatctcctgatggagaatggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccccacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtccatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacggacctggtggagaccctggagctgcagaacctgatgctgtgtgcgctgcagaccatctacggagcagaggcacggaaggagtcacggggcgcgcatgccagggaagactacaaggtgcggattgatgagtacgattactccaagcccatccaggggcaacagaagaagccctttgaggagcactggaggaagcacaccctgtcctatgtggacgttggcactgggaaggtcactctggaatatagacccgtgatcgacaaaactttgaacgaggctgactgtgccaccgtcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgaacaaa

SEQ ID NO: 75740 - DNA, 1702 bp, Homo sapiens
  misc_feature (35)..(35): n is a, c, g, or t
  misc_feature (51)..(51): n is a, c, g, or t
ggctaggtgagtgccgcggtttaatcggcacaggncactcgctattgcatnaccttatatggaaggtctctgcgatatgataccagctattttgtggagtattttgccttggatctcctgatggagaatggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccccacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtccatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacggacctggtggagaccctggagctgcagaacctgatgctgtgtgcgctgcagaccatctacggagcagaggcacggaaggagtcacggggcgcgcatgccagggaagactacaaggtgcggattgatgagtacgattactccaagcccatccaggggcaacagaagaagccctttgaggagcactggaggaagcacaccctgtcctatgtggacgttggcactgggaaggtcactctggaatatagacccgtgatcgacaaaactttgaacgaggctgactgtgccaccgtcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgaacaaa

SEQ ID NO: 75741 - DNA, 1134 bp, Homo sapiens
agctcctcctagtgtgtatcaccacagggctgctggcttgtgtcacgttcaccaccagaccccgcgtcaggagtcccgccaggggtgtggagaggcagcgctgcctggttggccgtggagctgtatggaacatggtgcctcacaggcagtctgcttggagtcctggaccctggctgtatcctgctggaaaggatgtgtgtgggtctaagatgtgtatgtaatagaaacatttatttattcagaagctttagtcaaaacttcatttttaagtttggagtaataaactcatagtctgaatttcctaatttttctgtttaatttatgtaacttttaagtgaaatgcaaaacaacaggtctaaaagttaagcagttcttggtatggctgcttctatggattaaaagtttacaaataatattttgtgccacagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacggacctggtggagaccctggagctgcagaacctgatgctgtgtgcgctgcagaccatctacggagcagaggcacggaaggagtcacggggcgcgcatgccagggaagactacaaggtgcggattgatgagtacgattactccaagcccatccaggggcaacagaagaagccctttgaggagcactggaggaagcacaccctgtcctatgtggacgttggcactgggaaggtcactctggaatatagacccgtgatcgacaaaactttgaacgaggctgactgtgccaccgtcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgaacaaa

SEQ ID NO: 75742 - DNA, 705 bp, Homo sapiens
gaaagatacactacaactaggtgtggtttattcagcaaatgcaaggctggttcaatatttgaaaatcaaccaatgttatctgcaattttgacagactaaagaaaaaataaaacaccacaggatcatatcagttgatgcggcaaaagcatttgaccagatcaaacatccatttataataataactctcagaaaactagagctagaagaaaactttctcaacctaaaaaacgaggaaccacaaattaactaaagctagcatcacacttgatggctaaagtctcaatgcttttcccctaaaatcaggaccaaggcaagtgtgtctgatctccccactgctattcaacatagtactgggaatcctggccattacaataatgtaagaaaagaaaagctatacaaattggaaagaaaaaataaatctatccttatttgcagattgcatggttgtctagatagaaaatcccaaggaatctaaaaaaaaaaaatcttaaaactaataagtgggtttagcaggatcacaaaatgcaaagccaacacataaatatcaaccatattacgtattagccaaaaacaattggaaactgaaataaaaaacataatgttatttacagttgctccaaaaaagctccccactactattcaacatagtactgggaatcctggccattacagtaatgtaagaaaagaaaaggcatacaaattgga

SEQ ID NO: 75743 - DNA, 256 bp, Homo sapiens
catttgagtacacctcctctattagattctttcatacatatcccaagcacttgatatactttatagcctaggaatacagaagtaacttttgtgtcttcaaagcagttttaaaaatacatgcctttgtgagaaatgagctttaaaaacagtgctacatttgtatgatatattgggaatacagaacctaagaatctttactaaggagataatggtaactagactacctagactgccatctgcaacaagaatctgctaa

SEQ ID NO: 75744 - DNA, 144 bp, Homo sapiens
tcatagataccaaacataataatgcaaataaagtatggggaagtatttatatcatatgtaaacaatatataaggaaaatgcaccaaagaaataagcatatatacctgaaacaagctaagggagggccatgcataaattgttggc

SEQ ID NO: 75745 - DNA, 520 bp, Homo sapiens
caggttggagcccctttccctctcccctgcatgtccatcgcaggcttcaatgtgtctggcaggcaggaaaattgaagtgcgaatttgagtgaccgtctgtacgtccaaaatggaaaatggcattcatcagactacttctttctcttatttcatgtgtaactccttaacagaaaacaactgctgcacacggagggccttatcagacacaggacagggaccacagtattagcactcaagtgctcatagcctttcccccaccaagcccatccattctgtgcactgttggccccaggggagacaaggtaattttctcccttcctggtcatcttggggcccagaccaccagctggagaaatgatgcagagagagcagatgagaaagctgaaatactgcaagttgaaatgactcgtcctagatcccaggtctagtgaagagtgagcaccagaaatcacatgtactagactaccagcagtcagatataatcagcccccaaatctcctgtggttcactatatataaaa

SEQ ID NO: 75746 - DNA, 2575 bp, Homo sapiens
  misc_feature (506)..(506): n is a, c, g, or t
  misc_feature (1938)..(1938): n is a, c, g, or t
  misc_feature (1993)..(1993): n is a, c, g, or t
  misc_feature (1995)..(1997): n is a, c, g, or t
  misc_feature (2008)..(2009): n is a, c, g, or t
  misc_feature (2017)..(2017): n is a, c, g, or t
  misc_feature (2539)..(2539): n is a, c, g, or t
aagcttgcgcgccatgtaaggtaaagtgactgattctatagcaatccaattgttcctttgtctgcccgtttacatataacaatgttgtcaatgtttgattgaaaatacctagcaggcgacacacacacctagctcctcaggcggagagcacccctttcttggccacccgggtatcccccagggagtacggggctcaaaacacccttttggagaacaaggtggaagcaaatttcaggaagtaaaacttcctgaaataaaataaaatatcgaatgccttgagacccatacattttcaggttttcctaattaaagcaattactttccaccacccctccaacctggaatcaccaacttggttagagaaactgatttttcttttttctttttttttcccaaaagagtacatctgatcattttagcctgcaactaatgatagagatattagggctagttaaccacagttttacaagactcctctcccgcgtgtgggccattgtcatgctgtnggtcccgcccacctgaaaggtctccccgccccgactggggtttgttgttgaagaaggagaatccccggaaaggctgagtctccagctcaaggtcaaaacgtccaaggccgaaagccctccagtttcccctggacaccttgctcctgcttctgctacgaccttctgggaacgcgaatttctcattttcttcttaaattgccattttcgctttaggagatgaatgttttcctttggctgttttggcaatgactctgaattaaagcgatgctaacgcctcttttccccctaattgttaaaagctatggactgcaggaagatggtccgcttctcttacagtgtgatttggatcatggccatttctaaagcctttgaactgggattagttgccgggctgggccatcaggaatttgctcgtccatctcggggagacctggccttcagagatgacagcatttggccccaggaggagcctgcaattcggcctcggtcttcccagcgtgtgctgcccatgggaatacagcacagtaaggagctaaacagaacctgctgcctgaatgggggaacctgcatgctggagtccttttgtgcctgccctccctccttctacggacggaactgtgagcacgatgtgcgcaaagagaactgtgggtctgtgccccatgacacctggctgcccaagaagtgttccctgtgtaaatgctggcacggtcagctccgctgctttcctcaggcatttctacccggctgtgatggccttgtgatggatgagcacctcgtggcttccaggactccagaactaccaccgtctgcacgtactaccacttttatgctagctggcatctgcctttctatacaaagctactattaatcgacattgacctatttccagaaatacaattttagatattatgcaaatttcatgacccgtaaaggctgctgctacaatgtcctaactgaaagatgatcatttgtagttgccttaaaataatgaatacatttccaaaacggtctctaacatttccttacagaactaactacttcttacctctttgccctgccctctcccaaaaaactacttcttttttcaaaagaaagtcagccatatctccattgtgcccaagtccagtgtttcttttttttttttgagacggagtctcactctgtcacccaggctggactgcaatgacgcgatctcggttcactgcaacctccgcatccggggttcaagccattctcctgcctcagcctcccaagtagctgggattacaggcatgtgtcaccatgccggctaatttttttgtattttagtagagacgggggtttcaccatattggccagctggtctcgaactctgaccttgtgatccatcgctcgcctctcgagtgctgagattacacacgtgagcaactgtgcaaggcctggtgtttcttgntacatgtaattctaccaaggtcttcttaatatgttcttttaaatgattgaattanannntcagattattnnagactaantctaatgtggaccttagaatacagttttgagtagagttgatcaaaatcaattaaaatagtctctttaaaaggaaagaaaacatctttaaggggaggaaccagagtgctgaaggaatggaagtccatctgcgtgtgtgcagggagactgggtaggaaagaggaagcaaatagaagagagaggttgaaaaacaaaatgggttacttgattggtgattaggtggtggtagagaagcaagtaaaaaggctaaatggaagggcaagtttccatcatctatagaaagctatgtaagacaaggactcccctttttttcccaaaggcattgtaaaaagaatgaagtctccttagaaaaaaaattatacctcaatgtccccaacaagattgcttaataaattgtgtttcctccaagctattcaattcttttaactgttgtagaagagaaaatgttcacaatatatttagttgtaaaccaagtgatcaaactacatattgtaaagcccatttttaaaatacattgtatatangtgtatgcacagtaaaaatggaaactatattgacct

SEQ ID NO: 75747 - DNA, 578 bp, Homo sapiens
agctccagcctcttaaggcacagatttggccataaagtttgttaaatgattttccgatttggtatattttcatgttttctttagccatttgattcacataggtctaatgaggtgttgatttaaaatacagaaatacatccctattgtgtgcttaacaaaactatgtccatttgataggaaggtaagagttaacctctgtatggatgttttgtgaactgctataattgacttatttatttattagcttgtctccactaccagaaaccgcatcatctgacttaatgagctttcatctgcagtacctataattgtagggtatcttggggttctctgagattcccacatttgtcagtattcctggttttttgggaaatactattctttattctcttcaaagcttggaatctataagctgtggaagagatactaaattgatttcttgtgaagatttagtaggcatgatttctatatttaagatgcaatccttgggaggctgaggcaggagaatcgtttgaatccggaaggcagaggttgcagtgagccaagattgcgccactacactccagcgtgggtgacag

SEQ ID NO: 75748 - DNA, 368 bp, Homo sapiens
cctgttgatttctgggagggctctctccttggcatgtagaagtggccttggggagaaggcggggccggccagggtttctactcctgcctcatggagacccgcctcagatgcccagcactgcgactgctgcacagccacgaggctgagccgctgcggatgcatgcgtgacttaggaatgtgtgctggtgtgtttgccacagcaacaggatgaggaaagcacagctccaagagaggtgggagctcatccacctggggaagcatgagcaggagcaggaagggtcactctgggactgtgctcatgggaccctgagatgcagcagaaagagcagtgtgaggagcaaagtgacgctgcctgcaggtgctgtcca

SEQ ID NO: 75749 - DNA, 1597 bp, Homo sapiens
ttaaaatgtttataattacatattttataattaaaatgtttataattacatattttataattacatattttataaagtatttataattacatattttataattaaagtatttataattacatattttataattaaagtatttataattacatattttataattcaatattttataaatagttaaaaagacgaggaaaaaattaaaaagacgaggttattgatctcaggaattgtatttgccaagtgagaaggaaaaaatattcacaaaggcttgtacatactttgatcctgaggaacacctctggtgtcttcatgtgccacatagtcttcctcactgactgtctgcctttgcaaggcaaggctctccggtaggcctcgagatgaaataacaagtcctttatttcactcagcctgccaggagtggagaaggaatggctagggagtcctagccccaggggcttcatggcaatacggaccccagatgtctccctggagctctgccaggatccattcaaggccaagaaagtatgattgggagaggaggggtggagatgtagattcctaacaattctgtgacccagcatacatgtatgctctttaggctcttaagcatccttatttttccaaatataatatccaacaatcccaagtgtagtaaaaacccaagggtttctcctgccacatccactcacttcaaactctgattttaaacactggcaatatccagtcagagcctccaagctgagctctagaaagagaaagctgcaaaaaacctgtgcaacaaaacttgcactcatattactgacaagggtagatataaaacagcgcattcttttccatgacactgaagagcaaagaagagtgtaacttgggggcaataagaaattggaggtcaccacctcccaaatcctacatgaggtctatttggaaaagacctccttttttaattcaaaaatccttcaacctccaccattctttcataaagcttcacattctcttggtgaagcccactgttaaaatgcacaggcgttacctggaaaaggaaacacatagccttaacaatattcttctgtactgaactgaagagtgagaaagagtctatggagctataatacggtagtgtatgaatctggtactcaaggaaagtctgttggataatggatggatggatggatggatggatgggtgggtgagcgaataaatgagtggataaatgaggggtcagttttgagagtgagagaaacatggaaattagactcaaatcccaaggcaccacatggaatagttccaggaatagttctgcaagagtttccctgatgagctataagcagcaaaaatttagtgagtgttcaaactgaaaggaggcctggaattgtggcttaatttggagggaaagagggagtccaagattcccagtgcttatttgttgatatctatctagtgctgaaaagaaaaaaaaatagccacaaatccaaaatgattgtgcagtcacatggtacccactgcccagttccttgaccagtgtccctcatacaaagggcccctgatgagctcagaatgtctttgttgtactgaataaagtttgaagaacaaggga

SEQ ID NO: 75750 - DNA, 495 bp, Homo sapiens
gtaatgtctaagaaaggatgctgtcatggttactggagagtctgtgggcgctacagaatggcacctgctccaggatggagcagagcaagactcgtgggctgaattctttggcttgtgagttccacttaacaccaattgcagggctccacatgtagggaccccaagtctccaccctggattttcatgccatcccctccaccccctcaaagcaatttcttaattataaaaagaaaactttctagaggcaatcaacctgaaactttgctattatattttcattaacaatgcagcttcagcagagtaaattgccccttacctgggcctaaataggaagagtgaccacctttggatattcaggagttaacaaacccagggtacccagtaataacaaacacatagccccaaaccagttgttactcagatgactctgtatttattccatttattagtttgtgacatgaaaataaaaagataaatcactggctgatagtgttt

SEQ ID NO: 75751 - DNA, 1359 bp, Homo sapiens
acacatcttatttactgtcagtttccaatgtagtataaaaatgcacacaccagttaaataagaagacctgccaagcaactcagtaaagctgatataataaaatcccagaaaaataaactctttttctcatttgagagactttaaaagtaacttcttgtatggtaaaaattataggcaggctttccagaagttcacacaaccagctaacctgaatgcacaaggaactatctgtgtagagtcaaaggcaattctaaaatagtagtgtagagttctgggggatgtcagagaaaaaacttgtcaaaatcattgagcacttactctgaactctactaaatctatcaggagttaatgtatattgttccagtcattttattttgcttttacacacatatttatatacacatgaaatatatatagaatatctacaaatcatttcattaataaattatacagtgtaattcagccactagcttttttcattcaaatgtgagctcaaatgtgacctgtcacctgtttctgtatgtcctgttagctaagaatggcttttatgtttttgaatggttagaaaaaataagtctaaagaaaaataacatttcatgactagtgaaaattacacaaaatttgaatttcagtgttgcactataacagcagagctgcatatttacaactgagaccatatggcctatgacctacaaatgctttaaatatttactatctagctctttccctaagcagcctgaggtaatctgtgaaaatggttcgctactcacttgacccggagaaccccacgaaatcatgcaaatcaagaggttccaatcttcgtgttcactttaagaacactcgtgaaactgctcaggccatcaagggtatgcatatacaaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaataaaaaataaaaat

SEQ ID NO: 75752 - DNA, 355 bp, Homo sapiens
cccaggaggctgaggcaggagaatcgcctgaacccgggaggcagaggttgcagtgagccgggattgtgccactgcactccagcctggtgacagagcgagagttcatccagacacacacatatatatataatttccaaacaggctttactaaaccccctgaggtctcatgacacagtagaaaatcatgatttagtagaaagagcatggtcgtaggaatccagtagatcagtagacctgagttagagtcccaaatctgccactttcaatctgtatggcctcaggcaagttacttaacctttctgtctctctgtttctttataaaatggagataataatagtaacttcttcataggag

SEQ ID NO: 75753 - DNA, 479 bp, Homo sapiens
cttaatttacaagacactaagggctcctcacccaaccccctttcgtaaggagttggcctgggtaaacagatcctcagcatttcaaaggagcctaattaactgataaggtacgaacaccaacaatatatgaagttcccaggaattttctccaagagataacaacataaaaccttgagttcgtgtctggcgtagaccctatatctaattataatgaaagatttagaatcttgcacctggtactgttgctcttcttgtaaccatttgtcttttaagttgtttatcactctgtaaccattttgattcttttgattcttgcatgtttttacttctgtagaattattacatttaagtccccctccccttcctaaacctaagtataaaagttaatcgagccccttcctcgtggccgaaagaattttgagcattagctgtctctttggccgccggcttaataaaggactcttaattcgtctcaaagt

SEQ ID NO: 75754 - DNA, 694 bp, Homo sapiens
tgcagggggttctgtgggggtcttgtgtcacaggctgcacaaagactttcctcaaactaatattcagggatttctgtcctgcagggtggggaggtggcagctgcctgccctgccaaggatcttgctgtggacgaaatatctgggggttagggggacagttgtagcatctgctggcattcgggtgcctcccaggacctgggagctgactctacagagaggtctggtgccaagccaggcaccttcctgagttctcaggactcccacctctgccccaagggctttgggcagggacctaaaggggaaagagtcctggatccatctctagccaaatcacaccccagagccagaggcctggggacctccttgccttccccgtcccccacagcaaggtcaacactactacgccttagccacccgtcaccctgctgactgcgacttccctctgcagcacagggcaggcagccacctatgccccacaagacggaacccgggaggggagtagagggcaccagggaatgctgtgagggacttcagggtgggcaaatgcagaagggagccagtgtcgcccctaccccatcccacagccatttttctctcgggttctacccaccactgtgtcggatttttcttaaataaatggaagcggtcagactggaggtgggggcagcagctcccatgaacagagagtacatgg

SEQ ID NO: 75755 - DNA, 425 bp, Homo sapiens
  misc_feature (283)..(283): n is a, c, g, or t
  misc_feature (307)..(307): n is a, c, g, or t
ccctagatctcaataaggaatagcccaataaaaactggcaaaattggcggggcatggtggcttacacgcctgtaatcctagcgctttgggaggctgaggcaggtggatcacgaggtcaggagatagagaccagcgtggccaacatggtgaaaccccatctctactactaaaaatacgaaaaagtagcagggcgtggtggtgcatacctgtaatcccagctactcaggagactgagacaggagaatcgcctgaacccaggaggcagaggttgcagtgagctganattgtgccaccacactccagctgnggcaatagagcatcttctcttcaggctttctgacttcaggtggggacaggaagtgacaaagatggtttgattgaaaagccaggaagttagctcaggtgtggtggctcacgcctgtaat

SEQ ID NO: 75756 - DNA, 459 bp, Homo sapiens
gtcccccgccactattgtgtgtgtgtgtgtgtgtgtgttggtctcactgtcactcaggctggaatacagtggcccaatcctaactcactgcagtctcaaactcctggggttcaagcaatcctcttgccttagcttcccaagtagctgcgactgcagacatgtaccaccatgcctggctacttttttaatttttgtagagatggtgtctcactatgtttaccaggctggtcctggactcctggcctcaagtgatcttccatggcacttggcctctcactctctttttccttggggaaagggcagagtgatggtgctatagtggcttccatctgcaaagccaggacaggcaggcatcttctcttcaggctttctgacttcaggtggggacaggaagtgacaaagatggtttgattgaaaagccaggaagttagctcaggtgtggtggctcacgcctgtaat

SEQ ID NO: 75757 - DNA, 427 bp, Homo sapiens
tgaagaagacaattatgatggataaattggttctattgcagtttttttcttgtctataaagcagctgtccccggcctttttggcaccagggaccagtttcatggcagacagtttttccatggtgggtggggtatggtttcaggatgattcaagtgcattacatttatcatttgattattataaggagtgtgcaaactagacacctcacatgcgcagttcacaatagggttcacgtgcctttgagaatctaatgccaccactgatctgacaggaggcagaactcaggtggtaatgcttacttgcccactgcagctcaccttctgctttgcagcccagttcctaacaggccatagactcttgggttgggggtgactgaggacccctgctataaagcattaagccccttgtacacaattcactcctttta

SEQ ID NO: 75758 - DNA, 221 bp, Homo sapiens
gtggatcactactattgttttttttactgttacttttaagtataagtttccaactttatgaacatttctaatatttcaatgtgtttaccatttatataaaacataagcattatattttattagatgtgtatcccaattgtgctgcttattttccctttgttgaaccaaaatgtcttaaggaataaatgtgaaacagtttcctattttaaatttgaacaccg

SEQ ID NO: 75759 - DNA, 421 bp, Homo sapiens
ggcagacacctgtaatcccagctacttgggaggcagaaggtggagaatcacttaaacctggcaggcggaggttgcagtgagctgagagtgcaccattgcactctagtctgggtgacgagtggaactccgtctcaaaaacaaagaaaaacagaaaagaaaatccctaactcctaacttgtttgctataataagttatatattgatgtttattcactgcttaaatgaagcaaattaaaataatctttaatttttaaatcccttaatgttatattaattgattaactatcattctgttacccaacagtatacttgaccaatgtttttaacataaaggactactttacagaaaacaaacttacgaatattaagcagcagctgtttgaagtattcatttacttgataggttttattaatatgtgtg

SEQ ID NO: 75760 - DNA, 494 bp, Homo sapiens
  misc_feature (489)..(489): n is a, c, g, or t
tagaggatccccctagttttagaagtttcaatagcaccatgacggaactagagacagccatgggcatgatcatagacgtcttttcccgatattcgggcagcgagggcagcacgcagaccctgaccaagggggagctcaaggtgctgatggagaaggagctaccaggcttcctgcagagtggaaaagacaaggatgccgtggataaattgctcaaggacctggacgccaatggagatgcccaggtggacttcagtgagttcatcgtgttcgtggctgcaatcacgtctgcctgtcacaagtactttgagaaggcaggactcaaatgatgccctggagatgtcacagattcctggcagagccatggtcccaggcttcccaaaagtgtttgttggcaattattcccctaggctgagcctgctcatgtacctctgattaataaatgcttatgaaatgacttctaaaactaggggtacaggctcgattcgtatntgtta

SEQ ID NO: 75761 - DNA, 561 bp, Homo sapiens
  misc_feature (556)..(556): n is a, c, g, or t
ctgtgtcaatatgaggctgccttataaagcaccaagaggctgccagtgggacattttctcggccctgccagcccccaggaggaaggtgggtctgaatctagcaccatgacggaactagagacagccatgggcatgatcatagacgtcttttcccgatattcgggcagcgagggcagcacgcagaccctgaccaagggggagctcaaggtgctgatggagaaggagctaccaggcttcctgcagagtggaaaagacaaggatgccgtggataaattgctcaaggacctggacgccaatggagatgcccaggtggacttcagtgagttcatcgtgttcgtggctgcaatcacgtctgcctgtcacaagtactttgagaaggcaggactcaaatgatgccctggagatgtcacagattcctggcagagccatggtcccaggcttcccaaaagtgtttgttggcaattattcccctaggctgagcctgctcatgtacctctgattaataaatgcttatgaaatgacttctaaaactaggggtacaggctcgattcgtatntgtta

SEQ ID NO: 75762 - DNA, 897 bp, Homo sapiens
tagaggatccccctagttttagaagtttcaatagcattttctcggccctgccagcccccaggaggaaggtgggtctgaatctagcaccatgacggaactagagacagccatgggcatgatcatagacgtcttttcccgatattcgggcagcgagggcagcacgcagaccctgaccaagggggagctcaaggtgctgatggagaaggagctaccaggcttcctgcagagtggaaaagacaaggatgccgtggataaattgctcaaggacctggacgccaatggagatgcccaggtggacttcagtgagttcatcgtgttcgtggctgcaatcacgtctgcctgtcacaagtactttgagaaggcaggactcaaatgatgccctggagatgtcacagattcctggcagagccatggtcccaggcttcccaaaagtgtttgttggcaattattcccctaggctgagcctgctcatgtacctctgattaataaatgcttatgaaatgaacttctcctggtctcagagaaactggttatttccttaaaacctcagtgtcctctccccacaaaacagaattcactaattaaacttgtcatttcattactcattgcctgcctgcagtggtgagacagatgaagaagacaaggcagtcgataaaaatccatttgttggccatcttctgagtgcccactgagacacagtcccacctttggccgtgtgaatgccaccatgtcctggacccaagggaggctcgggtacacacatccatgtatttattcatctacttcgtaattcatttagtcggtcacgtagccactcattgaacctgggcccctccatctctccaaacagcatgttttcttcaagtaacatactgtttggagagtctccgtcgaact

SEQ ID NO: 75763 - DNA, 497 bp, Homo sapiens
  misc_feature (21)..(21): n is a, c, g, or t
tcagagctcggtaccatctgntcgaccaggaggaaggtgggtctgaatctagcaccatgacggaactagagacagccatgggcatgatcatagacgtcttttcccgatattcgggcagcgagggcagcacgcagaccctgaccaagggggagctcaaggtgctgatggagaaggagctaccaggcttcctgcagagtggaaaagacaaggatgccgtggataaattgctcaaggacctggacgccaatggagatgcccaggtggacttcagtgagttcatcgtgttcgtggctgcaatcacgtctgcctgtcacaagtactttgagaaggcaggactcaaatgatgccctggagatgtcacagattcctggcagagccatggtcccaggcttcccaaaagtgtttgttggcaattattcccctaggctgagcctgctcatgtacctctgattaataaatgcttatgaaatgaaaaaaaaaaaacaaagaaaaaaaaa

SEQ ID NO: 75764 - DNA, 495 bp, Homo sapiens
cagctcgtacccaattagcatggccaggaggaaggtgggtctgaatctagcaccatgacggaactagagacagccatgggcatgatcatagacgtcttttcccgatattcgggcagcgagggcagcacgcagaccctgaccaagggggagctcaaggtgctgatggagaaggagctaccaggcttcctgcagagtggaaaagacaaggatgccgtggataaattgctcaaggacctggacgccaatggagatgcccaggtggacttcagtgagttcatcgtgttcgtggctgcaatcacgtctgcctgtcacaagtactttgagaaggcaggactcaaatgatgccctggagatgtcacagattcctggcagagccatggtcccaggcttcccaaaagtgtttgttggcaattattcccctaggctgagcctgctcatgtacctctgattaataaatgcttatgaaatgaaaaaaaaaaaacaaagaaaaaaaaa

SEQ ID NO: 75765 - DNA, 664 bp, Homo sapiens
gcaaagactggatgcatttcctgagaacaaccatcactgtaaagcactttacaaatccaaagacaacccccggcaaaaactcaaaatgaaactccctctcgcagagcacaattccaattcgctctaaaaacattacaagttagttcatgtcatgccagatagctgaaggcagctcacaagttcttaaggccaggaatgccatgtgtctgctatgcacagctggccctggccctgagcctgaatgacagcaaaggtgacgcagatgtgggtgccctgctcctgcccagcagcagtgcttggtggaggctgaggccctgcacaggcaccctcactgctgaccttgagcctctctctcctctagagtggaaaagacaaggatgccgtggataaattgctcaaggacctggacgccaatggagatgcccaggtggacttcagtgagttcatcgtgttcgtggctgcaatcacgtctgcctgtcacaagtactttgagaaggcaggactcaaatgatgccctggagatgtcacagattcctggcagagccatggtcccaggcttcccaaaagtgtttgttggcaattattcccctaggctgagcctgctcatgtacctctgattaataaatgcttatgaaatgaaaaaaaaaaaacaaagaaaaaaaaa

SEQ ID NO: 75766 - DNA, 263 bp, Homo sapiens
tagaggatccccctagttttagaagtttcaatagcacctagttataaagtccccaggctgcaatcacgtctgcctgtcacaagtactttgagaaggcaggactcaaatgatgccctggagatgtcacagattcctggcagagccatggtcccaggcttcccaaaagtgtttgttggcaattattcccctaggctgagcctgctcatgtacctctgattaataaatgcttatgaaatgaaaaaaaaaaaacaaagaaaaaaaaa

SEQ ID NO: 75767 - DNA, 546 bp, Homo sapiens
ctgtgtcaatatgaggctgccttataaagcaccaagaggctgccagtgggacattttctcggccctgccagcccccaggaggaaggtgggtctgaatctagcaccatgacggaactagagacagccatgggcatgatcatagacgtcttttcccgatattcgggcagcgagggcagcacgcagaccctgaccaagggggagctcaaggtgctgatggagaaggagctaccaggcttcctgcagagtggaaaagacaaggatgccgtggataaattgctcaaggacctggacgccaatggagatgcccaggtggacttcagtgagttcatcgtgttcgtggctgcaatcacgtctgcctgtcacaagtactttgagaaggcaggactcaaatgatgccctggagatgtcacagattcctggcagagccatggtcccaggcttcccaaaagtgtttgttggcaattattcccctaggctgagcctgctcatgtacctctgattaataaatgcttatgaaatgaaaaaaaaaaaacaaagaaaaaaaaa

SEQ ID NO: 75768 - DNA, 914 bp, Homo sapiens
ctgtgtcaatatgaggctgccttataaagcaccaagaggctgccagtgggacattttctcggccctgccagcccccaggaggaaggtgggtctgaatctagcaccatgacggaactagagacagccatgggcatgatcatagacgtcttttcccgatattcgggcagcgagggcagcacgcagaccctgaccaagggggagctcaaggtgctgatggagaaggagctaccaggcttcctgcagagtggaaaagacaaggatgccgtggataaattgctcaaggacctggacgccaatggagatgcccaggtggacttcagtgagttcatcgtgttcgtggctgcaatcacgtctgcctgtcacaagtactttgagaaggcaggactcaaatgatgccctggagatgtcacagattcctggcagagccatggtcccaggcttcccaaaagtgtttgttggcaattattcccctaggctgagcctgctcatgtacctctgattaataaatgcttatgaaatgaacttctcctggtctcagagaaactggttatttccttaaaacctcagtgtcctctccccacaaaacagaattcactaattaaacttgtcatttcattactcattgcctgcctgcagtggtgagacagatgaagaagacaaggcagtcgataaaaatccatttgttggccatcttctgagtgcccactgagacacagtcccacctttggccgtgtgaatgccaccatgtcctggacccaagggaggctcgggtacacacatccatgtatttattcatctacttcgtaattcatttagtcggtcacgtagccactcattgaacctgggcccctccatctctccaaacagcatgttttcttcaagtaacatactgtttggagagtctccgtcgaact

SEQ ID NO: 75769 - DNA, 500 bp, Homo sapiens
cccactccagagtatccccgaaacacagccaggaggaaggtgggtctgaatctagcaccatgacggaactagagacagccatgggcatgatcatagacgtcttttcccgatattcgggcagcgagggcagcacgcagaccctgaccaagggggagctcaaggtgctgatggagaaggagctaccaggcttcctgcagagtggaaaagacaaggatgccgtggataaattgctcaaggacctggacgccaatggagatgcccaggtggacttcagtgagttcatcgtgttcgtggctgcaatcacgtctgcctgtcacaagtactttgagaaggcaggactcaaatgatgccctggagatgtcacagattcctggcagagccatggtcccaggcttcccaaaagtgtttgttggcaattattcccctaggctgagcctgctcatgtacctctgattaataaatgcttatgaaatgaaaaaaaaaaaacaaagaaaaaaaaa

SEQ ID NO: 75770 - DNA, 616 bp, Homo sapiens
acacccctccccacatcaagcccgaatgatatttcctattcgcctacacaattctccgatccgtccctaacaaactaggaggcgtcccttgccctattactatccatcctcatcctagcaataatcgccggtcacgagatatctcgtgaccggcgattatatctgaatatggaccatgacggaactagagacagccatgggcatgatcatagacgtcttttcccgatattcgggcagcgagggcagcacgcagaccctgaccaagggggagctcaaggtgctgatggagaaggagctaccaggcttcctgcagagtggaaaagacaaggatgccgtggataaattgctcaaggacctggacgccaatggagatgcccaggtggacttcagtgagttcatcgtgttcgtggctgcaatcacgtctgcctgtcacaagtactttgagaaggcaggactcaaatgatgccctggagatgtcacagattcctggcagagccatggtcccaggcttcccaaaagtgtttgttggcaattattcccctaggctgagcctgctcatgtacctctgattaataaatgcttatgaaatgaaaaaaaaaaaacaaagaaaaaaaaa

SEQ ID NO: 75771 - DNA, 4650 bp, Homo sapiens
cgttttcttcgttgcgtacgattgtgctccgttggtgttctcagcagggatctgattctatcgcccaggaccacaccgcagcgtaactgcaggcctctcagcgaaaaagggggaaagcaaagacccgggtgtgcatcctcttcctcggcttccgcccctttccggcggagtggagatcctattcagaggggccggtctctctaaatatgccccaggatgaccgagcggccgccgagcgaggcggctcgcagtgacccccagctagagggacgggacgcggccgaggccagcatggcccccccgcacctggtcctgctgaacggcgtcgccaaggagacgagccgcgcggccgcagcggagcccccagtcatcgaactgggcgcgcgcggaggcccggggggcggccctgccggtgggggcggcgccgcgagagacttaaagggccgcgacgcggcgacggccgaagcgcgccatcgggtgcccaccaccgagctgtgcagacctcccgggcccgccccggcccccgcgcccgcctcggttacagcggagctgcccggcgacggccgcatggtgcagctgagtcctcccgcgctggctgcccccgccgcccccggccgcgcgctgctctacagcctcagccagccgctggcctctctcggcagcgggttctttggggagccggatgccttccctatgttcaccaccaacaatcgagtgaagaggagaccttccccctatgagatggagattactgatggtccccacaccaaagttgtgcggcgtatcttcaccaacagccgggagcgatggcggcagcagaatgtgaacggggcctttgccgagctccgcaagctgatccccacacatcccccggacaagaagctcagcaagaatgagatcctccgcctggccatgaagtatatcaacttcttggccaagctgctcaatgaccaggaggaggagggcacccagcgggccaagactggcaaggaccctgtggtgggggctggtgggggtggaggtgggggagggggcggcgcgcccccagatgacctcctgcaagacgtgctttcccccaactccagctgcggcagctccctggatggggcagccagcccggacagctacacggaggagcccgcgcccaagcacacggcccgcagcctccatcctgccatgctgcctgccgccgatggagccggccctcggtgatgggtctgggccaccaggatcagccaggagggcgttcttaggctgctgggatggtgggcttcagggcaggtggggtgagaattgggcggctctgaagcaaggcggtggacttgaactttcctggatgtctgaactttgggaagcctttactgaccctggggctggcttttctgtttcctgtaccagtaggagatcagaaaaatggagcaaagtggtaggtactttttgtgaagacggcacggtcttccctcttccctcagtcccaaatccttcccaagtaagaggctggagttgtcactgcttttggcctggagtttgggatccctgtctttcctaagacctggggttgtcagctctcatctgaggcatccagcagtctctgccttgcctttagcccctcccaagctggctggggtggcctgtgtggccacttctgtccatatttataggtacccaatagctgcccatttcgtgagccccatcttcacccaggcctatgttgatccatccagcttgccagatgctgcagagtcacaagcctcgaggtgccttcttcagggcctggttgaagaagatgatcagtggacagtctgctctagatgagctgggccggagggtcaggaaacccagtcgcccttacttcttgccctggggatcaaagttctgctttctccccaatgagacttgccttcctaagcctgtggctgtggagaccatgtctgcagccctgagaaagccctgtcgggctttgtgtgaaggcagagaaagggacaatgatagtagagtgatatggagcaagagatattttgggcatgtgggcttcaactcctcgacatcactgttcatgctggcgagtgaatgccagtgtgctgatgggcgtacgctggtgctgagtagatgcgcagccccatctgtgcattctcctggatgcttagagggatttctttgctgtaagatgtctgtttgctgatggtctggtctatgttccgaattgagcacaaaacctgtcctatgaatgctttgcatttggaatttttgcttgacttcagttattggtggaatctttagcgctcaataggaccaggatccagcctcacttctagggtatgggaaatccaatcagagaccaggccctggctaagacccaaacatatgcacattcacttagcagaaccttaaacacccctcagttgtgcagcttttggtcatcaagggtgcgtctgggaggttggtttaatgcaatagaagtgctcccctctgaaagttgtacatgaaatttttgtaaatcacatccttatccttcatcttttaaagaaataaccactgcaagtccttttgtaaagtgaagaatccttttgtagaatgaaccactgccccttcattgatttcctgtgtcaatccagatggtgggatgtggttttcttaaggtgaggcctgtctgtgacctgcatctaagcccatgggacaaattgcacagaagtcctgtatgtctgtcattgtacccttaagtcaccctagccctctccctctaggctctgccttcgaggtcagaggagagatagcctgtggccctgtcctgccatgcaagaactcatcactgtggctgtctggaaagcccccccttatagtttgggcttcagcctagtggcttgtcctcaccatgatggggccctaattcagccatgtacagacagagaatatgtctgctcctttccccttccttttaagtaaggtccaattctcgagcttggggcaacattgttcacctttgtagcactcaggctctccattcaatttcaggctccccagatcatgttttggtgaaaattagggttggttcctttccaacgtttggaagatcctgtgaggagccccatctgtctaaagatagagtcattgctgtaggatctaaggctgtttgcttcaccgtggattcgcttgagttaggaatgagaagtagccacagtatggatgggtggatgggttttatgagatggatcacatattttattaagaactcaaacttctggctccctcttctttcagacttgccatgtgactctggcttggcctatctcctagggctatggtgtggactgaatgggatcatgaaagtagacagttttgagaacgtaaagaactttttcttttccctcaatctcaatcctgcagtggggtttcgcagcctgagtccacgacctaggcagtaggccggtgtgcctgactgcccagcatttgggtaatttagattgtaaaccgctttggcctgagttattgagattgtcctcatttctccagattatctatttgtgtgtgtgtgtgtgtgtgtgtgagagacggtgtcttgttctgtcactcaggctggagtacagtggtgccatcattgctgtctgcagccttgaactctgggctcaagcaatcctctcacctcagcctcccgagtagggaggaccacaggtgtgagccaccacacctggctaatttttacttttttttttttttggtagagatggagtcttgctatattgcccaggctggtcttgaagtcctggcttcaggcaattctcctgcctttgcctccagaagcactgggatcacaggtgtcagccattgcacccagcccagattgtcttaatttctatcttgttccaaggccagggacagtaataagaatggaaaagagatatgggaacactggcagactgtgtaaaatgtaatgcaactacccaaaacaagcctggtaggaaagggcaagtctttaggtctttgtaagaactaaagaagatctgtaatttttattttcaccctctgtaccccatgaccttatccttcctctccttccttgttacccatgaaaaactggcaacattccaagaatagcatctgtacaaaggggaaagaacataaaggtaaaacaaaacaaaacaacattttgagaacaaagatgaccataaccactgaagggaatcacatcttttaagacaaattcatattcttttatttgttatggcagatgacaagatggtacaacctttattcttttccaaaataaaacaaagggcacagcatctgtagtcagccgacaactatttcggccttttgggggtgggtctggccgtacttgtgatttcgatggtacgtgaccctctgctgaagacttgccccctgcccgtgtacatagtgcattgtttctgtgggcgggcccagcactttccgtcaacgttgtactgtatgtgatgaattgcgttggtctctgcatttttctgcagaagaggagtaaccgctccaggtaccttgacctttgtacagcccagaggccaacactgtgggtgtgtgactctttagcaaaaaaaacccatgtggtgatgatgtgtctatatatgtgaggatgtatcgggaagatttctaaataaaagttttacaaaggggaaaaaaaaa

SEQ ID NO: 75772 - DNA, 507 bp, Homo sapiens
tgggccctgatcccaggcctgaggcctagggtggggaggcaggaacacccctcttctccggtagaggcgaggatggtggtgctgttccctggtgggtttggtacttgtgcaggcttggggcttctccagggtgttgtgctggtgtgggcccagaagagagaccagaggctgggtctaagggcctgaggctgttttcatctaagaaattctctgtatgggggattgggtctgcttgagacctgtccccaggaagaatctcctggggtcttctgtcttgttctggcacaggtggaaatattctggctgtctggcaactgcagatgaggatttcctgttgggggctataagcagggtctccgtagtacaaagagagaggagctgtagtcgtcaaatactctagaacgattcagtctaaaatctccctcctccttcattctccccaaataaaaacaaacaaaatctctcgggcgttcctttctgtaatccaaatcaagtgatgcagcttag

SEQ ID NO: 75773 - DNA, 547 bp, Homo sapiens
tcggcggctgctctgcccggaggcccgcctgtgcctaggtgtttgaggggttcgttggtgagtgggaggctcctccaggcttgaagctgagcagcgctcgccgaggccggcgccttcgagccggtagctgcgggcttcggttcccgctgcactccggcttcatccatttctgatcgcccaggaccacaccgcagcgtaactgcaggcctctcagcgaaaaagggggaaagcaaagacccgggtgtgcatcctcttcctcggcttccgcccctttccggcggagtggagatcctattcagaggggccggtctctctaaatatgccccaggtggaaatattctggctgtctggcaactgcagatgaggatttcctgttgggggctataagcagggtctccgtagtacaaagagagaggagctgtagtcgtcaaatactctagaacgattcagtctaaaatctccctcctccttcattctccccaaataaaaacaaacaaaatctctcgggcgttcctttctgtaatccaaatcaagtgatgcagcttag

SEQ ID NO: 75774 - DNA, 4434 bp, Homo sapiens
cgctcaggaccgggcctcaaaatggccacacgcgtacccccgtagcggaaaaacatcgcccaggaccacaccgcagcgtaactgcaggcctctcagcgaaaaagggggaaagcaaagacccgggtgtgcatcctcttcctcggcttccgcccctttccggcggagtggagatcctattcagaggggccggtctctctaaatatgccccagcgggttctttggggagccggatgccttccctatgttcaccaccaacaatcgagtgaagaggagaccttccccctatgagatggagattactgatggcactgaccctcagggattccctgcacttcctcccaagtcttccttagagtctggagtctgcttcctccctgcaatggagtcatcaagggttttctccgaggtccctacacagtaggctccccttgtctcccgttaacacattctgggcttagacctggagttcccttcctgacatcatggattctaccttgccccctggattccccgagaagggccttggcactgctcctttgaggtccccacaccaaagttgtgcggcgtatcttcaccaacagccgggagcgatggcggcagcagaatgtgaacggggcctttgccgagctccgcaagctgatccccacacatcccccggacaagaagctcagcaagaatgagatcctccgcctggccatgaagtatatcaacttcttggccaagctgctcaatgaccaggaggaggagggcacccagcgggccaagactggcaaggaccctgtggtgggggctggtgggggtggaggtgggggagggggcggcgcgcccccagatgacctcctgcaagacgtgctttcccccaactccagctgcggcagctccctggatggggcagccagcccggacagctacacggaggagcccgcgcccaagcacacggcccgcagcctccatcctgccatgctgcctgccgccgatggagccggccctcggtgatgggtctgggccaccaggatcagccaggagggcgttcttaggctgctgggatggtgggcttcagggcaggtggggtgagaattgggcggctctgaagcaaggcggtggacttgaactttcctggatgtctgaactttgggaagcctttactgaccctggggctggcttttctgtttcctgtaccagtaggagatcagaaaaatggagcaaagtggtaggtactttttgtgaagacggcacggtcttccctcttccctcagtcccaaatccttcccaagtaagaggctggagttgtcactgcttttggcctggagtttgggatccctgtctttcctaagacctggggttgtcagctctcatctgaggcatccagcagtctctgccttgcctttagcccctcccaagctggctggggtggcctgtgtggccacttctgtccatatttataggtacccaatagctgcccatttcgtgagccccatcttcacccaggcctatgttgatccatccagcttgccagatgctgcagagtcacaagcctcgaggtgccttcttcagggcctggttgaagaagatgatcagtggacagtctgctctagatgagctgggccggagggtcaggaaacccagtcgcccttacttcttgccctggggatcaaagttctgctttctccccaatgagacttgccttcctaagcctgtggctgtggagaccatgtctgcagccctgagaaagccctgtcgggctttgtgtgaaggcagagaaagggacaatgatagtagagtgatatggagcaagagatattttgggcatgtgggcttcaactcctcgacatcactgttcatgctggcgagtgaatgccagtgtgctgatgggcgtacgctggtgctgagtagatgcgcagccccatctgtgcattctcctggatgcttagagggatttctttgctgtaagatgtctgtttgctgatggtctggtctatgttccgaattgagcacaaaacctgtcctatgaatgctttgcatttggaatttttgcttgacttcagttattggtggaatctttagcgctcaataggaccaggatccagcctcacttctagggtatgggaaatccaatcagagaccaggccctggctaagacccaaacatatgcacattcacttagcagaaccttaaacacccctcagttgtgcagcttttggtcatcaagggtgcgtctgggaggttggtttaatgcaatagaagtgctcccctctgaaagttgtacatgaaatttttgtaaatcacatccttatccttcatcttttaaagaaataaccactgcaagtccttttgtaaagtgaagaatccttttgtagaatgaaccactgccccttcattgatttcctgtgtcaatccagatggtgggatgtggttttcttaaggtgaggcctgtctgtgacctgcatctaagcccatgggacaaattgcacagaagtcctgtatgtctgtcattgtacccttaagtcaccctagccctctccctctaggctctgccttcgaggtcagaggagagatagcctgtggccctgtcctgccatgcaagaactcatcactgtggctgtctggaaagcccccccttatagtttgggcttcagcctagtggcttgtcctcaccatgatggggccctaattcagccatgtacagacagagaatatgtctgctcctttccccttccttttaagtaaggtccaattctcgagcttggggcaacattgttcacctttgtagcactcaggctctccattcaatttcaggctccccagatcatgttttggtgaaaattagggttggttcctttccaacgtttggaagatcctgtgaggagccccatctgtctaaagatagagtcattgctgtaggatctaaggctgtttgcttcaccgtggattcgcttgagttaggaatgagaagtagccacagtatggatgggtggatgggttttatgagatggatcacatattttattaagaactcaaacttctggctccctcttctttcagacttgccatgtgactctggcttggcctatctcctagggctatggtgtggactgaatgggatcatgaaagtagacagttttgagaacgtaaagaactttttcttttccctcaatctcaatcctgcagtggggtttcgcagcctgagtccacgacctaggcagtaggccggtgtgcctgactgcccagcatttgggtaatttagattgtaaaccgctttggcctgagttattgagattgtcctcatttctccagattatctatttgtgtgtgtgtgtgtgtgtgtgtgagagacggtgtcttgttctgtcactcaggctggagtacagtggtgccatcattgctgtctgcagccttgaactctgggctcaagcaatcctctcacctcagcctcccgagtagggaggaccacaggtgtgagccaccacacctggctaatttttacttttttttttttttggtagagatggagtcttgctatattgcccaggctggtcttgaagtcctggcttcaggcaattctcctgcctttgcctccagaagcactgggatcacaggtgtcagccattgcacccagcccagattgtcttaatttctatcttgttccaaggccagggacagtaataagaatggaaaagagatatgggaacactggcagactgtgtaaaatgtaatgcaactacccaaaacaagcctggtaggaaagggcaagtctttaggtctttgtaagaactaaagaagatctgtaatttttattttcaccctctgtaccccatgaccttatccttcctctccttccttgttacccatgaaaaactggcaacattccaagaatagcatctgtacaaaggggaaagaacataaaggtaaaacaaaacaaaacaacattttgagaacaaagatgaccataaccactgaagggaatcacatcttttaagacaaattcatattcttttatttgttatggcagatgacaagatggtacaacctttattcttttccaaaataaaacaaagggcacagcatctgtagtcagccgacaactatttcggccttttgggggtgggtctggccgtacttgtgatttcgatggtacgtgaccctctgctgaagacttgccccctgcccgtgtacatagtgcattgtttctgtgggcgggcccagcactttccgtcaacgttgtactgtatgtgatgaattgcgttggtctctgcatttttctgcagaagaggagtaaccgctccaggtaccttgacctttgtacagcccagaggccaacactgtgggtgtgtgactctttagcaaaaaaaacccatgtggtgatgatgtgtctatatatgtgaggatgtatcgggaagatttctaaataaaagttttacaaaggggaaaaaaaaa

SEQ ID NO: 75775 - DNA, 5011 bp, Homo sapiens
gcccgggactatcccttcgcggtgtagcggcagccggagacctggctgaggaggcaaccgcgtagacacctccctgcttagaaaacaaacactgaaccagaccgatcccagttggagggttcgaaaatgttccagacagcctgtcgggaggggttgttgttgctgttggactaaatagctattcctgattggtcatgtatagggttttttaaggcgggtggggggaggagggggtagaggaaaggctccaaacacctgcaggttgggggcggaaagctgtttgcgattccctggactggttggtcggggacaggaggtaattcccagccattgacccccatttctctctctccctccctcttgccctgcctctttctctccacccctatctttcctggaaactcgctttgggcgcggcagatcgcccaggaccacaccgcagcgtaactgcaggcctctcagcgaaaaagggggaaagcaaagacccgggtgtgcatcctcttcctcggcttccgcccctttccggcggagtggagatcctattcagaggggccggtctctctaaatatgccccaggatgaccgagcggccgccgagcgaggcggctcgcagtgacccccagctagagggacgggacgcggccgaggccagcatggcccccccgcacctggtcctgctgaacggcgtcgccaaggagacgagccgcgcggccgcagcggagcccccagtcatcgaactgggcgcgcgcggaggcccggggggcggccctgccggtgggggcggcgccgcgagagacttaaagggccgcgacgcggcgacggccgaagcgcgccatcgggtgcccaccaccgagctgtgcagacctcccgggcccgccccggcccccgcgcccgcctcggttacagcggagctgcccggcgacggccgcatggtgcagctgagtcctcccgcgctggctgcccccgccgcccccggccgcgcgctgctctacagcctcagccagccgctggcctctctcggcagcgggttctttggggagccggatgccttccctatgttcaccaccaacaatcgagtgaagaggagaccttccccctatgagatggagattactgatggtccccacaccaaagttgtgcggcgtatcttcaccaacagccgggagcgatggcggcagcagaatgtgaacggggcctttgccgagctccgcaagctgatccccacacatcccccggacaagaagctcagcaagaatgagatcctccgcctggccatgaagtatatcaacttcttggccaagctgctcaatgaccaggaggaggagggcacccagcgggccaagactggcaaggaccctgtggtgggggctggtgggggtggaggtgggggagggggcggcgcgcccccagatgacctcctgcaagacgtgctttcccccaactccagctgcggcagctccctggatggggcagccagcccggacagctacacggaggagcccgcgcccaagcacacggcccgcagcctccatcctgccatgctgcctgccgccgatggagccggccctcggtgatgggtctgggccaccaggatcagccaggagggcgttcttaggctgctgggatggtgggcttcagggcaggtggggtgagaattgggcggctctgaagcaaggcggtggacttgaactttcctggatgtctgaactttgggaagcctttactgaccctggggctggcttttctgtttcctgtaccagtaggagatcagaaaaatggagcaaagtggtaggtactttttgtgaagacggcacggtcttccctcttccctcagtcccaaatccttcccaagtaagaggctggagttgtcactgcttttggcctggagtttgggatccctgtctttcctaagacctggggttgtcagctctcatctgaggcatccagcagtctctgccttgcctttagcccctcccaagctggctggggtggcctgtgtggccacttctgtccatatttataggtacccaatagctgcccatttcgtgagccccatcttcacccaggcctatgttgatccatccagcttgccagatgctgcagagtcacaagcctcgaggtgccttcttcagggcctggttgaagaagatgatcagtggacagtctgctctagatgagctgggccggagggtcaggaaacccagtcgcccttacttcttgccctggggatcaaagttctgctttctccccaatgagacttgccttcctaagcctgtggctgtggagaccatgtctgcagccctgagaaagccctgtcgggctttgtgtgaaggcagagaaagggacaatgatagtagagtgatatggagcaagagatattttgggcatgtgggcttcaactcctcgacatcactgttcatgctggcgagtgaatgccagtgtgctgatgggcgtacgctggtgctgagtagatgcgcagccccatctgtgcattctcctggatgcttagagggatttctttgctgtaagatgtctgtttgctgatggtctggtctatgttccgaattgagcacaaaacctgtcctatgaatgctttgcatttggaatttttgcttgacttcagttattggtggaatctttagcgctcaataggaccaggatccagcctcacttctagggtatgggaaatccaatcagagaccaggccctggctaagacccaaacatatgcacattcacttagcagaaccttaaacacccctcagttgtgcagcttttggtcatcaagggtgcgtctgggaggttggtttaatgcaatagaagtgctcccctctgaaagttgtacatgaaatttttgtaaatcacatccttatccttcatcttttaaagaaataaccactgcaagtccttttgtaaagtgaagaatccttttgtagaatgaaccactgccccttcattgatttcctgtgtcaatccagatggtgggatgtggttttcttaaggtgaggcctgtctgtgacctgcatctaagcccatgggacaaattgcacagaagtcctgtatgtctgtcattgtacccttaagtcaccctagccctctccctctaggctctgccttcgaggtcagaggagagatagcctgtggccctgtcctgccatgcaagaactcatcactgtggctgtctggaaagcccccccttatagtttgggcttcagcctagtggcttgtcctcaccatgatggggccctaattcagccatgtacagacagagaatatgtctgctcctttccccttccttttaagtaaggtccaattctcgagcttggggcaacattgttcacctttgtagcactcaggctctccattcaatttcaggctccccagatcatgttttggtgaaaattagggttggttcctttccaacgtttggaagatcctgtgaggagccccatctgtctaaagatagagtcattgctgtaggatctaaggctgtttgcttcaccgtggattcgcttgagttaggaatgagaagtagccacagtatggatgggtggatgggttttatgagatggatcacatattttattaagaactcaaacttctggctccctcttctttcagacttgccatgtgactctggcttggcctatctcctagggctatggtgtggactgaatgggatcatgaaagtagacagttttgagaacgtaaagaactttttcttttccctcaatctcaatcctgcagtggggtttcgcagcctgagtccacgacctaggcagtaggccggtgtgcctgactgcccagcatttgggtaatttagattgtaaaccgctttggcctgagttattgagattgtcctcatttctccagattatctatttgtgtgtgtgtgtgtgtgtgtgtgagagacggtgtcttgttctgtcactcaggctggagtacagtggtgccatcattgctgtctgcagccttgaactctgggctcaagcaatcctctcacctcagcctcccgagtagggaggaccacaggtgtgagccaccacacctggctaatttttacttttttttttttttggtagagatggagtcttgctatattgcccaggctggtcttgaagtcctggcttcaggcaattctcctgcctttgcctccagaagcactgggatcacaggtgtcagccattgcacccagcccagattgtcttaatttctatcttgttccaaggccagggacagtaataagaatggaaaagagatatgggaacactggcagactgtgtaaaatgtaatgcaactacccaaaacaagcctggtaggaaagggcaagtctttaggtctttgtaagaactaaagaagatctgtaatttttattttcaccctctgtaccccatgaccttatccttcctctccttccttgttacccatgaaaaactggcaacattccaagaatagcatctgtacaaaggggaaagaacataaaggtaaaacaaaacaaaacaacattttgagaacaaagatgaccataaccactgaagggaatcacatcttttaagacaaattcatattcttttatttgttatggcagatgacaagatggtacaacctttattcttttccaaaataaaacaaagggcacagcatctgtagtcagccgacaactatttcggccttttgggggtgggtctggccgtacttgtgatttcgatggtacgtgaccctctgctgaagacttgccccctgcccgtgtacatagtgcattgtttctgtgggcgggcccagcactttccgtcaacgttgtactgtatgtgatgaattgcgttggtctctgcatttttctgcagaagaggagtaaccgctccaggtaccttgacctttgtacagcccagaggccaacactgtgggtgtgtgactctttagcaaaaaaaacccatgtggtgatgatgtgtctatatatgtgaggatgtatcgggaagatttctaaataaaagttttacaaaggggaaaaaaaaa

SEQ ID NO: 75776 - DNA, 4163 bp, Homo sapiens
agtcagagtcactttctgtaaatggtacttaggtaggcgcgtccgcctcggttacagcggagctgcccggcgacggccgcatggtgcagctgagtcctcccgcgctggctgcccccgccgcccccggccgcgcgctgctctacagcctcagccagccgctggcctctctcggcagcgggttctttggggagccggatgccttccctatgttcaccaccaacaatcgagtgaagaggagaccttccccctatgagatggagattactgatggtccccacaccaaagttgtgcggcgtatcttcaccaacagccgggagcgatggcggcagcagaatgtgaacggggcctttgccgagctccgcaagctgatccccacacatcccccggacaagaagctcagcaagaatgagatcctccgcctggccatgaagtatatcaacttcttggccaagctgctcaatgaccaggaggaggagggcacccagcgggccaagactggcaaggaccctgtggtgggggctggtgggggtggaggtgggggagggggcggcgcgcccccagatgacctcctgcaagacgtgctttcccccaactccagctgcggcagctccctggatggggcagccagcccggacagctacacggaggagcccgcgcccaagcacacggcccgcagcctccatcctgccatgctgcctgccgccgatggagccggccctcggtgatgggtctgggccaccaggatcagccaggagggcgttcttaggctgctgggatggtgggcttcagggcaggtggggtgagaattgggcggctctgaagcaaggcggtggacttgaactttcctggatgtctgaactttgggaagcctttactgaccctggggctggcttttctgtttcctgtaccagtaggagatcagaaaaatggagcaaagtggtaggtactttttgtgaagacggcacggtcttccctcttccctcagtcccaaatccttcccaagtaagaggctggagttgtcactgcttttggcctggagtttgggatccctgtctttcctaagacctggggttgtcagctctcatctgaggcatccagcagtctctgccttgcctttagcccctcccaagctggctggggtggcctgtgtggccacttctgtccatatttataggtacccaatagctgcccatttcgtgagccccatcttcacccaggcctatgttgatccatccagcttgccagatgctgcagagtcacaagcctcgaggtgccttcttcagggcctggttgaagaagatgatcagtggacagtctgctctagatgagctgggccggagggtcaggaaacccagtcgcccttacttcttgccctggggatcaaagttctgctttctccccaatgagacttgccttcctaagcctgtggctgtggagaccatgtctgcagccctgagaaagccctgtcgggctttgtgtgaaggcagagaaagggacaatgatagtagagtgatatggagcaagagatattttgggcatgtgggcttcaactcctcgacatcactgttcatgctggcgagtgaatgccagtgtgctgatgggcgtacgctggtgctgagtagatgcgcagccccatctgtgcattctcctggatgcttagagggatttctttgctgtaagatgtctgtttgctgatggtctggtctatgttccgaattgagcacaaaacctgtcctatgaatgctttgcatttggaatttttgcttgacttcagttattggtggaatctttagcgctcaataggaccaggatccagcctcacttctagggtatgggaaatccaatcagagaccaggccctggctaagacccaaacatatgcacattcacttagcagaaccttaaacacccctcagttgtgcagcttttggtcatcaagggtgcgtctgggaggttggtttaatgcaatagaagtgctcccctctgaaagttgtacatgaaatttttgtaaatcacatccttatccttcatcttttaaagaaataaccactgcaagtccttttgtaaagtgaagaatccttttgtagaatgaaccactgccccttcattgatttcctgtgtcaatccagatggtgggatgtggttttcttaaggtgaggcctgtctgtgacctgcatctaagcccatgggacaaattgcacagaagtcctgtatgtctgtcattgtacccttaagtcaccctagccctctccctctaggctctgccttcgaggtcagaggagagatagcctgtggccctgtcctgccatgcaagaactcatcactgtggctgtctggaaagcccccccttatagtttgggcttcagcctagtggcttgtcctcaccatgatggggccctaattcagccatgtacagacagagaatatgtctgctcctttccccttccttttaagtaaggtccaattctcgagcttggggcaacattgttcacctttgtagcactcaggctctccattcaatttcaggctccccagatcatgttttggtgaaaattagggttggttcctttccaacgtttggaagatcctgtgaggagccccatctgtctaaagatagagtcattgctgtaggatctaaggctgtttgcttcaccgtggattcgcttgagttaggaatgagaagtagccacagtatggatgggtggatgggttttatgagatggatcacatattttattaagaactcaaacttctggctccctcttctttcagacttgccatgtgactctggcttggcctatctcctagggctatggtgtggactgaatgggatcatgaaagtagacagttttgagaacgtaaagaactttttcttttccctcaatctcaatcctgcagtggggtttcgcagcctgagtccacgacctaggcagtaggccggtgtgcctgactgcccagcatttgggtaatttagattgtaaaccgctttggcctgagttattgagattgtcctcatttctccagattatctatttgtgtgtgtgtgtgtgtgtgtgtgagagacggtgtcttgttctgtcactcaggctggagtacagtggtgccatcattgctgtctgcagccttgaactctgggctcaagcaatcctctcacctcagcctcccgagtagggaggaccacaggtgtgagccaccacacctggctaatttttacttttttttttttttggtagagatggagtcttgctatattgcccaggctggtcttgaagtcctggcttcaggcaattctcctgcctttgcctccagaagcactgggatcacaggtgtcagccattgcacccagcccagattgtcttaatttctatcttgttccaaggccagggacagtaataagaatggaaaagagatatgggaacactggcagactgtgtaaaatgtaatgcaactacccaaaacaagcctggtaggaaagggcaagtctttaggtctttgtaagaactaaagaagatctgtaatttttattttcaccctctgtaccccatgaccttatccttcctctccttccttgttacccatgaaaaactggcaacattccaagaatagcatctgtacaaaggggaaagaacataaaggtaaaacaaaacaaaacaacattttgagaacaaagatgaccataaccactgaagggaatcacatcttttaagacaaattcatattcttttatttgttatggcagatgacaagatggtacaacctttattcttttccaaaataaaacaaagggcacagcatctgtagtcagccgacaactatttcggccttttgggggtgggtctggccgtacttgtgatttcgatggtacgtgaccctctgctgaagacttgccccctgcccgtgtacatagtgcattgtttctgtgggcgggcccagcactttccgtcaacgttgtactgtatgtgatgaattgcgttggtctctgcatttttctgcagaagaggagtaaccgctccaggtaccttgacctttgtacagcccagaggccaacactgtgggtgtgtgactctttagcaaaaaaaacccatgtggtgatgatgtgtctatatatgtgaggatgtatcgggaagatttctaaataaaagttttacaaaggggaaaaaaaaa

SEQ ID NO: 75777 - DNA, 766 bp, Homo sapiens
acagtttgagaaagaggataccatacaggaaagaaatacacagaagtcaaattgcagagacacagacattctgatcactgtgtacatgtgatgaaactataagaggctggtgaaagaagtatagaaaagattagcagaagaggtttcagagcttatgcagtgctaggaacaataactttcaaccagtgaaattaaagacttgatatttcacaaggaattcattagagcacccagaagaggggtcttgcctccatagtggtaaataatttgccccagactaaaggctgcactggtcttgcctaacatacattaaattcaagaaccaaaagcaccaaactatctcctagtgacttaactatgaatcagaacacagctcaagacaattaaaagaatacaaaattacctagcatcccaaaatgtaaaatttataatgtgtggcacccaataaaaaattatcaagtatgcaaaaaatggaaaaataaataaatctggatgaagaagaaagtgaatcaatttaaactaatccagatttgaaatagatattagatttgacacacaaagacattaaagcagttacaatattggaatttgaaattttcaaaatgttaagtaaaacccggaaagttatggaaaacattcatctctttcatttcaagacacaaaaacaacagtgtattagattaatattatactggagtcttctaatggaagattagacatttgaggactaagctcgaactttttatcttgcccaaattcctaccta

SEQ ID NO: 75778 - DNA, 454 bp, Homo sapiens
gttctctcagcaacgtgggtggcaggttatgctacccatataatgtattgtagttggctctccacacttgtcagggttagtgttcaaccattcggaaaattttcccattgttctatcatgtgaaccaagactagtgtagaattcccaataacttacaaaaaaaggattaattagaaagtttgaaatttgattacttattgttttaatacagtactatgtattttagtattttatctataattagaattgttttttagtcaaaataatgtatcaaaatcaaaacttcatcttattttttaatagattttacagaaatttgtatactgaatcctgcctcttttttttgtattaacactgtttccatcttaagcattttgctttagatggaccatagctcttggcagctagtgcatttttagcaaataatactgtttctagtaagagttgcagagaa

SEQ ID NO: 75779 - DNA, 1332 bp, Homo sapiens
cagtttcagggcctgagtccccatgccctgctctatgggggtgcgggggtgtcatgtcttgcactttccccagcaacctgccacccccctaccctgtgagaacaagcccctctcattctgtgtcccttgactccacgacggcggctgccttgtccacgaggcagggattctcatctctggtgcagcccctgtcctcaccactctgggcttgtgctgttcttggtcccttatcttgttgtcacagggctaaccctccccacacacctggctgtcccctgccccacagctcctaggccagggcctgtccctgcccctaacacgcagcccctcggttcctcttaccctcttcttggaccctacgccatttctgggtaatcagaaagctcagagatggtctccaggtgaccccccagtctgtccctctccctgaatccagagcgctgcagtcacagtagaggcaattgctgtcattccgcggcccatgacagcctggcggcccgtacccctcccccatgatcccctgcacagacaggcccacgtgtgtccccagatgcctgaatcactgctgacggctggggacctggcggccgtgggctcctggggagccactggggagggggtggcggccgcgtctcgcctccacgggaacacctgcggacataaataggcagccagcagaggcagcagcacagagccaccaagcagtgctgcatacggggtccacctgtgtgcaccaggatgcctgacaccatgctgcccgcctgcttcctcggcctactggccttctcctccgcgtgctacttccagaactgcccgaggggcggcaagagggccatgtccgacctggagctgagacagtgcctcccctgcggccccgggggcaaaggccgctgcttcgggcccagcatctgctgcgcggacgagctgggctgcttcgtgggcacggctgaggcgctgcgctgccaggaggagaactacctgccgtcgccctgccagtccggccagaaggcgtgcgggagcgggggccgctgcgccgccttcggcgtttgctgcaacgacgagagctgcgtgaccgagcccgagtgccgcgagggctttcaccgccgcgcccgcgccagcgaccggagcaacgccacgcagctggacgggccggccggggccttgctgctgcggctggtgcagctggccggggcgcccgagcccttcgagcccgcccagcccgacgcctactgagccccgcgctcgtcccaccggcgcgctcttcgcgcccgcccctgcagcacggacaataaacctccgccaatgcacggcctcgcgtctgtctcagtctct

SEQ ID NO: 75780 - DNA, 144 bp, Homo sapiens
tttatgattatattctcttagaaaattaacaatggcagttcaaatttcaaattagatttaaggactaacctctgattatttatcttgtccaaattcctacccaaggggtctggggagtcatgccctacaaatcatggattctca

SEQ ID NO: 75781 - DNA, 687 bp, Homo sapiens
ctcttatttaaaccaaattgcattgcactaatcccacagcatgctctttgaggacccagctctgatagggcttctgaggtgccagaaacctccagctggaatatcctgccttcaggacacatcagacatctggctgttcattagtccaatgttacaagtcctgcagtccacctcccattctatctggctccctgctctaccagagacaaatccaccagagccataacagatgcgctgccgggtccccatcagcatctgcactgagacctaccacgggacaaaccaatgatgaaaaaaccaaagtccagaaaatgaaaatggtctcagagagactggccaatcctatttggggtcctctagaaaattctcccatcactcttccctgtcctaccatttccacatattgatcatgacttggtgcttcgtttttctgcccctgcactagaacacaaactccacaaaggcaaggagtttatcttgttcttgatgaatcccaggcacttaaggaagtatttgttcgataattagttgttgagtgagtgaataaatgcacctgtcctagcattttgtgggtaggttctgccaccattgtcttgtactctcaaagtcttatcaaaattgctgtaaatcatgcctaaaatgagacatgagtttgccaccaaaaatgtgaattaatttgccaggaaa

SEQ ID NO: 75782 - DNA, 1678 bp, Homo sapiens
aggccggaagtgaccgccctttgccactccccctgcctcctctccgcctttaacttctcgggaagatgaggcagtttggcatctgtggccgagttgctgttgccgggtgatagttggagcggagacttagcataatggcagaacctgtttctccactgaagcactttgtgctggctaagaaggcgattactgcaatctttgaccagttactggagtttgttactgaaggatcacattttgttgaagcaacatataagaatccggaacttgatcgaatagccactgaagatgatctggtagaaatgcaaggatataaagacaagctttccatcattggtgaggtgctatctcggagacacatgaaggtggcattttttggcaggacaagcagtgggaagagctctgttatcaatgcaatgttgtgggataaagttctccctagtgggattggccatataaccaattgcttcctaagtgttgaaggaactgatggagataaagcctatcttatgacagaaggatcagatgaaaaaaagagtgtgaagacagttaatcaactggcccatgcccttcacatggacaaagatttgaaagctggctgtcttgtacgtgtgttttggccaaaagcaaaatgtgccctcttgagagatgacctggtgttagtagacagtccaggcacagatgtcactacagagctggatagctggattgataagttttgcctagatgctgatgtctttgttttggtcgcaaactctgaatcaacactaatgaatacggaaaaacacttttttcacaaggtgaatgagcggctttccaagcctaatattttcattctcaataatcgttgggatgcctctgcatcagagccagaatatatggaagacgtacgcagacagcacatggaaagatgcctgcatttcttggtggaggagctcaaagttgtaaatgctttagaagcacagaatcgtatcttctttgtttcagcaaaggaagttcttagtgctagaaagcaaaaagcacaggggatgccagaaagtggtgtggcacttgctgaaggatttcatgcaagattacaggaatttcagaattttgaacaaatctttgaggagtgtatctcgcagtcagcagtgaaaacaaagttcgaacagcacactatcagagctaaacagatactagctactgtgaaaaacataatggattcagtaaacctggcagctgaagataaaaggcattattcagtggaagagagggaagaccaaattgatagactggactttattcgaaaccagatgaaccttttaacactggatgttaagaaaaaaatcaaggaggttaccgaggaggtggcaaacaaagtttcatgtgcaatgacagatgaaatttgtcgactgtctgttttggttgatgaattttgttcagagtttcatcctaatccagatgtattaaaaatatataaaagtgaattaaataagcacatagaggatggtatgggaagaaatttggctgatcgatgcaccgatgaagtaaacgccttagtgcttcagacccagcaagaaattattgaaaatttgaagccattacttccagctggtatacaggataaactacatacactgatcccttgcaagaaatttgatctcagttataatctaaattaccacaagttatgttcaga

SEQ ID NO: 75783 - DNA, 883 bp, Homo sapiens
ggaaggaagtctaatgccttgcttactagccctgccttaggggaacatcctgaagtctccctggagagtgtgaattgacttcttacattaatatcatgcatattcacctgtcctatagctttctgaagccatttcctttctttggtctatattttcaacttttgctattacagtacaattcttaagaggaaaaagggcaaacctgtaaggcattgcattgtttcccaattcagctggaggggagcctcctagactccagggaactctgctccaagtaggttgtgtgtgggcaatgaatgttatctaaaacctgaagactctgagcactgctgaaggtgcaaagatgcagtagagatggactctgtcctctagaagcttaaagtctagttgaatagatgacataatccattcagcaaacacttattaagcatgtgtgtgtttgaggcacggtgacagcacagcaatgattaagctgcaatcctgactttctaaggagactgcaatgaatggttaagtaagaaatatgaaacaagtcaggcagtacagtgaacttcccagtgaataatataaacagttaagtggtgcttagaaaatagaggaatcactgtgagctaggatggcttgggaaggctttaaggaggtggtaagcttaagcaaaacccccaaatctcagctgcttcttacattcatagaattttccaggttctagaataaagcacaaaccatttcaaggaaatgtaaatttctcagttggagcaactctcgtgctctctcttcagtcagttgccgtggctgctgcttcatccagcccttctccctctcccactccgtgccattgcatcagtctgacatactccaagaacaaaaagtataaaaaatgact

SEQ ID NO: 75784 - DNA, 179 bp, Homo sapiens
agaaccctcaaataatttttagaattcttacctaatatgtaaaagtctgcatgactcttaacaatgagtcacatccattgattttacagggattttagttcgtaatccagaaagtaataatcagggattttattttaatcaggcatcaatccagattcactgttatactgaaatatcaa

SEQ ID NO: 75785 - DNA, 367 bp, Homo sapiens
ctacagagctgagacattctttctgggttaagcttgttgggaggcactcctgtgtctctctcccgctcctacccatcttgctgagtatgccaaggatgcaagtccctgaccacactttacctcacaaccatttctcagggttgtgtttgcagaaagcaatcttcagtgataaggtaatgtctctctccaggaaaaagagcaggcttattataaaagaggtgggttccccaagctcagtgcttttcacttgtgacacaagccactacctgcatgtaggctcctccacactgtccccgtgggactgacacgaacatgaagatcacattgcctactctgctgtgcataataaaattctttgtctctgaca

SEQ ID NO: 75786 - DNA, 763 bp, Homo sapiens
  misc_feature (595)..(595): n is a, c, g, or t
  misc_feature (598)..(598): n is a, c, g, or t
  misc_feature (607)..(607): n is a, c, g, or t
  misc_feature (609)..(609): n is a, c, g, or t
  misc_feature (613)..(614): n is a, c, g, or t
  misc_feature (618)..(618): n is a, c, g, or t
  misc_feature (626)..(626): n is a, c, g, or t
  misc_feature (630)..(630): n is a, c, g, or t
  misc_feature (637)..(637): n is a, c, g, or t
  misc_feature (645)..(645): n is a, c, g, or t
  misc_feature (654)..(654): n is a, c, g, or t
  misc_feature (665)..(665): n is a, c, g, or t
  misc_feature (671)..(671): n is a, c, g, or t
  misc_feature (689)..(689): n is a, c, g, or t
  misc_feature (741)..(741): n is a, c, g, or t
ctcgcgagcgcctgccgtttctcggggcgggacgggggggcggggactgggcggagaggcgcgtgctgctgcgtgcgtgcgcgcgcgccgcgggcgggccagtgaaaccggcggccctggcacgtgacctaggaccggctcaccgggtcgcttggtggctccgtctgtctgtccgtccgcccgcgggtgccatcatggcggacgcggccagtcaggtgctcctgggctccggtctcaccatcctgtcccagccgctcatgtacgtgaaagtgctcatccaggtgggatatgagcctcttcctccaacaataggacgaaatatttttgggcggcaagtgtgtcagcttcctggtctctttagttatgctcagcacattgccagtatcgatgggaggcgcgggttgttcacaggcttaactccaagactgtgttcgggagtccttggaactgtggtccatggtaaagttttacagcattaccaggagagtgacaagggtgaggagttaggacctggaaatgtacagaaagaagtctcatcttcctttgaccacgttatcaaggagacaactcgagagatgatcgctcgttgtggtgntanggtgatgananatgnnttgnatgtgatnactntgagatntatggtanagttgattnggagagaatgnaagtantgtggagtttgtgattgnataataaggatgtatggggaagaggggattgtaggatttttgggcggtgttnttggtgcggttgtacgtgagat

SEQ ID NO: 75787 - DNA, 2890 bp, Homo sapiens
  misc_feature (2648)..(2649): n is a, c, g, or t
  misc_feature (2652)..(2652): n is a, c, g, or t
  misc_feature (2654)..(2654): n is a, c, g, or t
ctcgcgagcgcctgccgtttctcggggcgggacgggggggcggggactgggcggagaggcgcgtgctgctgcgtgcgtgcgcgcgcgccgcgggcgggccagtgaaaccggcggccctggcacgtgacctaggaccggctcaccgggtcgcttggtggctccgtctgtctgtccgtccgcccgcgggtgccatcatggcggacgcggccagtcaggtgctcctgggctccggtctcaccatcctgtcccagccgctcatgtacgtgaaagtgctcatccaggtgggatatgagcctcttcctccaacaataggacgaaatatttttgggcggcaagtgtgtcagcttcctggtctctttagttatgctcagcacattgccagtatcgatgggaggcgcgggttgttcacaggcttaactccaagactgtgttcgggagtccttggaactgtggtccatggtaaagttttacagcattaccaggagagtgacaagggtgaggagttaggacctggaaatgtacagaaagaagtctcatcttcctttgaccacgttatcaaggagacaactcgagagatgatcgctcgttctgctgctaccctcatcacacatcccttccatgtgatcactctgagatctatggtacagttcattggcagagaatccaagtactgtggactttgtgattccataataaccatctatcgggaagagggcattctaggatttttcgcgggtcttgttcctcgccttctaggtgacatcctttctttgtggctgtgtaactcactggcctacctcgtcaatacctatgcactggacagtggggtttctaccatgaatgaaatgaagagttattctcaagctgtcacaggattttttgcgagtatgttgacctatccctttgtgcttgtctccaatcttatggctgtcaacaactgtggtcttgctggtggatgccctccttactccccaatatatacgtcttggatagactgttggtgcatgctacaaaaagaggggaatatgagccgaggaaatagcttatttttccggaaggtcccctttgggaagacttattgttgtgacctgaaaatgttaatttgaagatgtggggcagggacagtgacatttctgtagtcccagatgcacagaattatgggagagaatgttgatttctatacagtgtggcgcgcttttttaataatcatttaatcttgggaaaattcaggtgtttggtgtctgccttttttgttcttttttccagcacaacataacttaccactgatactccccctttagttattctgaattaggatatttttgctccaaattcttattttacttaaccagaagggaaaaaaagttgtattttcctgaagctacaggcactttgtcatgtgatttttgagtctcaatttaaggctttgtaaaatgaagagtagaattccaagaaaaatgagaaataattttgtaaaacttaacaaaatcactaaattaaactatatgggaggttatgaattactttttcttgggtagaccctaaaatgtcagtagcatgcaccagaatctgactcccattatgcttctaagcacatttcattgaccttgtctctcatacttcaagaaaaggacagtacattgctacattaccctagaaagtctgtgtgaggatctgccccttcagtctgttattgcaaagtaataaaatgtcacctacagggagcctctgagcctactctagttcaagaggctacctgaaaaaaaataaataagataaagggtcagcaacaacaaagaaaaagacaattacagaaaataagcaagatttggaaaggaagtataatggcacttttttcctcaaaggaagttcttgttttcacataaaatatgaaaagcagatcctgcaggagtaacccccttctttaagagccaagtatttgccagtgcttaaattacaccataccgttctaattatatataatcttttgttcttcagttttttgttttgtttcctttttgttattgttgccgaaggtgagtagttttgcatttctgatgacagccttggaaagtatatttgtaactccatgtctggtaatgccaacccaagtcgacatgggtcttaggacactgaccacctcacatgccataccctcagttaagcatgttaacatttataggaggaaaaaaatcactttgggagaaaataaaattcaactcaagcataaagcttctgtttactcaggccttctaaaaagcaggttaaaatgctctaaaatgagaaagcctgtggtttcacttatttatataactcactgggacattgccaaatgagtaagcacttaattcgctgcttctgagacttctctgtcaaaacagccccactgataatattagacagaacgagaatgcaggggtctcttccctcccctggggtttaggaagctcatgaggagctcggcttaaaatgtctttgatgtctcttcctttgtctcaaaaagtaatgtcaattttatatactatttcaatattactatctgcatttgttttaatataaaaatgtttgctgcctacctttttctcccaaaaaatctttaagtaaagatgatctgggaaaatgaaaaaaaaaaaaaaaaaaaaaaaaannaananaaaaaaaatccttaataaaaaataaattcaatataataagatccttaacttaatatagaatctataacaaaaaaaaaaatttttggcccttttgggccaattaatttttaaatctggcgatttttttcttgggcgccaaatctgggctttttggaacaatcccccttggggggggtatttaaaatctaatgcgcgggtttatcgttgtctgtgccttgggttcccccatttttttt

SEQ ID NO: 75788 - DNA, 2190 bp, Homo sapiens
  misc_feature (1255)..(1256): n is a, c, g, or t
  misc_feature (1259)..(1259): n is a, c, g, or t
  misc_feature (1261)..(1261): n is a, c, g, or t
ctcgcgagcgcctgccgtttctcggggcgggacgggggggcggggactgggcggagaggcgcgtgctgctgcgtgcgtgcgcgcgcgccgcgggcgggccagtgaaaccggcggccctggcacgtgacctaggaccggctcaccgggtcgcttggtggctccgtctgtctgtccgtccgcccgcgggtgccatcatggcggacgcggccagtcaggtgctcctgggctccggtctcaccatcctgtcccagccgctcatgtacgtgaaagtgctcatccaggtgggatatgagcctcttcctccaacaataggacgaaatatttttgggcggcaagtgtgtcagcttcctggtctctttagttatgctcagcacattgccagtatcgatgggaggcgcgggttgttcacaggcttaactccaagactgtgttcgggagtccttggaactgtggtccatggtaaagttttacagcattaccaggagagtgacaagggtgaggagttaggacctggaaatgtacagaaagaagtctcatcttcctttgaccacgttatcaaggagacaactcgagagatgatcgctcgttctgctgctaccctcatcacacatcccttccatgtgatcactctgagatctatggtacagttcattggcagagaatccaagtactgtggactttgtgattccataataaccatctatcgggaagagggcattctaggatttttcgcgggtcttgttcctcgccttctaggtgacatcctttctttgtggctgtgtaactcactggcctacctcgtcaatacctatgcactggacagtggggtttctaccatgaatgaaatgaagagttattctcaagctgtcacaggattttttgcgagtatgttgacctatccctttgtgcttgtctccaatcttatggctgtcaacaactgtggtcttgctggtggatgccctccttactccccaatatatacgtcttggatagactgttggtgcatgctacaaaaagaggggaatatgagccgaggaaatagcttatttttccggaaggtcccctttgggaagacttattgttgtgacctgaaaatgttaatttgaagatgtggggcagggacagtgacatttctgtagtcccagatgcacagaattatgggagagaatgttgatttctatacagtgtggcgcgcttttttaataatcatttaatcttgggaaaattcaaaaaaaaaaaaaaaaaaaaaaaaaannaananaaaaaaaaggggggggggtaaaaaatccccgggggggcatttacggtaaccagaactttgtgtaaacaaggtgggcccctatagagggggtcggttataaataagatcaggcagtggggacgatgattatacacaccgttgtggtgacgttgggaaaacacgcggtagagttgcagaacttttgtgaaaagcgaacccaaaacatttgtgctgggggtgacacagatacatgtgggagacaacattacccactaacgaagagatgtaaaagaggcctaacgggaagcaatataaaagtttgaaggaggtgatatcgatgggctaaacataccacgggcatatctcgcgcgacggcagaacaacgttcgcagaacccgggaggaatcgcattacggacacgacttattatcacccgcggccgcattcacaacaacgacggagctacgaaaagcaaactcagaactagcccagacacaagaagaacgacacaccacgacctagaacacagacacagacagagaccaaacatagcacaaccacagatgaagacaacaacacagacacgaccacaccaagcacacacacagagacaaagcacagcaacacaaaacaacaacaaccacaaaacacaagagacagaacgaagaagcacagacgcaagaggagagcgaacgtgaaagcgcagagaaaggaaaggactaacagagacaacgaaaagaggagagaagaaacgagaggcagagacaaacacgaccgggagagaagcgggagacacaacgagaaagacaaagagagaggccgagagcgcaagaagaaaagaagagacaagcgagaacgaaaagcaaagaaggagaaagagaaagagagaaaagcaagaggagcgaagacggcacaagggaaagacggaggaaaaaaaacagcacaggaag

SEQ ID NO: 75789 - DNA, 2600 bp, Homo sapiens
ctcgcgagcgcctgccgtttctcggggcgggacgggggggcggggactgggcggagaggcgcgtgctgctgcgtgcgtgcgcgcgcgccgcgggcgggccagtgaaaccggcggccctggcacgtgacctaggaccggctcaccgggtcgcttggtggctccgtctgtctgtccgtccgcccgcgggtgccatcatggcggacgcggccagtcaggtgctcctgggctccggtctcaccatcctgtcccagccgctcatgtgggatatgagcctcttcctccaacaataggacgaaatatttttgggcggcaagtgtgtcagcttcctggtctctttagttatgctcagcacattgccagtatcgatgggaggcgcgggttgttcacaggcttaactccaagactgtgttcgggagtccttggaactgtggtccatggtaaagttttacagcattaccaggagagtgacaagggtgaggagttaggacctggaaatgtacagaaagaagtctcatcttcctttgaccacgttatcaaggagacaactcgagagatgatcgctcgttctgctgctaccctcatcacacatcccttccatgtgatcactctgagatctatggtacagttcattggcagagaatccaagtactgtggactttgtgattccataataaccatctatcgggaagagggcattctaggatttttcgcgggtcttgttcctcgccttctaggtgacatcctttctttgtggctgtgtaactcactggcctacctcgtcaatacctatgcactggacagtggggtttctaccatgaatgaaatgaagagttattctcaagctgtcacaggattttttgcgagtatgttgacctatccctttgtgcttgtctccaatcttatggctgtcaacaactgtggtcttgctggtggatgccctccttactccccaatatatacgtcttggatagactgttggtgcatgctacaaaaagaggggaatatgagccgaggaaatagcttatttttccggaaggtcccctttgggaagacttattgttgtgacctgaaaatgttaatttgaagatgtggggcagggacagtgacatttctgtagtcccagatgcacagaattatgggagagaatgttgatttctatacagtgtggcgcgcttttttaataatcatttaatcttgggaaaattcaggtgtttggtgtctgccttttttgttcttttttccagcacaacataacttaccactgatactccccctttagttattctgaattaggatatttttgctccaaattcttattttacttaaccagaagggaaaaaaagttgtattttcctgaagctacaggcactttgtcatgtgatttttgagtctcaatttaaggctttgtaaaatgaagagtagaattccaagaaaaatgagaaataattttgtaaaacttaacaaaatcactaaattaaactatatgggaggttatgaattactttttcttgggtagaccctaaaatgtcagtagcatgcaccagaatctgactcccattatgcttctaagcacatttcattgaccttgtctctcatacttcaagaaaaggacagtacattgctacattaccctagaaagtctgtgtgaggatctgccccttcagtctgttattgcaaagtaataaaatgtcacctacagggagcctctgagcctactctagttcaagaggctacctgaaaaaaaataaataagataaagggtcagcaacaacaaagaaaaagacaattacagaaaataagcaagatttggaaaggaagtataatggcacttttttcctcaaaggaagttcttgttttcacataaaatatgaaaagcagatcctgcaggagtaacccccttctttaagagccaagtatttgccagtgcttaaattacaccataccgttctaattatatataatcttttgttcttcagttttttgttttgtttcctttttgttattgttgccgaaggtgagtagttttgcatttctgatgacagccttggaaagtatatttgtaactccatgtctggtaatgccaacccaagtcgacatgggtcttaggacactgaccacctcacatgccataccctcagttaagcatgttaacatttataggaggaaaaaaatcactttgggagaaaataaaattcaactcaagcataaagcttctgtttactcaggccttctaaaaagcaggttaaaatgctctaaaatgagaaagcctgtggtttcacttatttatataactcactgggacattgccaaatgagtaagcacttaattcgctgcttctgagacttctctgtcaaaacagccccactgataatattagacagaacgagaatgcaggggtctcttccctcccctggggtttaggaagctcatgaggagctcggcttaaaatgtctttgatgtctcttcctttgtctcaaaaagtaatgtcaattttatatactatttcaatattactatctgcatttgttttaatataaaaatgtttgctgcctacctttttctcccaaaaaatctttaagtaaagatgatctgggaaaatg

SEQ ID NO: 75790 - DNA, 1427 bp, Homo sapiens
ctcgcgagcgcctgccgtttctcggggcgggacgggggggcggggactgggcggagaggcgcgtgctgctgcgtgcgtgcgcgcgcgccgcgggcgggccagtgaaaccggcggccctggcacgtgacctaggaccggctcaccgggtcgcttggtggctccgtctgtctgtccgtccgcccgcgggtgccatcatggcggacgcggccagtcaggtgctcctgggctccggtctcaccatcctgtcccagccgctcatgtacgtgaaagtgctcatccaggtgggatatgagcctcttcctccaacaataggacgaaatatttttgggcggcaagtgtgtcagcttcctggtctctttagttatgctcagcacattgccagtatcgatgggaggcgcgggttgttcacaggcttaactccaagactgtgttcgggagtccttggaactgtggtccatggtaaagttttacagcattaccaggagagtgacaagggtgaggagttaggacctggaaatgtacagaaagaagtctcatcttcctttgaccacgttatcaaggagacaactcgagagatgatcgctcgttctgctgctaccctcatcacacatcccttccatgtgatcactctgagatctatggtacagttcattggcagagaatccaagtactgtggactttgtgattccataataaccatctatcgggaagagggcattctaggatttttcgcgggtcttgttcctcgccttctaggtgacatcctttctttgtggctgtgtaactcactggcctacctcgtcaatacctatgcactggacagtggggtttctaccatgaatgaaatgaagagttattctcaagctgtcacaggattttttgcgagtatgttgacctatccctttgtgcttgtctccaatcttatggctgtcaacaactgtggtcttgctggtggatgccctccttactccccaatatatacgtcttggatagactgttggtgcatgctacaaaaagaggggaatatgagccgaggaaatagcttatttttccggaaggtcccctttgggaagacttattgttgtgacctgaaaatgttaatttgaagatgtggggcagggacagtgacatttctgtagtcccagatgcacagaattatgggagagtctccgtcgaactagttcgacggagactctctacattgttttttttttgagacaaggtcttgctgtcacctaggcagaagtgcagtggcacaatcatagctcactgcagcctcaatctccccagcccaagcaatcctctcaccctagcctcctgggaataccagcctgcaccaccatgcccacttttttaaactgaatttttactagagacaaggtcttgctatgttgcccaggagctagggtgagagtctccgtcgaact

SEQ ID NO: 75791 - DNA, 2542 bp, Homo sapiens
ctcgcgagcgcctgccgtttctcggggcgggacgggggggcggggactgggcggagaggcgcgtgctgctgcgtgcgtgcgcgcgcgccgcgggcgggccagtgaaaccggcggccctggcacgtgacctaggaccggctcaccgggtcgcttggtggctccgtctgtctgtccgtccgcccgcgggtgccatcatggcggacgcggccagtcaggtgctcctgggctccggtctcaccatcctgtcccagccgctcatgtgggatatgagcctcttcctccaacaataggacgaaatatttttgggcggcaagtgtgtcagcttcctggtctctttagttatgctcagcacattgccagtatcgatgggaggcgcgggttgttcacaggcttaactccaagactgtgttcgggagtccttggaactgtggtccatggtaaagttttacagcattaccaggagagtgacaagggtgaggagttaggacctggaaatgtacagaaagaagtctcatcttcctttgaccacgttatcaaggagtgatcactctgagatctatggtacagttcattggcagagaatccaagtactgtggactttgtgattccataataaccatctatcgggaagagggcattctaggatttttcgcgggtcttgttcctcgccttctaggtgacatcctttctttgtggctgtgtaactcactggcctacctcgtcaatacctatgcactggacagtggggtttctaccatgaatgaaatgaagagttattctcaagctgtcacaggattttttgcgagtatgttgacctatccctttgtgcttgtctccaatcttatggctgtcaacaactgtggtcttgctggtggatgccctccttactccccaatatatacgtcttggatagactgttggtgcatgctacaaaaagaggggaatatgagccgaggaaatagcttatttttccggaaggtcccctttgggaagacttattgttgtgacctgaaaatgttaatttgaagatgtggggcagggacagtgacatttctgtagtcccagatgcacagaattatgggagagaatgttgatttctatacagtgtggcgcgcttttttaataatcatttaatcttgggaaaattcaggtgtttggtgtctgccttttttgttcttttttccagcacaacataacttaccactgatactccccctttagttattctgaattaggatatttttgctccaaattcttattttacttaaccagaagggaaaaaaagttgtattttcctgaagctacaggcactttgtcatgtgatttttgagtctcaatttaaggctttgtaaaatgaagagtagaattccaagaaaaatgagaaataattttgtaaaacttaacaaaatcactaaattaaactatatgggaggttatgaattactttttcttgggtagaccctaaaatgtcagtagcatgcaccagaatctgactcccattatgcttctaagcacatttcattgaccttgtctctcatacttcaagaaaaggacagtacattgctacattaccctagaaagtctgtgtgaggatctgccccttcagtctgttattgcaaagtaataaaatgtcacctacagggagcctctgagcctactctagttcaagaggctacctgaaaaaaaataaataagataaagggtcagcaacaacaaagaaaaagacaattacagaaaataagcaagatttggaaaggaagtataatggcacttttttcctcaaaggaagttcttgttttcacataaaatatgaaaagcagatcctgcaggagtaacccccttctttaagagccaagtatttgccagtgcttaaattacaccataccgttctaattatatataatcttttgttcttcagttttttgttttgtttcctttttgttattgttgccgaaggtgagtagttttgcatttctgatgacagccttggaaagtatatttgtaactccatgtctggtaatgccaacccaagtcgacatgggtcttaggacactgaccacctcacatgccataccctcagttaagcatgttaacatttataggaggaaaaaaatcactttgggagaaaataaaattcaactcaagcataaagcttctgtttactcaggccttctaaaaagcaggttaaaatgctctaaaatgagaaagcctgtggtttcacttatttatataactcactgggacattgccaaatgagtaagcacttaattcgctgcttctgagacttctctgtcaaaacagccccactgataatattagacagaacgagaatgcaggggtctcttccctcccctggggtttaggaagctcatgaggagctcggcttaaaatgtctttgatgtctcttcctttgtctcaaaaagtaatgtcaattttatatactatttcaatattactatctgcatttgttttaatataaaaatgtttgctgcctacctttttctcccaaaaaatctttaagtaaagatgatctgggaaaatg

SEQ ID NO: 75792 - DNA, 2367 bp, Homo sapiens
ctcgcgagcgcctgccgtttctcggggcgggacgggggggcggggactgggcggagaggcgcgtgctgctgcgtgcgtgcgcgcgcgccgcgggcgggccagtgaaaccggcggccctggcacgtgacctaggaccggctcaccgggtcgcttggtggctccgtctgtctgtccgtccgcccgcgggtgccatcatggcggacgcggccagtcaggtgctcctgggctccggtctcaccatcctgtcccagccgctcatgtacgtgaaagtgctcatccaggtgggatatgagcctcttcctccaacaataggacgaaatatttttgggcggcaagtgtgtcagcttcctggtctctttagttatgtgatcactctgagatctatggtacagttcattggcagagaatccaagtactgtggactttgtgattccataataaccatctatcgggaagagggcattctaggatttttcgcgggtcttgttcctcgccttctaggtgacatcctttctttgtggctgtgtaactcactggcctacctcgtcaatacctatgcactggacagtggggtttctaccatgaatgaaatgaagagttattctcaagctgtcacaggattttttgcgagtatgttgacctatccctttgtgcttgtctccaatcttatggctgtcaacaactgtggtcttgctggtggatgccctccttactccccaatatatacgtcttggatagactgttggtgcatgctacaaaaagaggggaatatgagccgaggaaatagcttatttttccggaaggtcccctttgggaagacttattgttgtgacctgaaaatgttaatttgaagatgtggggcagggacagtgacatttctgtagtcccagatgcacagaattatgggagagaatgttgatttctatacagtgtggcgcgcttttttaataatcatttaatcttgggaaaattcaggtgtttggtgtctgccttttttgttcttttttccagcacaacataacttaccactgatactccccctttagttattctgaattaggatatttttgctccaaattcttattttacttaaccagaagggaaaaaaagttgtattttcctgaagctacaggcactttgtcatgtgatttttgagtctcaatttaaggctttgtaaaatgaagagtagaattccaagaaaaatgagaaataattttgtaaaacttaacaaaatcactaaattaaactatatgggaggttatgaattactttttcttgggtagaccctaaaatgtcagtagcatgcaccagaatctgactcccattatgcttctaagcacatttcattgaccttgtctctcatacttcaagaaaaggacagtacattgctacattaccctagaaagtctgtgtgaggatctgccccttcagtctgttattgcaaagtaataaaatgtcacctacagggagcctctgagcctactctagttcaagaggctacctgaaaaaaaataaataagataaagggtcagcaacaacaaagaaaaagacaattacagaaaataagcaagatttggaaaggaagtataatggcacttttttcctcaaaggaagttcttgttttcacataaaatatgaaaagcagatcctgcaggagtaacccccttctttaagagccaagtatttgccagtgcttaaattacaccataccgttctaattatatataatcttttgttcttcagttttttgttttgtttcctttttgttattgttgccgaaggtgagtagttttgcatttctgatgacagccttggaaagtatatttgtaactccatgtctggtaatgccaacccaagtcgacatgggtcttaggacactgaccacctcacatgccataccctcagttaagcatgttaacatttataggaggaaaaaaatcactttgggagaaaataaaattcaactcaagcataaagcttctgtttactcaggccttctaaaaagcaggttaaaatgctctaaaatgagaaagcctgtggtttcacttatttatataactcactgggacattgccaaatgagtaagcacttaattcgctgcttctgagacttctctgtcaaaacagccccactgataatattagacagaacgagaatgcaggggtctcttccctcccctggggtttaggaagctcatgaggagctcggcttaaaatgtctttgatgtctcttcctttgtctcaaaaagtaatgtcaattttatatactatttcaatattactatctgcatttgttttaatataaaaatgtttgctgcctacctttttctcccaaaaaatctttaagtaaagatgatctgggaaaatg

SEQ ID NO: 75793 - DNA, 2595 bp, Homo sapiens
taattttcagagtatctccccatacggattttgaatatcataaataccctgtgagataggcaggacagctataattagtatcactttagagattaaaaaacattgatgctctgagagtttcatctgctgcctgtcacatcgctgctgagtgctggagctggcatttgaagctggtcttcaatccgtggggaaatgctcttcccactattccatgctgcctcacctaggtcacccagaccctagaaatgtggtttttgatgcctctcatctgtatctgtacttgggaccattcttgctttgtaatttttctcgtcttttgctctgccaaatatgaatatcagatagcttagcaaaatcatttttttaagctagtcaaagcaaaacaatatttaagtctcttctgcaaagcacctcgcaaatcttttgcctccctgcttacagttatgaatagtaaggtgagccactgagggtatagccgacctgcattttaaacataggaacaaaagtcactggagatcagcttcaagtacagctgtgttaacgagaatgaactaggtatgcgggctggattctggtgtttgattccttttttacttccctagaatgttttgtgacctctaattatttgacaaacatttgtactgaagagcctgtcatgttactgatcacattttttggttcttatttttattgtttcttcatgtaggggtcttgttcctcgccttctaggtgacatcctttctttgtggctgtgtaactcactggcctacctcgtcaatacctatgcactggacagtggggtttctaccatgaatgaaatgaagagttattctcaagctgtcacaggattttttgcgagtatgttgacctatccctttgtgcttgtctccaatcttatggctgtcaacaactgtggtcttgctggtggatgccctccttactccccaatatatacgtcttggatagactgttggtgcatgctacaaaaagaggggaatatgagccgaggaaatagcttatttttccggaaggtcccctttgggaagacttattgttgtgacctgaaaatgttaatttgaagatgtggggcagggacagtgacatttctgtagtcccagatgcacagaattatgggagagaatgttgatttctatacagtgtggcgcgcttttttaataatcatttaatcttgggaaaattcaggtgtttggtgtctgccttttttgttcttttttccagcacaacataacttaccactgatactccccctttagttattctgaattaggatatttttgctccaaattcttattttacttaaccagaagggaaaaaaagttgtattttcctgaagctacaggcactttgtcatgtgatttttgagtctcaatttaaggctttgtaaaatgaagagtagaattccaagaaaaatgagaaataattttgtaaaacttaacaaaatcactaaattaaactatatgggaggttatgaattactttttcttgggtagaccctaaaatgtcagtagcatgcaccagaatctgactcccattatgcttctaagcacatttcattgaccttgtctctcatacttcaagaaaaggacagtacattgctacattaccctagaaagtctgtgtgaggatctgccccttcagtctgttattgcaaagtaataaaatgtcacctacagggagcctctgagcctactctagttcaagaggctacctgaaaaaaaataaataagataaagggtcagcaacaacaaagaaaaagacaattacagaaaataagcaagatttggaaaggaagtataatggcacttttttcctcaaaggaagttcttgttttcacataaaatatgaaaagcagatcctgcaggagtaacccccttctttaagagccaagtatttgccagtgcttaaattacaccataccgttctaattatatataatcttttgttcttcagttttttgttttgtttcctttttgttattgttgccgaaggtgagtagttttgcatttctgatgacagccttggaaagtatatttgtaactccatgtctggtaatgccaacccaagtcgacatgggtcttaggacactgaccacctcacatgccataccctcagttaagcatgttaacatttataggaggaaaaaaatcactttgggagaaaataaaattcaactcaagcataaagcttctgtttactcaggccttctaaaaagcaggttaaaatgctctaaaatgagaaagcctgtggtttcacttatttatataactcactgggacattgccaaatgagtaagcacttaattcgctgcttctgagacttctctgtcaaaacagccccactgataatattagacagaacgagaatgcaggggtctcttccctcccctggggtttaggaagctcatgaggagctcggcttaaaatgtctttgatgtctcttcctttgtctcaaaaagtaatgtcaattttatatactatttcaatattactatctgcatttgttttaatataaaaatgtttgctgcctacctttttctcccaaaaaatctttaagtaaagatgatctgggaaaatg

SEQ ID NO: 75794 - DNA, 2122 bp, Homo sapiens
  misc_feature (1187)..(1188): n is a, c, g, or t
  misc_feature (1191)..(1191): n is a, c, g, or t
  misc_feature (1193)..(1193): n is a, c, g, or t
ctcgcgagcgcctgccgtttctcggggcgggacgggggggcggggactgggcggagaggcgcgtgctgctgcgtgcgtgcgcgcgcgccgcgggcgggccagtgaaaccggcggccctggcacgtgacctaggaccggctcaccgggtcgcttggtggctccgtctgtctgtccgtccgcccgcgggtgccatcatggcggacgcggccagtcaggtgctcctgggctccggtctcaccatcctgtcccagccgctcatgtacgtgaaagtgctcatccaggtgggatatgagcctcttcctccaacaataggacgaaatatttttgggcggcaagtgtgtcagcttcctggtctctttagttatgctcagcacattgccagtatcgatgggaggcgcgggttgttcacaggcttaactccaagactgtgttcgggagtccttggaactgtggtccatggtaaagttttacagcattaccaggagagtgacaagggtgaggagttaggacctggaaatgtacagaaagaagtctcatcttcctttgaccacgttatcaaggagacaactcgagagatgatcgctcgttctgctgctaccctcatcacacatcccttccatgtgatcactctgagatctatggtacagttcattggcagagaatccaagtactgtggactttgtgattccataataaccatctatcgggaagagggcattctaggatttttcgcgggtcttgttcctcgccttctaggtgacatcctttctttgtggctgtgtaactcactggcctacctcgtcaatacctatgcactggacagtggggtttctaccatgaatgaaatgaagagttattctcaagctgtcacaggatcttgctggtggatgccctccttactccccaatatatacgtcttggatagactgttggtgcatgctacaaaaagaggggaatatgagccgaggaaatagcttatttttccggaaggtcccctttgggaagacttattgttgtgacctgaaaatgttaatttgaagatgtggggcagggacagtgacatttctgtagtcccagatgcacagaattatgggagagaatgttgatttctatacagtgtggcgcgcttttttaataatcatttaatcttgggaaaattcaaaaaaaaaaaaaaaaaaaaaaaaaannaananaaaaaaaaggggggggggtaaaaaatccccgggggggcatttacggtaaccagaactttgtgtaaacaaggtgggcccctatagagggggtcggttataaataagatcaggcagtggggacgatgattatacacaccgttgtggtgacgttgggaaaacacgcggtagagttgcagaacttttgtgaaaagcgaacccaaaacatttgtgctgggggtgacacagatacatgtgggagacaacattacccactaacgaagagatgtaaaagaggcctaacgggaagcaatataaaagtttgaaggaggtgatatcgatgggctaaacataccacgggcatatctcgcgcgacggcagaacaacgttcgcagaacccgggaggaatcgcattacggacacgacttattatcacccgcggccgcattcacaacaacgacggagctacgaaaagcaaactcagaactagcccagacacaagaagaacgacacaccacgacctagaacacagacacagacagagaccaaacatagcacaaccacagatgaagacaacaacacagacacgaccacaccaagcacacacacagagacaaagcacagcaacacaaaacaacaacaaccacaaaacacaagagacagaacgaagaagcacagacgcaagaggagagcgaacgtgaaagcgcagagaaaggaaaggactaacagagacaacgaaaagaggagagaagaaacgagaggcagagacaaacacgaccgggagagaagcgggagacacaacgagaaagacaaagagagaggccgagagcgcaagaagaaaagaagagacaagcgagaacgaaaagcaaagaaggagaaagagaaagagagaaaagcaagaggagcgaagacggcacaagggaaagacggaggaaaaaaaacagcacaggaag

SEQ ID NO: 75795 - DNA, 2096 bp, Homo sapiens
ttcagaggatcccccaacgctctcacagtcttctgtgaaatatcatccatctaatcttgatgctgtcgcagatggtggtgacacaagttattgacaaactactgccaaatggtgcacaatattttgtaaaaagtacccagtagccccatttcatacaatgtacctaaattatgcagtaacttggcatcatcgttccctccttgttgctgtgtaattagtcagtgttgccacagtgtgtggcgctgatggagatgtcagaaccgagaacacttaaccttctttgattgtttttcaagttttaagacttcgatcccccctatgtgagcagcgttccaacgcgctcacaggattttttgcgagtatgttgacctatccctttgtgcttgtctccaatcttatggctgtcaacaactgtggtcttgctggtggatgccctccttactccccaatatatacgtcttggatagactgttggtgcatgctacaaaaagaggggaatatgagccgaggaaatagcttatttttccggaaggtcccctttgggaagacttattgttgtgacctgaaaatgttaatttgaagatgtggggcagggacagtgacatttctgtagtcccagatgcacagaattatgggagagaatgttgatttctatacagtgtggcgcgcttttttaataatcatttaatcttgggaaaattcaggtgtttggtgtctgccttttttgttcttttttccagcacaacataacttaccactgatactccccctttagttattctgaattaggatatttttgctccaaattcttattttacttaaccagaagggaaaaaaagttgtattttcctgaagctacaggcactttgtcatgtgatttttgagtctcaatttaaggctttgtaaaatgaagagtagaattccaagaaaaatgagaaataattttgtaaaacttaacaaaatcactaaattaaactatatgggaggttatgaattactttttcttgggtagaccctaaaatgtcagtagcatgcaccagaatctgactcccattatgcttctaagcacatttcattgaccttgtctctcatacttcaagaaaaggacagtacattgctacattaccctagaaagtctgtgtgaggatctgccccttcagtctgttattgcaaagtaataaaatgtcacctacagggagcctctgagcctactctagttcaagaggctacctgaaaaaaaataaataagataaagggtcagcaacaacaaagaaaaagacaattacagaaaataagcaagatttggaaaggaagtataatggcacttttttcctcaaaggaagttcttgttttcacataaaatatgaaaagcagatcctgcaggagtaacccccttctttaagagccaagtatttgccagtgcttaaattacaccataccgttctaattatatataatcttttgttcttcagttttttgttttgtttcctttttgttattgttgccgaaggtgagtagttttgcatttctgatgacagccttggaaagtatatttgtaactccatgtctggtaatgccaacccaagtcgacatgggtcttaggacactgaccacctcacatgccataccctcagttaagcatgttaacatttataggaggaaaaaaatcactttgggagaaaataaaattcaactcaagcataaagcttctgtttactcaggccttctaaaaagcaggttaaaatgctctaaaatgagaaagcctgtggtttcacttatttatataactcactgggacattgccaaatgagtaagcacttaattcgctgcttctgagacttctctgtcaaaacagccccactgataatattagacagaacgagaatgcaggggtctcttccctcccctggggtttaggaagctcatgaggagctcggcttaaaatgtctttgatgtctcttcctttgtctcaaaaagtaatgtcaattttatatactatttcaatattactatctgcatttgttttaatataaaaatgtttgctgcctacctttttctcccaaaaaatctttaagtaaagatgatctgggaaaatg

SEQ ID NO: 75796 - DNA, 2000 bp, Homo sapiens
gcagtgagccgagattgcaccactgcactacagcctgggcaacagagcgagactccatctcaaaaaagaaaaacaaagaaataaatgaaagctagcacttactgaatgttaggcactgttctacatgactcatttgctaagccagctggaaagtggcaaagccagaatccaacctgggcgttctgtctgcccagagtaagaacttaataaggagaaattgtagttagttcatagtagctcagcctttcagagaatactaatccttgttctgtagtgatagtcccagttttgtcctagatttagtcacgtctcccaattggacctctctgctgatttggattggctgatctcatctcgctagatattatttgtgttttgttttgttttgttttccagggggaatatgagccgaggaaatagcttatttttccggaaggtcccctttgggaagacttattgttgtgacctgaaaatgttaatttgaagatgtggggcagggacagtgacatttctgtagtcccagatgcacagaattatgggagagaatgttgatttctatacagtgtggcgcgcttttttaataatcatttaatcttgggaaaattcaggtgtttggtgtctgccttttttgttcttttttccagcacaacataacttaccactgatactccccctttagttattctgaattaggatatttttgctccaaattcttattttacttaaccagaagggaaaaaaagttgtattttcctgaagctacaggcactttgtcatgtgatttttgagtctcaatttaaggctttgtaaaatgaagagtagaattccaagaaaaatgagaaataattttgtaaaacttaacaaaatcactaaattaaactatatgggaggttatgaattactttttcttgggtagaccctaaaatgtcagtagcatgcaccagaatctgactcccattatgcttctaagcacatttcattgaccttgtctctcatacttcaagaaaaggacagtacattgctacattaccctagaaagtctgtgtgaggatctgccccttcagtctgttattgcaaagtaataaaatgtcacctacagggagcctctgagcctactctagttcaagaggctacctgaaaaaaaataaataagataaagggtcagcaacaacaaagaaaaagacaattacagaaaataagcaagatttggaaaggaagtataatggcacttttttcctcaaaggaagttcttgttttcacataaaatatgaaaagcagatcctgcaggagtaacccccttctttaagagccaagtatttgccagtgcttaaattacaccataccgttctaattatatataatcttttgttcttcagttttttgttttgtttcctttttgttattgttgccgaaggtgagtagttttgcatttctgatgacagccttggaaagtatatttgtaactccatgtctggtaatgccaacccaagtcgacatgggtcttaggacactgaccacctcacatgccataccctcagttaagcatgttaacatttataggaggaaaaaaatcactttgggagaaaataaaattcaactcaagcataaagcttctgtttactcaggccttctaaaaagcaggttaaaatgctctaaaatgagaaagcctgtggtttcacttatttatataactcactgggacattgccaaatgagtaagcacttaattcgctgcttctgagacttctctgtcaaaacagccccactgataatattagacagaacgagaatgcaggggtctcttccctcccctggggtttaggaagctcatgaggagctcggcttaaaatgtctttgatgtctcttcctttgtctcaaaaagtaatgtcaattttatatactatttcaatattactatctgcatttgttttaatataaaaatgtttgctgcctacctttttctcccaaaaaatctttaagtaaagatgatctgggaaaatg

SEQ ID NO: 75797 - DNA, 1634 bp, Homo sapiens
  misc_feature (5)..(5): n is a, c, g, or t
  misc_feature (25)..(25): n is a, c, g, or t
  misc_feature (28)..(28): n is a, c, g, or t
cgttngatccctccctcagccgganaantaggggaatatgagccgaggaaatagcttatttttccggaaggtcccctttgggaagacttattgttgtgacctgaaaatgttaatttgaagatgtggggcagggacagtgacatttctgtagtcccagatgcacagaattatgggagagaatgttgatttctatacagtgtggcgcgcttttttaataatcatttaatcttgggaaaattcaggtgtttggtgtctgccttttttgttcttttttccagcacaacataacttaccactgatactccccctttagttattctgaattaggatatttttgctccaaattcttattttacttaaccagaagggaaaaaaagttgtattttcctgaagctacaggcactttgtcatgtgatttttgagtctcaatttaaggctttgtaaaatgaagagtagaattccaagaaaaatgagaaataattttgtaaaacttaacaaaatcactaaattaaactatatgggaggttatgaattactttttcttgggtagaccctaaaatgtcagtagcatgcaccagaatctgactcccattatgcttctaagcacatttcattgaccttgtctctcatacttcaagaaaaggacagtacattgctacattaccctagaaagtctgtgtgaggatctgccccttcagtctgttattgcaaagtaataaaatgtcacctacagggagcctctgagcctactctagttcaagaggctacctgaaaaaaaataaataagataaagggtcagcaacaacaaagaaaaagacaattacagaaaataagcaagatttggaaaggaagtataatggcacttttttcctcaaaggaagttcttgttttcacataaaatatgaaaagcagatcctgcaggagtaacccccttctttaagagccaagtatttgccagtgcttaaattacaccataccgttctaattatatataatcttttgttcttcagttttttgttttgtttcctttttgttattgttgccgaaggtgagtagttttgcatttctgatgacagccttggaaagtatatttgtaactccatgtctggtaatgccaacccaagtcgacatgggtcttaggacactgaccacctcacatgccataccctcagttaagcatgttaacatttataggaggaaaaaaatcactttgggagaaaataaaattcaactcaagcataaagcttctgtttactcaggccttctaaaaagcaggttaaaatgctctaaaatgagaaagcctgtggtttcacttatttatataactcactgggacattgccaaatgagtaagcacttaattcgctgcttctgagacttctctgtcaaaacagccccactgataatattagacagaacgagaatgcaggggtctcttccctcccctggggtttaggaagctcatgaggagctcggcttaaaatgtctttgatgtctcttcctttgtctcaaaaagtaatgtcaattttatatactatttcaatattactatctgcatttgttttaatataaaaatgtttgctgcctacctttttctcccaaaaaatctttaagtaaagatgatctgggaaaatg

SEQ ID NO: 75798 - DNA, 1708 bp, Homo sapiens
ttggatagactgtcggctcatattcccctctttttgtagcatgcaccaacaagtctatccaagacgtatatattggggagtaaggagggcatccaccagcaagaggggaatatgagccgaggaaatagcttatttttccggaaggtcccctttgggaagacttattgttgtgacctgaaaatgttaatttgaagatgtggggcagggacagtgacatttctgtagtcccagatgcacagaattatgggagagaatgttgatttctatacagtgtggcgcgcttttttaataatcatttaatcttgggaaaattcaggtgtttggtgtctgccttttttgttcttttttccagcacaacataacttaccactgatactccccctttagttattctgaattaggatatttttgctccaaattcttattttacttaaccagaagggaaaaaaagttgtattttcctgaagctacaggcactttgtcatgtgatttttgagtctcaatttaaggctttgtaaaatgaagagtagaattccaagaaaaatgagaaataattttgtaaaacttaacaaaatcactaaattaaactatatgggaggttatgaattactttttcttgggtagaccctaaaatgtcagtagcatgcaccagaatctgactcccattatgcttctaagcacatttcattgaccttgtctctcatacttcaagaaaaggacagtacattgctacattaccctagaaagtctgtgtgaggatctgccccttcagtctgttattgcaaagtaataaaatgtcacctacagggagcctctgagcctactctagttcaagaggctacctgaaaaaaaataaataagataaagggtcagcaacaacaaagaaaaagacaattacagaaaataagcaagatttggaaaggaagtataatggcacttttttcctcaaaggaagttcttgttttcacataaaatatgaaaagcagatcctgcaggagtaacccccttctttaagagccaagtatttgccagtgcttaaattacaccataccgttctaattatatataatcttttgttcttcagttttttgttttgtttcctttttgttattgttgccgaaggtgagtagttttgcatttctgatgacagccttggaaagtatatttgtaactccatgtctggtaatgccaacccaagtcgacatgggtcttaggacactgaccacctcacatgccataccctcagttaagcatgttaacatttataggaggaaaaaaatcactttgggagaaaataaaattcaactcaagcataaagcttctgtttactcaggccttctaaaaagcaggttaaaatgctctaaaatgagaaagcctgtggtttcacttatttatataactcactgggacattgccaaatgagtaagcacttaattcgctgcttctgagacttctctgtcaaaacagccccactgataatattagacagaacgagaatgcaggggtctcttccctcccctggggtttaggaagctcatgaggagctcggcttaaaatgtctttgatgtctcttcctttgtctcaaaaagtaatgtcaattttatatactatttcaatattactatctgcatttgttttaatataaaaatgtttgctgcctacctttttctcccaaaaaatctttaagtaaagatgatctgggaaaatg

SEQ ID NO: 75799 - DNA, 1635 bp, Homo sapiens
ttggaccctctagctgaaagaggaaatagccggggaatatgagccgaggaaatagcttatttttccggaaggtcccctttgggaagacttattgttgtgacctgaaaatgttaatttgaagatgtggggcagggacagtgacatttctgtagtcccagatgcacagaattatgggagagaatgttgatttctatacagtgtggcgcgcttttttaataatcatttaatcttgggaaaattcaggtgtttggtgtctgccttttttgttcttttttccagcacaacataacttaccactgatactccccctttagttattctgaattaggatatttttgctccaaattcttattttacttaaccagaagggaaaaaaagttgtattttcctgaagctacaggcactttgtcatgtgatttttgagtctcaatttaaggctttgtaaaatgaagagtagaattccaagaaaaatgagaaataattttgtaaaacttaacaaaatcactaaattaaactatatgggaggttatgaattactttttcttgggtagaccctaaaatgtcagtagcatgcaccagaatctgactcccattatgcttctaagcacatttcattgaccttgtctctcatacttcaagaaaaggacagtacattgctacattaccctagaaagtctgtgtgaggatctgccccttcagtctgttattgcaaagtaataaaatgtcacctacagggagcctctgagcctactctagttcaagaggctacctgaaaaaaaataaataagataaagggtcagcaacaacaaagaaaaagacaattacagaaaataagcaagatttggaaaggaagtataatggcacttttttcctcaaaggaagttcttgttttcacataaaatatgaaaagcagatcctgcaggagtaacccccttctttaagagccaagtatttgccagtgcttaaattacaccataccgttctaattatatataatcttttgttcttcagttttttgttttgtttcctttttgttattgttgccgaaggtgagtagttttgcatttctgatgacagccttggaaagtatatttgtaactccatgtctggtaatgccaacccaagtcgacatgggtcttaggacactgaccacctcacatgccataccctcagttaagcatgttaacatttataggaggaaaaaaatcactttgggagaaaataaaattcaactcaagcataaagcttctgtttactcaggccttctaaaaagcaggttaaaatgctctaaaatgagaaagcctgtggtttcacttatttatataactcactgggacattgccaaatgagtaagcacttaattcgctgcttctgagacttctctgtcaaaacagccccactgataatattagacagaacgagaatgcaggggtctcttccctcccctggggtttaggaagctcatgaggagctcggcttaaaatgtctttgatgtctcttcctttgtctcaaaaagtaatgtcaattttatatactatttcaatattactatctgcatttgttttaatataaaaatgtttgctgcctacctttttctcccaaaaaatctttaagtaaagatgatctgggaaaatg

SEQ ID NO: 75800 - DNA, 928 bp, Homo sapiens
  misc_feature (857)..(857): n is a, c, g, or t
  misc_feature (861)..(861): n is a, c, g, or t
  misc_feature (876)..(877): n is a, c, g, or t
  misc_feature (915)..(915): n is a, c, g, or t
ctcgcgagcgcctgccgtttctcggggcgggacgggggggcggggactgggcggagaggcgcgtgctgctgcgtgcgtgcgcgcgcgccgcgggcgggccagtgaaaccggcggccctggcacgtgacctaggaccggctcaccgggtcgcttggtggctccgtctgtctgtccgtccgcccgcgggtgccatcatggcggacgcggccagtcaggtgctcctgggctccggtctcaccatcctgtcccagccgctcatgtacgtgaaagtgctcatccaggtgggatatgagcctcttcctccaacaataggacgaaatatttttgggcggcaagtgtgtcagcttcctggtctctttagttatgctcagcacattgccagtatcgatgggaggcgcgggttgttcacaggcttaactccaagactgtgttcgggagtccttggaactgtggtccatggtaaagttttacagcattaccaggagagtgacaagggtgaggagttaggacctggaaatgtacagaaagaagtctcatcttcctttgaccacgttatcaaggagacaactcgagagatgatcgctcgttctgctgctaccctcatcacacatcccttccatgtgatcactctgagatctatggtacagttcattggcagagaatccaagtactgtggactttgtgattccataataaccatctatcgggaagagggcattctaggatttttcgcgggtcttgttcctcgccttctaggtgacatcctttctttgtggctgtgtaactcactggcctacctcgtcaatacctatgcactggacagtggggggtttctttccaatgaattgaaatgaagngttnttcttcaaagtttgnnaaaggttttttgggggagtttttttggacccttccccngggggttgggttc

SEQ ID NO: 75801 - DNA, 198 bp, Homo sapiens
ttcacatgacactgtaataaccctaatcatcctttttctttttttctatagcattaccaggagagtgacaagggtgaggtatgttggagctgatttctaagcatgagggcctttcccttgcaagttgttactgcttttggggcctcttttggagaaaagccaagtagtcagtctcctattcatctcagtgagtgttgt

SEQ ID NO: 75802 - DNA, 558 bp, Homo sapiens
acagttactgggttgtagtcacaaaacaaaattgttctcttctcccaaaaatgtgagtagagactaaatggagcctgtcatttatctagaatgatgtcagactctccaaaatcacttaccaataagagagcaacttaataatctcaataaaggcctcatattttttatttcagcttaatgactttgttggtgacctttcctgtttctttatttttttctcttacctgtaaaattgagaaaacaacagaagcctgctttgcagagaaattttgagaagtaactataatagaacattgagatccatgagtgaaaagtatgataaaatgacaatgaatgagatctttcacatcccattcaaactcttcttgactccagccagggcaggagggctgtgtcattcactttcttatcctataccacgatatccacccacattccttctcacaggcatttgagtgtcatttgtttagatttcagaagtgtgtgttgattgtttctagacaactcgagagatgatcgctcgttctgctgctaccctcatcacacatcccttccatg

SEQ ID NO: 75803 - DNA, 2622 bp, Homo sapiens
ctcgcgagcgcctgccgtttctcggggcgggacgggggggcggggactgggcggagaggcgcgtgctgctgcgtgcgtgcgcgcgcgccgcgggcgggccagtgaaaccggcggccctggcacgtgacctaggaccggctcaccgggtcgcttggtggctccgtctgtctgtccgtccgcccgcgggtgccatcatggcggacgcggccagtcaggtgctcctgggctccggtctcaccatcctgtcccagccgctcatgtacgtgaaagtgctcatccaggtgggatatgagcctcttcctccaacaataggacgaaatatttttgggcggcaagtgtgtcagcttcctggtctctttagttatgctcagcacattgccagtatcgatgggaggcgcgggttgttcacaggcttaactccaagactgtgttcgggagtccttggaactgtggtccatggtaaagttttacagcattaccaggagagtgacaagggtgaggagttaggacctggaaatgtacagaaagaagtctcatcttcctttgaccacgttatcaaggagacaactcgagagatgatcgctcgttctgctgctaccctcatcacacatcccttccatgtgatcactctgagatctatggtacagttcattggcagagaatccaagtactgtggactttgtgattccataataaccatctatcgggaagagggcattctaggatttttcgcgggtcttgttcctcgccttctaggtgacatcctttctttgtggctgtgtaactcactggcctacctcgtcaatacctatgcactggacagtggggtttctaccatgaatgaaatgaagagttattctcaagctgtcacaggattttttgcgagtatgttgacctatccctttgtgcttgtctccaatcttatggctgtcaacaactgtggtcttgctggtggatgccctccttactccccaatatatacgtcttggatagactgttggtgcatgctacaaaaagaggggaatatgagccgaggaaatagcttatttttccggaaggtcccctttgggaagacttattgttgtgacctgaaaatgttaatttgaagatgtggggcagggacagtgacatttctgtagtcccagatgcacagaattatgggagagaatgttgatttctatacagtgtggcgcgcttttttaataatcatttaatcttgggaaaattcaggtgtttggtgtctgccttttttgttcttttttccagcacaacataacttaccactgatactccccctttagttattctgaattaggatatttttgctccaaattcttattttacttaaccagaagggaaaaaaagttgtattttcctgaagctacaggcactttgtcatgtgatttttgagtctcaatttaaggctttgtaaaatgaagagtagaattccaagaaaaatgagaaataattttgtaaaacttaacaaaatcactaaattaaactatatgggaggttatgaattactttttcttgggtagaccctaaaatgtcagtagcatgcaccagaatctgactcccattatgcttctaagcacatttcattgaccttgtctctcatacttcaagaaaaggacagtacattgctacattaccctagaaagtctgtgtgaggatctgccccttcagtctgttattgcaaagtaataaaatgtcacctacagggagcctctgagcctactctagttcaagaggctacctgaaaaaaaataaataagataaagggtcagcaacaacaaagaaaaagacaattacagaaaataagcaagatttggaaaggaagtataatggcacttttttcctcaaaggaagttcttgttttcacataaaatatgaaaagcagatcctgcaggagtaacccccttctttaagagccaagtatttgccagtgcttaaattacaccataccgttctaattatatataatcttttgttcttcagttttttgttttgtttcctttttgttattgttgccgaaggtgagtagttttgcatttctgatgacagccttggaaagtatatttgtaactccatgtctggtaatgccaacccaagtcgacatgggtcttaggacactgaccacctcacatgccataccctcagttaagcatgttaacatttataggaggaaaaaaatcactttgggagaaaataaaattcaactcaagcataaagcttctgtttactcaggccttctaaaaagcaggttaaaatgctctaaaatgagaaagcctgtggtttcacttatttatataactcactgggacattgccaaatgagtaagcacttaattcgctgcttctgagacttctctgtcaaaacagccccactgataatattagacagaacgagaatgcaggggtctcttccctcccctggggtttaggaagctcatgaggagctcggcttaaaatgtctttgatgtctcttcctttgtctcaaaaagtaatgtcaattttatatactatttcaatattactatctgcatttgttttaatataaaaatgtttgctgcctacctttttctcccaaaaaatctttaagtaaagatgatctgggaaaatg

SEQ ID NO: 75804 - DNA, 1489 bp, Homo sapiens
ctcgcgagcgcctgccgtttctcggggcgggacgggggggcggggactgggcggagaggcgcgtgctgctgcgtgcgtgcgcgcgcgccgcgggcgggccagtgaaaccggcggccctggcacgtgacctaggaccggctcaccgggtcgcttggtggctccgtctgtctgtccgtccgcccgcgggtgccatcatggcggacgcggccagtcaggtgctcctgggctccggtctcaccatcctgtcccagccgctcatgtacgtgaaagtgctcatccaggtgggatatgagcctcttcctccaacaataggacgaaatatttttgggcggcaagtgtgtcagcttcctggtctctttagttatgctcagcacattgccagtatcgatgggaggcgcgggttgttcacaggcttaactccaagactgtgttcgggagtccttggaactgtggtccatggtaaagttttacagcattaccaggagagtgacaagggtgaggagttaggacctggaaatgtacagaaagaagtctcatcttcctttgaccacgttatcaaggagacaactcgagagatgatcgctcgttctgctgctaccctcatcacacatcccttccatgtgatcactctgagatctatggtacagttcattggcagagaatccaagtactgtggactttgtgattccataataaccatctatcgggaagagggcattctaggatttttcgcgggtcttgttcctcgccttctaggtgacatcctttctttgtggctgtgtaactcactggcctacctcgtcaatacctatgcactggacagtggggtttctaccatgaatgaaatgaagagttattctcaagctgtcacaggattttttgcgagtatgttgacctatccctttgtgcttgtctccaatcttatggctgtcaacaactgtggtcttgctggtggatgccctccttactccccaatatatacgtcttggatagactgttggtgcatgctacaaaaagaggggaatatgagccgaggaaatagcttatttttccggaaggtcccctttgggaagacttattgttgtgacctgaaaatgttaatttgaagatgtggggcagggacagtgacatttctgtagtcccagatgcacagaattatgggagagaatgttgatttctatacagtgtggcgcgcttttttaataatcatttaatcttgggaaaattcaggtgtttggtgtctgccttttttgttcttttttccagcacaacataacttaccactgatactccccctttagttattctgaattaggatatttttgctccaaattcttattttacttaaccagaagggaaaaaaagttgtattttcctgaagctacaggcactttgtcatgtgatttttgagtctcaatttaaggctttgtaaaatgaagagtagaattccaagaaaaagtaattcataacctcccatatagtttaattt

SEQ ID NO: 75805 - DNA, 2484 bp, Homo sapiens
ccgtgtggatagggctggtacgagactgggttaatcggcagagggcgggtgccatcatggcggacgcggccagtcaggtgctcctgggctccggtctcaccatcctgtcccagccgctcatgtacgtgaaagtgctcatccaggtgggatatgagcctcttcctccaacaataggacgaaatatttttgggcggcaagtgtgtcagcttcctggtctctttagttatgctcagcacattgccagtatcgatgggaggcgcgggttgttcacaggcttaactccaagactgtgttcgggagtccttggaactgtggtccatggtaaagttttacagcattaccaggagagtgacaagggtgaggagttaggacctggaaatgtacagaaagaagtctcatcttcctttgaccacgttatcaaggagacaactcgagagatgatcgctcgttctgctgctaccctcatcacacatcccttccatgtgatcactctgagatctatggtacagttcattggcagagaatccaagtactgtggactttgtgattccataataaccatctatcgggaagagggcattctaggatttttcgcgggtcttgttcctcgccttctaggtgacatcctttctttgtggctgtgtaactcactggcctacctcgtcaatacctatgcactggacagtggggtttctaccatgaatgaaatgaagagttattctcaagctgtcacaggattttttgcgagtatgttgacctatccctttgtgcttgtctccaatcttatggctgtcaacaactgtggtcttgctggtggatgccctccttactccccaatatatacgtcttggatagactgttggtgcatgctacaaaaagaggggaatatgagccgaggaaatagcttatttttccggaaggtcccctttgggaagacttattgttgtgacctgaaaatgttaatttgaagatgtggggcagggacagtgacatttctgtagtcccagatgcacagaattatgggagagaatgttgatttctatacagtgtggcgcgcttttttaataatcatttaatcttgggaaaattcaggtgtttggtgtctgccttttttgttcttttttccagcacaacataacttaccactgatactccccctttagttattctgaattaggatatttttgctccaaattcttattttacttaaccagaagggaaaaaaagttgtattttcctgaagctacaggcactttgtcatgtgatttttgagtctcaatttaaggctttgtaaaatgaagagtagaattccaagaaaaatgagaaataattttgtaaaacttaacaaaatcactaaattaaactatatgggaggttatgaattactttttcttgggtagaccctaaaatgtcagtagcatgcaccagaatctgactcccattatgcttctaagcacatttcattgaccttgtctctcatacttcaagaaaaggacagtacattgctacattaccctagaaagtctgtgtgaggatctgccccttcagtctgttattgcaaagtaataaaatgtcacctacagggagcctctgagcctactctagttcaagaggctacctgaaaaaaaataaataagataaagggtcagcaacaacaaagaaaaagacaattacagaaaataagcaagatttggaaaggaagtataatggcacttttttcctcaaaggaagttcttgttttcacataaaatatgaaaagcagatcctgcaggagtaacccccttctttaagagccaagtatttgccagtgcttaaattacaccataccgttctaattatatataatcttttgttcttcagttttttgttttgtttcctttttgttattgttgccgaaggtgagtagttttgcatttctgatgacagccttggaaagtatatttgtaactccatgtctggtaatgccaacccaagtcgacatgggtcttaggacactgaccacctcacatgccataccctcagttaagcatgttaacatttataggaggaaaaaaatcactttgggagaaaataaaattcaactcaagcataaagcttctgtttactcaggccttctaaaaagcaggttaaaatgctctaaaatgagaaagcctgtggtttcacttatttatataactcactgggacattgccaaatgagtaagcacttaattcgctgcttctgagacttctctgtcaaaacagccccactgataatattagacagaacgagaatgcaggggtctcttccctcccctggggtttaggaagctcatgaggagctcggcttaaaatgtctttgatgtctcttcctttgtctcaaaaagtaatgtcaattttatatactatttcaatattactatctgcatttgttttaatataaaaatgtttgctgcctacctttttctcccaaaaaatctttaagtaaagatgatctgggaaaatg

SEQ ID NO: 75806 - DNA, 2595 bp, Homo sapiens
ctcgcgagcgcctgccgtttctcggggcgggacgggggggcggggactgggcggagaggcgcgtgctgctgcgtgcgtgcgcgcgcgccgcgggcgggccagtgaaaccggcggccctggcacgtgacctaggaccggctcaccgggtcgcttggtggctccgtctgtctgtccgtccgcccgcgggtgccatcatggcggacgcggccagtcaggtgctcctgggctccggtctcaccatcctgtcccagccgctcatgtacgtgaaagtgctcatccaggtgggatatgagcctcttcctccaacaataggacgaaatatttttgggcggcaagtgtgtcagcttcctggtctctttagttatgctcagcacattgccagtatcgatgggaggcgcgggttgttcacaggcttaactccaagactgtgttcgggagtccttggaactgtggtccatggtaaagttttacaggagttaggacctggaaatgtacagaaagaagtctcatcttcctttgaccacgttatcaaggagacaactcgagagatgatcgctcgttctgctgctaccctcatcacacatcccttccatgtgatcactctgagatctatggtacagttcattggcagagaatccaagtactgtggactttgtgattccataataaccatctatcgggaagagggcattctaggatttttcgcgggtcttgttcctcgccttctaggtgacatcctttctttgtggctgtgtaactcactggcctacctcgtcaatacctatgcactggacagtggggtttctaccatgaatgaaatgaagagttattctcaagctgtcacaggattttttgcgagtatgttgacctatccctttgtgcttgtctccaatcttatggctgtcaacaactgtggtcttgctggtggatgccctccttactccccaatatatacgtcttggatagactgttggtgcatgctacaaaaagaggggaatatgagccgaggaaatagcttatttttccggaaggtcccctttgggaagacttattgttgtgacctgaaaatgttaatttgaagatgtggggcagggacagtgacatttctgtagtcccagatgcacagaattatgggagagaatgttgatttctatacagtgtggcgcgcttttttaataatcatttaatcttgggaaaattcaggtgtttggtgtctgccttttttgttcttttttccagcacaacataacttaccactgatactccccctttagttattctgaattaggatatttttgctccaaattcttattttacttaaccagaagggaaaaaaagttgtattttcctgaagctacaggcactttgtcatgtgatttttgagtctcaatttaaggctttgtaaaatgaagagtagaattccaagaaaaatgagaaataattttgtaaaacttaacaaaatcactaaattaaactatatgggaggttatgaattactttttcttgggtagaccctaaaatgtcagtagcatgcaccagaatctgactcccattatgcttctaagcacatttcattgaccttgtctctcatacttcaagaaaaggacagtacattgctacattaccctagaaagtctgtgtgaggatctgccccttcagtctgttattgcaaagtaataaaatgtcacctacagggagcctctgagcctactctagttcaagaggctacctgaaaaaaaataaataagataaagggtcagcaacaacaaagaaaaagacaattacagaaaataagcaagatttggaaaggaagtataatggcacttttttcctcaaaggaagttcttgttttcacataaaatatgaaaagcagatcctgcaggagtaacccccttctttaagagccaagtatttgccagtgcttaaattacaccataccgttctaattatatataatcttttgttcttcagttttttgttttgtttcctttttgttattgttgccgaaggtgagtagttttgcatttctgatgacagccttggaaagtatatttgtaactccatgtctggtaatgccaacccaagtcgacatgggtcttaggacactgaccacctcacatgccataccctcagttaagcatgttaacatttataggaggaaaaaaatcactttgggagaaaataaaattcaactcaagcataaagcttctgtttactcaggccttctaaaaagcaggttaaaatgctctaaaatgagaaagcctgtggtttcacttatttatataactcactgggacattgccaaatgagtaagcacttaattcgctgcttctgagacttctctgtcaaaacagccccactgataatattagacagaacgagaatgcaggggtctcttccctcccctggggtttaggaagctcatgaggagctcggcttaaaatgtctttgatgtctcttcctttgtctcaaaaagtaatgtcaattttatatactatttcaatattactatctgcatttgttttaatataaaaatgtttgctgcctacctttttctcccaaaaaatctttaagtaaagatgatctgggaaaatg

SEQ ID NO: 75807 - DNA, 2501 bp, Homo sapiens
ctcgcgagcgcctgccgtttctcggggcgggacgggggggcggggactgggcggagaggcgcgtgctgctgcgtgcgtgcgcgcgcgccgcgggcgggccagtgaaaccggcggccctggcacgtgacctaggaccggctcaccgggtcgcttggtggctccgtctgtctgtccgtccgcccgcgggtgccatcatggcggacgcggccagtcaggtgctcctgggctccggtctcaccatcctgtcccagccgctcatgtacgtgaaagtgctcatccaggtgggatatgagcctcttcctccaacaataggacgaaatatttttgggcggcaagtgtgtcagcttcctggtctctttagttatgctcagcacattgccagtatcgatgggaggcgcgggttgttcacaggcttaactccaagactgtgttcgggagtccttggaactgtggtccatggtaaagttttacagcattaccaggagagtgacaagggtgagtgatcactctgagatctatggtacagttcattggcagagaatccaagtactgtggactttgtgattccataataaccatctatcgggaagagggcattctaggatttttcgcgggtcttgttcctcgccttctaggtgacatcctttctttgtggctgtgtaactcactggcctacctcgtcaatacctatgcactggacagtggggtttctaccatgaatgaaatgaagagttattctcaagctgtcacaggattttttgcgagtatgttgacctatccctttgtgcttgtctccaatcttatggctgtcaacaactgtggtcttgctggtggatgccctccttactccccaatatatacgtcttggatagactgttggtgcatgctacaaaaagaggggaatatgagccgaggaaatagcttatttttccggaaggtcccctttgggaagacttattgttgtgacctgaaaatgttaatttgaagatgtggggcagggacagtgacatttctgtagtcccagatgcacagaattatgggagagaatgttgatttctatacagtgtggcgcgcttttttaataatcatttaatcttgggaaaattcaggtgtttggtgtctgccttttttgttcttttttccagcacaacataacttaccactgatactccccctttagttattctgaattaggatatttttgctccaaattcttattttacttaaccagaagggaaaaaaagttgtattttcctgaagctacaggcactttgtcatgtgatttttgagtctcaatttaaggctttgtaaaatgaagagtagaattccaagaaaaatgagaaataattttgtaaaacttaacaaaatcactaaattaaactatatgggaggttatgaattactttttcttgggtagaccctaaaatgtcagtagcatgcaccagaatctgactcccattatgcttctaagcacatttcattgaccttgtctctcatacttcaagaaaaggacagtacattgctacattaccctagaaagtctgtgtgaggatctgccccttcagtctgttattgcaaagtaataaaatgtcacctacagggagcctctgagcctactctagttcaagaggctacctgaaaaaaaataaataagataaagggtcagcaacaacaaagaaaaagacaattacagaaaataagcaagatttggaaaggaagtataatggcacttttttcctcaaaggaagttcttgttttcacataaaatatgaaaagcagatcctgcaggagtaacccccttctttaagagccaagtatttgccagtgcttaaattacaccataccgttctaattatatataatcttttgttcttcagttttttgttttgtttcctttttgttattgttgccgaaggtgagtagttttgcatttctgatgacagccttggaaagtatatttgtaactccatgtctggtaatgccaacccaagtcgacatgggtcttaggacactgaccacctcacatgccataccctcagttaagcatgttaacatttataggaggaaaaaaatcactttgggagaaaataaaattcaactcaagcataaagcttctgtttactcaggccttctaaaaagcaggttaaaatgctctaaaatgagaaagcctgtggtttcacttatttatataactcactgggacattgccaaatgagtaagcacttaattcgctgcttctgagacttctctgtcaaaacagccccactgataatattagacagaacgagaatgcaggggtctcttccctcccctggggtttaggaagctcatgaggagctcggcttaaaatgtctttgatgtctcttcctttgtctcaaaaagtaatgtcaattttatatactatttcaatattactatctgcatttgttttaatataaaaatgtttgctgcctacctttttctcccaaaaaatctttaagtaaagatgatctgggaaaatg

SEQ ID NO: 75808 - DNA, 2554 bp, Homo sapiens
ctcgcgagcgcctgccgtttctcggggcgggacgggggggcggggactgggcggagaggcgcgtgctgctgcgtgcgtgcgcgcgcgccgcgggcgggccagtgaaaccggcggccctggcacgtgacctaggaccggctcaccgggtcgcttggtggctccgtctgtctgtccgtccgcccgcgggtgccatcatggcggacgcggccagtcaggtgctcctgggctccggtctcaccatcctgtcccagccgctcatgtacgtgaaagtgctcatccaggtgggatatgagcctcttcctccaacaataggacgaaatatttttgggcggcaagtgtgtcagcttcctggtctctttagttatgctcagcacattgccagtatcgatgggaggcgcgggttgttcacaggcttaactccaagactgtgttcgggagtccttggaactgtggtccatggtaaagttttacagcattaccaggagagtgacaagggtgaggagttaggacctggaaatgtacagaaagaagtctcatcttcctttgaccacgttatcaaggagacaactcgagagatgatcgctcgttctgctgctaccctcatcacacatcccttccatgtgatcactctgagatctatggtacagttcattggcagagaatccaagtactgtggactttgtgattccataataaccatctatcgggaagagggcattctaggatttttcgcgggtcttgttcctcgccttctaggtgacatcctttctttgtggctgtgtaactcactggcctacctcgtcaatacctatgcactggacagtggggtttctaccatgaatgaaatgaagagttattctcaagctgtcacaggatcttgctggtggatgccctccttactccccaatatatacgtcttggatagactgttggtgcatgctacaaaaagaggggaatatgagccgaggaaatagcttatttttccggaaggtcccctttgggaagacttattgttgtgacctgaaaatgttaatttgaagatgtggggcagggacagtgacatttctgtagtcccagatgcacagaattatgggagagaatgttgatttctatacagtgtggcgcgcttttttaataatcatttaatcttgggaaaattcaggtgtttggtgtctgccttttttgttcttttttccagcacaacataacttaccactgatactccccctttagttattctgaattaggatatttttgctccaaattcttattttacttaaccagaagggaaaaaaagttgtattttcctgaagctacaggcactttgtcatgtgatttttgagtctcaatttaaggctttgtaaaatgaagagtagaattccaagaaaaatgagaaataattttgtaaaacttaacaaaatcactaaattaaactatatgggaggttatgaattactttttcttgggtagaccctaaaatgtcagtagcatgcaccagaatctgactcccattatgcttctaagcacatttcattgaccttgtctctcatacttcaagaaaaggacagtacattgctacattaccctagaaagtctgtgtgaggatctgccccttcagtctgttattgcaaagtaataaaatgtcacctacagggagcctctgagcctactctagttcaagaggctacctgaaaaaaaataaataagataaagggtcagcaacaacaaagaaaaagacaattacagaaaataagcaagatttggaaaggaagtataatggcacttttttcctcaaaggaagttcttgttttcacataaaatatgaaaagcagatcctgcaggagtaacccccttctttaagagccaagtatttgccagtgcttaaattacaccataccgttctaattatatataatcttttgttcttcagttttttgttttgtttcctttttgttattgttgccgaaggtgagtagttttgcatttctgatgacagccttggaaagtatatttgtaactccatgtctggtaatgccaacccaagtcgacatgggtcttaggacactgaccacctcacatgccataccctcagttaagcatgttaacatttataggaggaaaaaaatcactttgggagaaaataaaattcaactcaagcataaagcttctgtttactcaggccttctaaaaagcaggttaaaatgctctaaaatgagaaagcctgtggtttcacttatttatataactcactgggacattgccaaatgagtaagcacttaattcgctgcttctgagacttctctgtcaaaacagccccactgataatattagacagaacgagaatgcaggggtctcttccctcccctggggtttaggaagctcatgaggagctcggcttaaaatgtctttgatgtctcttcctttgtctcaaaaagtaatgtcaattttatatactatttcaatattactatctgcatttgttttaatataaaaatgtttgctgcctacctttttctcccaaaaaatctttaagtaaagatgatctgggaaaatg

SEQ ID NO: 75809 - DNA, 2031 bp, Homo sapiens
ctcgcgagcgcctgccgtttctcggggcgggacgggggggcggggactgggcggagaggcgcgtgctgctgcgtgcgtgcgcgcgcgccgcgggcgggccagtgaaaccggcggccctggcacgtgacctaggaccggctcaccgggtcgcttggtggctccgtctgtctgtccgtccgcccgcgggtgccatcatggcggacgcggccagtcaggtgctcctgggctccggtctcaccatcctgtcccagccgctcatgtacgtgaaagtgctcatccaggtgggatatgagcctcttcctccaacaataggacgaaatatttttgggcggcaagtgtgtcagcttcctggtctctttagttatgcttctaagcacatttcattgaccttgtctctcatacttcaagaaaaggacagtacaaaagaggggaatatgagccgaggaaatagcttatttttccggaaggtcccctttgggaagacttattgttgtgacctgaaaatgttaatttgaagatgtggggcagggacagtgacatttctgtagtcccagatgcacagaattatgggagagaatgttgatttctatacagtgtggcgcgcttttttaataatcatttaatcttgggaaaattcaggtgtttggtgtctgccttttttgttcttttttccagcacaacataacttaccactgatactccccctttagttattctgaattaggatatttttgctccaaattcttattttacttaaccagaagggaaaaaaagttgtattttcctgaagctacaggcactttgtcatgtgatttttgagtctcaatttaaggctttgtaaaatgaagagtagaattccaagaaaaatgagaaataattttgtaaaacttaacaaaatcactaaattaaactatatgggaggttatgaattactttttcttgggtagaccctaaaatgtcagtagcatgcaccagaatctgactcccattatgcttctaagcacatttcattgaccttgtctctcatacttcaagaaaaggacagtacattgctacattaccctagaaagtctgtgtgaggatctgccccttcagtctgttattgcaaagtaataaaatgtcacctacagggagcctctgagcctactctagttcaagaggctacctgaaaaaaaataaataagataaagggtcagcaacaacaaagaaaaagacaattacagaaaataagcaagatttggaaaggaagtataatggcacttttttcctcaaaggaagttcttgttttcacataaaatatgaaaagcagatcctgcaggagtaacccccttctttaagagccaagtatttgccagtgcttaaattacaccataccgttctaattatatataatcttttgttcttcagttttttgttttgtttcctttttgttattgttgccgaaggtgagtagttttgcatttctgatgacagccttggaaagtatatttgtaactccatgtctggtaatgccaacccaagtcgacatgggtcttaggacactgaccacctcacatgccataccctcagttaagcatgttaacatttataggaggaaaaaaatcactttgggagaaaataaaattcaactcaagcataaagcttctgtttactcaggccttctaaaaagcaggttaaaatgctctaaaatgagaaagcctgtggtttcacttatttatataactcactgggacattgccaaatgagtaagcacttaattcgctgcttctgagacttctctgtcaaaacagccccactgataatattagacagaacgagaatgcaggggtctcttccctcccctggggtttaggaagctcatgaggagctcggcttaaaatgtctttgatgtctcttcctttgtctcaaaaagtaatgtcaattttatatactatttcaatattactatctgcatttgttttaatataaaaatgtttgctgcctacctttttctcccaaaaaatctttaagtaaagatgatctgggaaaatg

SEQ ID NO: 75810 - DNA, 786 bp, Homo sapiens
ctcgcgagcgcctgccgtttctcggggcgggacgggggggcggggactgggcggagaggcgcgtgctgctgcgtgcgtgcgcgcgcgccgcgggcgggccagtgaaaccggcggccctggcacgtgacctaggaccggctcaccgggtcgcttggtggctccgtctgtctgtccgtccgcccgcgggtgccatcatggcggacgcggccagtcaggtgctcctgggctccggtctcaccatcctgtcccagccgctcatgtacgtgaaagtgctcatccaggtgggatatgagcctcttcctccaacaataggacgaaatatttttgggcggcaagtgtgtcagcttcctggtctctttagttatgctcagcacattgccagtatcgatgggaggcgcgggttgttcacaggcttaactccaagactgtgttcgggagtccttggaactgtggtccatggtaaagttttacagcattaccaggagagtgacaagggtgaggagttaggacctggaaatgtacagaaagaagtctcatcttcctttgaccacgttatcaaggagacagaacgagaatgcaggggtctcttccctcccctggggtttaggaagctcatgaggagctcggcttaaaatgtctttgatgtctcttcctttgtctcaaaaagtaatgtcaattttatatactatttcaatattactatctgcatttgttttaatataaaaatgtttgctgcctacctttttctcccaaaaaatctttaagtaaagatgatctgggaaaatg

SEQ ID NO: 75811 - DNA, 1348 bp, Homo sapiens
  misc_feature (6)..(8): n is a, c, g, or t
ggccgnnnagagaacctgtaaacgctctcggaattatggcggcggtggatatccgagacaatctgctgggaatttcttgggttgacagctcttggatccctattttgaacagtggtagtgtcctggattacttttcagaaagaagtaatcctttttatgacagaacatgtaataatgaagtggtcaaaatgcagaggctaacattagaacacttgaatcagatggttggaatcgagtacatccttttgcatgctcaagagcccattcttttcatcattcggaagcaacagcggcagtcccctgcccaagttatcccactagctgattactatatcattgctggagtgatctatcaggcaccagacttgggatcagttataaactctagagtgcttactgcagtgcatggtattcagtcagcttttgatgaagctatgtcatactgtcgatatcatccttccaaagggtattggtggcacttcaaagatcatgaagagcaagataaagtcagacctaaagccaaaaggaaagaagaaccaagctctatttttcagagacaacgtgtggatgctttacttttagacctcagacaaaaatttccacccaaatttgtgcagctaaagcctggagaaaagcctgttccagtggatcaaacaaagaaagaggcagaacctataccagaaactgtaaaacctgaggagaaggagaccacaaagaatgtacaacagacagtgagtgctaaaggcccccctgaaaaacggatgagacttcagtgagtactggacaaaagagaagcctggaagactcctcatgctagttatcatacctcagtactgtggctcttgagctttgaagtactttattgtaaccttcttatttgtatggaatgcgcttattttttgaaaggatattaggccggatgtggtggctcacgcctgtaatcccagcactttgggaggccatggcgggtggatcacttgaggtcagaagttcaagaccagcctgaccaatatggtgaaaccccgtctctactaaaaatacaaaaattagccgggcgtggtggcgggcgcccatagtcccagctactcgggaggctgagacaggagacttgcttgaacccgggaggtggaggttgccctgagctgattatcatgctgttgcactccagcttgggcgacagagcgagactttgtctcaaaaaagaagaaaagatattattcccatcatgatttcttgtgaatatttgttatatgtcttctgtaacctttcctctcccggacttgagcaacctacacactcacatgtttactggtagatatgtttaaaagcaaaataaaggtatttgtat

SEQ ID NO: 75812 - DNA, 348 bp, Homo sapiens
gtttgttggattggattctttctatttttctaatcctttatcattttgttttctttcccatagacaatctgctgggaatttcttgggttgacagctcttggatccctattttgaacagtggtagtgtcctggattacttttcagaaagaagtaatcctttttatgacagaacatgtaataatgaagtggtcaaaatgcagaggctaacattagaacacttgaatcagatggttggaatcgagtacatccttttgcatgctcaagagcccattcttttcatcattcggaagcaacagcggcagtcccctgcccaaggtaaaatgtgtaaactttaggcattgttttctt

SEQ ID NO: 75813 - DNA, 2209 bp, Homo sapiens
ggaggtcccattccttccttcttttggtcggttctgagtgtcagctgtctactggggatctgctaaggctaagaggcaaagataggcaagtcactcccctgacctcaagaaactcccagtctacaggcgaagatacaccacccaccggtagagtcgctggaccagaatattaggtgttccagtcaaagtcacccagatttgccaaaagacctggcacaaatgtcacttccactatgaagtcccactgacttccatatacaagacaatctgctgggaatttcttgggttgacagctcttggatccctattttgaacagtggtagtgtcctggattacttttcagaaagaagtaatcctttttatgacagaacatgtaataatgaagtggtcaaaatgcagaggctaacattagaacacttgaatcagatggttggaatcgagtacatccttttgcatgctcaagagcccattcttttcatcattcggaagcaacagcggcagtcccctgcccaagttatcccactagctgattactatatcattgctggagtgatctatcaggcaccagacttgggatcagttataaactctagagtgcttactgcagtgcatggtattcagtcagcttttgatgaagctatgtcatactgtcgatatcatccttccaaagggtattggtggcacttcaaagatcatgaagagcaagataaagtcagacctaaagccaaaaggaaagaagaaccaagctctatttttcagagacaacgtgtggatgctttacttttagacctcagacaaaaatttccacccaaatttgtgcagctaaagcctggagaaaagcctgttccagtggatcaaacaaagaaagaggcagaacctataccagaaactgtaaaacctgaggagaaggagaccacaaagaatgtacaacagacagtgagtgctaaaggcccccctgaaaaacggatgagacttcagtgagtactggacaaaagagaagcctggaagactcctcatgctagttatcatacctcagtactgtggctcttgagctttgaagtactttattgtaaccttcttatttgtatggaatgcgcttattttttgaaaggatattaggccggatgtggtggctcacgcctgtaatcccagcactttgggaggccatggcgggtggatcacttgaggtcagaagttcaagaccagcctgaccaatatggtgaaaccccgtctctactaaaaatacaaaaattagccgggcgtggtggcgggcgcccatagtcccagctactcgggaggctgagacaggagacttgcttgaacccgggaggtggaggttgccctgagctgattatcatgctgttgcactccagcttgggcgacagagcgagactttgtctcaaaaaagaagaaaagatattattcccatcatgatttcttgtgaatatttgttatatgtcttctgtaacctttcctctcccggacttgagcaacctacacactcacatgtttactggtagatatgtttaaaagcaaaataaaggtatttgtatatattgcttcatcatgacttttttcttcatcataactgatatttttcagatgcactttgaagacataaaggatgttaaagtagtaactaagcatatttctttttgttcagttacataatcctcagtattaaaataaacagttgctgacattttggaagatgaagaaaaggaaaaacctcactcaccaataccattaccctataaatactgtaacagtgttgtgaattttaatcttattctgtgtgtagatacttcttttttcaataaagaaaaggaattttattttttttaaagttatggaggctgagaagtccagcattgattggctccatctggtgagggccttcttgctggtaggaagtctgcaaagtccctaggcagcacagggtatctcatggcaagggggctgagtgtgcttgctgcatgtagatgcttttaaaactgtactttaatcattcctttcgtacaattttactttattatatctgttgtaagcttttccccatgtttatgtagtttttatagactgttttagtgtccgaatttctgtaaatgattgtatctcagttttctttctgtcttatatttgggatttttcccagtttacattattttatataagactgctgtgattatatctttgtataatgcctttt

SEQ ID NO: 75814 - DNA, 2310 bp, Homo sapiens
  misc_feature (6)..(8): n is a, c, g, or t
ggccgnnnagagaacctgtaaacgctctcggaattatggcggcggtggatatccgagacaatctgctgggaatttcttgggttgacagctcttggatccctattttgaacagtggtagtgtcctggattacttttcagaaagaagtaatcctttttatgacagaacatgtaataatgaagtggtcaaaatgcagaggctaacattagaacacttgaatcagatggttggaatcgagtacatccttttgcatgctcaagagcccattcttttcatcattcggaagcaacagcggcagtcccctgcccaagttatcccactagctgattactatatcattgctggagtgatctatcaggcaccagacttgggatcagttataaactctagagtggtaagtgtcttcacattctttaagcactaaagaaaacttttaattagctaccttgcttccagtaatcaaactagagctcctctgccttgtgtaagttgctataaagtattgactattagaatgtcttgaactttggttactgtgagccaagtcggtgctcaaagtatatttcatagtctcaattatatagtaatttaggttctgaaaaataggttctgtctttgcatatgtaatatttgtgagtatttactttggaaagtttggtcgacctaatgataaatttagagtttattttccttttacaagcttactgcagtgcatggtattcagtcagcttttgatgaagctatgtcatactgtcgatatcatccttccaaagggtattggtggcacttcaaagatcatgaagagcaagataaagtcagacctaaagccaaaaggaaagaagaaccaagctctatttttcagagacaacgtgtggatgctttacttttagacctcagacaaaaatttccacccaaatttgtgcagctaaagcctggagaaaagcctgttccagtggatcaaacaaagaaagaggcagaacctataccagaaactgtaaaacctgaggagaaggagaccacaaagaatgtacaacagacagtgagtgctaaaggcccccctgaaaaacggatgagacttcagtgagtactggacaaaagagaagcctggaagactcctcatgctagttatcatacctcagtactgtggctcttgagctttgaagtactttattgtaaccttcttatttgtatggaatgcgcttattttttgaaaggatattaggccggatgtggtggctcacgcctgtaatcccagcactttgggaggccatggcgggtggatcacttgaggtcagaagttcaagaccagcctgaccaatatggtgaaaccccgtctctactaaaaatacaaaaattagccgggcgtggtggcgggcgcccatagtcccagctactcgggaggctgagacaggagacttgcttgaacccgggaggtggaggttgccctgagctgattatcatgctgttgcactccagcttgggcgacagagcgagactttgtctcaaaaaagaagaaaagatattattcccatcatgatttcttgtgaatatttgttatatgtcttctgtaacctttcctctcccggacttgagcaacctacacactcacatgtttactggtagatatgtttaaaagcaaaataaaggtatttgtatatattgcttcatcatgacttttttcttcatcataactgatatttttcagatgcactttgaagacataaaggatgttaaagtagtaactaagcatatttctttttgttcagttacataatcctcagtattaaaataaacagttgctgacattttggaagatgaagaaaaggaaaaacctcactcaccaataccattaccctataaatactgtaacagtgttgtgaattttaatcttattctgtgtgtagatacttcttttttcaataaagaaaaggaattttattttttttaaagttatggaggctgagaagtccagcattgattggctccatctggtgagggccttcttgctggtaggaagtctgcaaagtccctaggcagcacagggtatctcatggcaagggggctgagtgtgcttgctgcatgtagatgcttttaaaactgtactttaatcattcctttcgtacaattttactttattatatctgttgtaagcttttccccatgtttatgtagtttttatagactgttttagtgtccgaatttctgtaaatgattgtatctcagttttctttctgtcttatatttgggatttttcccagtttacattattttatataagactgctgtgattatatctttgtataatgcctttt

SEQ ID NO: 75815 - DNA, 1936 bp, Homo sapiens
atatggtagcttgagtttgtgaaacctgcatttccatttgttgctagtaggttttgtgagaaaagaccatttaatacacttaaaataacaaaggtaatttcaagccaataatttggattgtgtgatttaggtaattatgaaaaactttagctttaaaactcttacggttgtgcgtgcttatataccaaaactgaagtatctttaaaagacatatgtatcagcttaaatgttagaatttaacttcagttaagagggagagttaacaacacttctgtatatgtgctgtgtttaccttattttgggaattatctttggtatagcagccattaaaaataatgaagtttgggtatattcatggtggataaagatttgtaaaatatgagacaccaaactaagtaggcaatgttttgatttggacttcgtattttaatagataaagtcagacctaaagccaaaaggaaagaagaaccaagctctatttttcagagacaacgtgtggatgctttacttttagacctcagacaaaaatttccacccaaatttgtgcagctaaagcctggagaaaagcctgttccagtggatcaaacaaagaaagaggcagaacctataccagaaactgtaaaacctgaggagaaggagaccacaaagaatgtacaacagacagtgagtgctaaaggcccccctgaaaaacggatgagacttcagtgagtactggacaaaagagaagcctggaagactcctcatgctagttatcatacctcagtactgtggctcttgagctttgaagtactttattgtaaccttcttatttgtatggaatgcgcttattttttgaaaggatattaggccggatgtggtggctcacgcctgtaatcccagcactttgggaggccatggcgggtggatcacttgaggtcagaagttcaagaccagcctgaccaatatggtgaaaccccgtctctactaaaaatacaaaaattagccgggcgtggtggcgggcgcccatagtcccagctactcgggaggctgagacaggagacttgcttgaacccgggaggtggaggttgccctgagctgattatcatgctgttgcactccagcttgggcgacagagcgagactttgtctcaaaaaagaagaaaagatattattcccatcatgatttcttgtgaatatttgttatatgtcttctgtaacctttcctctcccggacttgagcaacctacacactcacatgtttactggtagatatgtttaaaagcaaaataaaggtatttgtatatattgcttcatcatgacttttttcttcatcataactgatatttttcagatgcactttgaagacataaaggatgttaaagtagtaactaagcatatttctttttgttcagttacataatcctcagtattaaaataaacagttgctgacattttggaagatgaagaaaaggaaaaacctcactcaccaataccattaccctataaatactgtaacagtgttgtgaattttaatcttattctgtgtgtagatacttcttttttcaataaagaaaaggaattttattttttttaaagttatggaggctgagaagtccagcattgattggctccatctggtgagggccttcttgctggtaggaagtctgcaaagtccctaggcagcacagggtatctcatggcaagggggctgagtgtgcttgctgcatgtagatgcttttaaaactgtactttaatcattcctttcgtacaattttactttattatatctgttgtaagcttttccccatgtttatgtagtttttatagactgttttagtgtccgaatttctgtaaatgattgtatctcagttttctttctgtcttatatttgggatttttcccagtttacattattttatataagactgctgtgattatatctttgtataatgcctttt

SEQ ID NO: 75816 - DNA, 883 bp, Homo sapiens
  misc_feature (6)..(8): n is a, c, g, or t
ggccgnnnagagaacctgtaaacgctctcggaattatggcggcggtggatatccgagacaatctgctgggaatttcttgggttgacagctcttggatccctattttgaacagtggtagtgtcctggattacttttcagaaagaagtaatcctttttatgacagaacatgtaataatgaagtggtcaaaatgcagaggctaacattagaacacttgaatcagatggttggaatcgagtacatccttttgcatgctcaagagcccattcttttcatcattcggaagcaacagcggcagtcccctgcccaagttatcccactagctgattactatatcattgctggagtgatctatcaggcaccagacttgggatcagttataaactctagagtgcttactgcagtgcatggtattcagtcagcttttgatgaagctatgtcatactgtcgatatcatccttccaaagggtattggtggcacttcaaagatcatgaagagcaaggtaagtagaacatccataccctcctaaaacactttttgatcctctgagaatgaagctgttttctttaggaaaatggctgttgatcttttctaagtgtgtttcactttttcatgggatgatggctttgttgcagctgagattcatgtaactagatgtggtaataatagctttcacataggaacagatgcaagttcactctgttagttaactggtagtctttgttaaggtgattcaaggttttaaaatatttggggccaggtgtggtggctcactcctgtaatcccagcactttggaatgccaaggcaggtggatcacctgagcctaggagttcaagatcagcttgggcaacatagtgaaacctggtctctacaaaaaaaaaaa

SEQ ID NO: 75817 - DNA, 2004 bp, Homo sapiens
  misc_feature (6)..(8): n is a, c, g, or t
ggccgnnnagagaacctgtaaacgctctcggaattatggcggcggtggatatccgagacaatctgctgggaatttcttgggttgacagctcttggatccctattttgaacagtggtagtgtcctggattacttttcagaaagaagtaatcctttttatgacagaacatgtaataatgaagtggtcaaaatgcagaggctaacattagaacacttgaatcagatggttggaatcgagtacatccttttgcatgctcaagagcccattcttttcatcattcggaagcaacagcggcagtcccctgcccaagttatcccactagctgattactatatcattgctggagtgatctatcaggcaccagacttgggatcagttataaactctagagtgcttactgcagtgcatggtattcagtcagcttttgatgaagctatgtcatactgtcgatatcatccttccaaagggtattggtggcacttcaaagatcatgaagagcaagataaagtcagacctaaagccaaaaggaaagaagaaccaagctctatttttcagagacaacgtgtggatgctttacttttagacctcagacaaaaatttccacccaaatttgtgcagctaaagcctggagaaaagcctgttccagtggatcaaacaaagaaagaggcagaacctataccagaaactgtaaaacctgaggagaaggagaccacaaagaatgtacaacagacagtgagtgctaaaggcccccctgaaaaacggatgagacttcagtgagtactggacaaaagagaagcctggaagactcctcatgctagttatcatacctcagtactgtggctcttgagctttgaagtactttattgtaaccttcttatttgtatggaatgcgcttattttttgaaaggatattaggccggatgtggtggctcacgcctgtaatcccagcactttgggaggccatggcgggtggatcacttgaggtcagaagttcaagaccagcctgaccaatatggtgaaaccccgtctctactaaaaatacaaaaattagccgggcgtggtggcgggcgcccatagtcccagctactcgggaggctgagacaggagacttgcttgaacccgggaggtggaggttgccctgagctgattatcatgctgttgcactccagcttgggcgacagagcgagactttgtctcaaaaaagaagaaaagatattattcccatcatgatttcttgtgaatatttgttatatgtcttctgtaacctttcctctcccggacttgagcaacctacacactcacatgtttactggtagatatgtttaaaagcaaaataaaggtatttgtatatattgcttcatcatgacttttttcttcatcataactgatatttttcagatgcactttgaagacataaaggatgttaaagtagtaactaagcatatttctttttgttcagttacataatcctcagtattaaaataaacagttgctgacattttggaagatgaagaaaaggaaaaacctcactcaccaataccattaccctataaatactgtaacagtgttgtgaattttaatcttattctgtgtgtagatacttcttttttcaataaagaaaaggaattttattttttttaaagttatggaggctgagaagtccagcattgattggctccatctggtgagggccttcttgctggtaggaagtctgcaaagtccctaggcagcacagggtatctcatggcaagggggctgagtgtgcttgctgcatgtagatgcttttaaaactgtactttaatcattcctttcgtacaattttactttattatatctgttgtaagcttttccccatgtttatgtagtttttatagactgttttagtgtccgaatttctgtaaatgattgtatctcagttttctttctgtcttatatttgggatttttcccagtttacattattttatataagactgctgtgattatatctttgtataatgcctttt

SEQ ID NO: 75818 - DNA, 1189 bp, Homo sapiens
  misc_feature (6)..(8): n is a, c, g, or t
ggccgnnnagagaacctgtaaacgctctcggaattatggcggcggtggatatccgagacaatctgctgggaatttcttgggttgacagctcttggatccctattttgaacagtggtagtgtcctggattacttttcagaaagaagtaatcctttttatgacagaacatgtaataatgaagtggtcaaaatgcagaggctaacattagaacacttgaatcagatggttggaatcgagtacatccttttgcatgctcaagagcccattcttttcatcattcggaagcaacagcggcagtcccctgcccaagttatcccactagctgattactatatcattgctggagtgatctatcaggcaccagacttgggatcagttataaactctagagtggtaagtgtcttcacattctttaagcactaaagaaaacttttaattagctaccttgcttccagtaatcaaactagagctcctctgccttgtgtaagttgctataaagtattgactattagaatgtcttgaactttggttactgtgagccaagtcggtgctcaaagtatatttcatagtctcaattatatagtaatttaggttctgaaaaataggttctgtctttgcatatgtaatatttgtgagtatttactttggaaagtttggtcgacctaatgataaatttagagtttattttccttttacaagcttactgcagtgcatggtattcagtcagcttttgatgaagctatgtcatactgtcgatatcatccttccaaagggtattggtggcacttcaaagatcatgaagagcaaggtaagtagaacatccataccctcctaaaacactttttgatcctctgagaatgaagctgttttctttaggaaaatggctgttgatcttttctaagtgtgtttcactttttcatgggatgatggctttgttgcagctgagattcatgtaactagatgtggtaataatagctttcacataggaacagatgcaagttcactctgttagttaactggtagtctttgttaaggtgattcaaggttttaaaatatttggggccaggtgtggtggctcactcctgtaatcccagcactttggaatgccaaggcaggtggatcacctgagcctaggagttcaagatcagcttgggcaacatagtgaaacctggtctctacaaaaaaaaaaa

SEQ ID NO: 75819 - DNA, 898 bp, Homo sapiens
ttcagtgtgtgcgtgtgttttaaatatgttctactttgatcatttcattttgttctatgagttctgcagtgactcagaagttccatgatactataactggagtaattttgctgtatttttagccatgtcctccaagcctcccagtatatgctgtgatctttgccaaacagaatctgatcagtgttacaggggaaatgatgtgtgaggctctacaaggagagggtctccagggcccacacctgagtcatgccttgaagcaacctcagcacacttagcctcccagtgattctgtgcaagtctgtctcaatcttttgagcttatgttagttctttgggggaaaaaaaatagaaacaacttctgaatagggcagtatgtttggggcagctttgtgaatacatatctaaaattacctccatttgccattttttaaatcaattttttttcaagcaatcagattcttttctcctagaggagctgtgggcaagaaaactaatgaattctacatccttctcatcacctggtttaaattgttttctgctctgagtaaacagtaattactgtttaagtacatctcagcagaattttatcccaattgcaacagttcatgttcctcctaatgtaatctctgcagaggaaatgatcgtcaagggaagcaggctgacctgctcacgggatggcgttcttacaatctgcatcttatgtaatggtgattctgtgtgcctgtgtcataattattggaatattattttatgcttttttttttttgagacggagtctcgctctgtcgcccaggctggagtgcagtggcacgatctcagctcactgcaagctcccctcccaggttcacgccattctgcctcagtctcccaagtagctgggactacaggttcccgccacc

SEQ ID NO: 75820 - DNA, 328 bp, Homo sapiens
gccaagatggccgaataggaacagctccggtctacagctcccagcgtgagcaatgcagaagacaggggttaggaaactgttgcctatgggctgaatttggcttgctgtctgcttttagagaccaggatgaatctgaaggctatggtggttattttctaatccaaaaaccagaagcagtactattcaatgagggctctggtaacaaggcctgtgatgtcatcagcaaccaatcagagcttctgaactgcacgtctcacattcagtgttaacatactgagttgatgtaattccaacaaaaaaaaaataaaaagatatgtgctgttttatt

SEQ ID NO: 75821 - DNA, 335 bp, Homo sapiens
ttactatgaaagtttataaaggtcatggtgaagggaagagaaacgcagctggagcccactggcctccctgagttgaggagaaagcactgggaatccaagaagtccacagcagctagagttcacagagagtgtcagagaggacaatgcttggcaaagagaaaactccagaggcatgctgaggacatcctttaggtagtcaactgagtaccgatcagcagagccgtgtgagaaaactaatcaagctgcaaaagacacccaaaaagattacaggaaacaaaccctggtgtgtacataggacaaaaataatgcctatcccctccagacagagggaaaac

SEQ ID NO: 75822 - DNA, 365 bp, Homo sapiens
agtgcctttactttgttaattcaatacaattattttcctaatctcaacttggccactaaataacggtgtgtccttgggctattcactcaacttgtccaagtcacagttttcatacttttaaaaagagtgttgaactaatattgattattcaggccaggcacagtgactcacacctgtaatcccagcaatctgggaggctaaggtgggcaggtcacttgaggtaaagagttcgagaccagcctggccaacatggtaaaactctgtctctactaaaaatacaaaaaatttgctggacatggtggcagacgcttgtaatcccagctacttgggaggctgaggcaggagaattgcttgagtctgggagg

SEQ ID NO: 75823 - DNA, 398 bp, Homo sapiens
atggatggggtgggaaaggagacaaaagtattggtagcagaaattaagatgtagctttaaaaggcaggattaggaggtttagataatattacactggacattaggtaaattagatttacatcatagctgtattcttgtctgactgtgtgtcctcagacaagtctcttcatttctaaaaacctcagtttctatatctgaaagcaaatattggatagcacaatatccaaattacaatatccaaacctccttttaatcttctgtaccaggctacaccaaattaaacgtaaagttttttccttacatgtccacccaataatataattgaatttgaactgcaattttggaatatatacatttgaactgatctaaaattcttaaattacaacacatactcacct

SEQ ID NO: 75824 - DNA, 808 bp, Homo sapiens
ccgcgggcgtcgtcggccatgagcgagttgccgggcgacgtgcgggcgtttctgcgggagcacccgagcctgcggctccagacggacgcccgcaaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgcaccagttgttctgcaaactcaccctgcggcacatcaacaagtgcccagaacacgtgctgaggcacacccagggccggcggtaccagcgagctctgtgtaaatatgaagaatgtcagaagcaaggggtggagtacgtgcctgcctgcctggtgcaccggaggaggaggagggaggaccagatggacggtgacgggcctcgcccgcgggaagccttctgggagcccacatccagtgatgaggggggagctgcaagtgatgacagcatgacagacctgtacccacctgagctattcaccagaaaggaccttggaagcacggaggatggggatggcactgatgactttttgacagacaaagaggatgagaaggcaaagcccccaagagagaaggccactgatgagggcaggagagagacgaccgtgtaccgagggctggtccagaagcgcgggaagaagcagttgggctcgttgaaaaagaagttcaagagtcatcaccgcaaacccaagagcttcagctcctgtaaacagccaggttaataaaagcacatgccgtgaa

SEQ ID NO: 75825 - DNA, 861 bp, Homo sapiens
ccgcgggcgtcgtcggccatgagcgagttgccgggcgacgtgcgggcgtttctgcgggagcacccgagcctgcggctccagacggacgcccgcaaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgcaccagttgttctgcaaactcaccctgcggcacatcaacaagtgcccagaacacgtgctgaggcacacccagggccggcggtaccagcgagctctgtgtaaatatgaagaatgtcagaagcaaggggtggagtacgtgcctgcctgcctggtgcaccggaggaggaggagggaggaccagatggacggtgacgggcctcgcccgcgggaagccttctgggagcccacatccagtgatgaggggggagctgcaagtgatgacagcatgacagacctgtacccacctgagctattcaccagaaaggaccttggaagcacggaggatggggatggcactgatgactttttgacagacaaagaggatgagaaggcaaagcccccaagagagaaggccactgatgagggcaggagagagacgaccgtgtaccgagggctggtccagaagcgcgggaagaagcagttgggctcgttgaaaaagaagttcaagagtcatcaccgcaaacccaagagcttcagctcctgtaaacagccaggttaataaaagcacatgccgtgaacaacaaaaaaacccaacaacacacaacaacaacccacacaccaaccacaacca

SEQ ID NO: 75826 - DNA, 810 bp, Homo sapiens
ctgcaagtgatgacagcatgacagacctgtacccacgtaagcagaacgggccctgcttctccctgaccctctactgtcagcagggagcagactgtggtgctgcctcccctgcaaaggtggcagcgaactcagcctaaaataactgtcagccaatccctgtgttcctcccagctgagctattcaccagaaaggaccttggaagcacggaggatggggatggcactgatgactttttgacagacaaagaggatgagaaggcaaagcccccaagagagaaggccactgatgagggcaggagagagacgaccgtgtaccgagggctggtccagaagcgcgggaaggtgagctgtcacctcctctgttagtgtggcagtggcttcccctagtgatggttttccatttgtttaaaaaaagaaaactgaacctttttcacaagtgaaatcccaagccaacaacacacaagaaccatagaagccgaggccgctggctggcggaaggccgtgagtgcctaccattgcttcccagccagccccttgtggaagccaggctctgtggaccacggtcaagaccactggtttgtgaggacaccctcctacctcagactatgagctgtggcgtgtttgtccttacccctgggcacagggacctgattactagccaccacctttgcctttgccatcagggcaggagtggagacttccccgcctttggtagataagcaggaccaaggccaaaagaggacaaggtcctaatgagtgtgtggcattgcactgtactcctctgaggccctgctgagcggggtctaatcct

SEQ ID NO: 75827 - DNA, 316 bp, Homo sapiens
ggaggttgcagtgagccgagatcgcgccattgcactccagcctgggcgacaagagcgaaactctgtctcaaaaaaagaaagaaattttccctacttaggaaagaaagaagacaattaaagaaaaactacctggttgagtctcaacttctcctttgtggcacttggaatgaatatctgtgcacatccccagctggtatctatctttgtccagcagcctgggagccacagagggtgaatgtgtgtcacttccctctttgctcaaggcccagagcagcgcctggcagtgcaaatgctcttggccaacagttgaatgagt

SEQ ID NO: 75828 - DNA, 811 bp, Homo sapiens
actgaaacagtaacagttcatcaaaagacagttatcccagatacgcttccaagagtggcaatcagttttcctaaagagtcaaagaaaagagtgagaattgtgggaagtgggagactagaaggacagacccatttggaaacaggaagtggttcaaggaacttaggatttggaatataggaaaagaaatggggaaacatacccatgccttctcttctctgtagacatccaatttgaacctactccagattagtaggaagtaaaatcattatctgatgttctgtggccacatggaaaatacattggtagttgcaaccagactagagtcaacattgagaaaccaatagaaccactaacttgggctggtgaggcacagctactggtcaaaacctgcccaggaggcccagtaccactcacagtcaggatcggggtcatggtaggggaaggtcagctagcttactgcagcccatctctgatggggaggtgaggacttccagccctgggctgctcattcacctcccctctggagcagtaaacagggaagtagcaagaagctaagctccttttgttaggcattgttaattcctccaaggtgaccattgatgtattttttattcagtaacttagcatatatgtgtgtgcacaattaatagttatatataataaaagtgaatatattaaaatttaaaaaaataaattatgatcattgcacaattctgtgactatactacaaaccattaaaatgtatactttaaatgggtgttttttatgttatttatgtgattatgtctcaataaagatgttttaaaaccat

SEQ ID NO: 75829 - DNA, 347 bp, Homo sapiens
gctcttcattggacccagtgatcaccaaatccttcaagcataaaatggccatgtgattatctccttcctctcaggatgaaaggcagacaataacatgtgatttatgttcctcaggaaaggacatgctataaactagagaacttgggaaagaggaagtacatgaattaacatgcaggcacatggtggcatgtgcctgtggtgccagctactgggcaggctgagtggcagcattgtttgagcccaggaggtgcaggctatggtgaactgagatcgtactactgcactccagcctggttaacagaatgagaccctgtctgtctttctctctctctctctctctctcacac

SEQ ID NO: 75830 - DNA, 520 bp, Homo sapiens
cccaccctcagactcacttgccggtgaccaagtctggctcacaacatcagacatttctttcctttaggaggatttagattttagaggtcctaattcagtctggactctggtttcatacaatagaatctggcagtggtaaacttaaccatatggggaatggatcagaagagtatgaagtaacccagcaaaaggctggcatcttgcaaaggtggatggagccaagactcttctgagatttcataagtggctttgctgcctgaaacaaagaatagccaaatgaagggatgagcagttttccagcaatgatttgtccaagtaaaatcatggtaccatccaacattgcgagacatctgcagggtgagagctacagcaacgcctctgacaaatggaatgctgaacttgagacatgatttatgcaactatttctcacctctttattccacattccaatcttaggataacatttaaaatcttaatgttgttttcaggaatagccaataaaataaatcggctctgcaaa

SEQ ID NO: 75831 - DNA, 1281 bp, Homo sapiens
gaggggaagatgggttctgcatggagccactccagggacttttcttctgtctcacagcctgacaatcacctctagctgttctcagtcccattctcatcaatgacctcgtctcctgattttgtacaatatctaggtgaccttctcttctttccatcttcaaacgcttgatcattgatgctcccttttctcttctctctcctcctgggaaaagagaaggaccaacatccccctttcccttcctcctgtgctgtcccgacccctctgagacctggctctagcagtaagtccctctctcttctgcagcaccagcctctgcccatccctgccctctgcacacaaagctctcacattgtctgcactttaagaacttttgtggcaaaccctggcaaatcctgccacttgtttccactcttctcaaatggctttgaggtcatcattgacctatcccatttgaccctgtcctgtatctgatgttgtaccctttctccttgatcccactctggcaactctcccactcccctttcttggatcaactgtcttgctcctcagtcttgatcaatgcctccttctctctctttagccttggccctttttggccagggaaataaatgtgaaatacataaagcttcattttatcttatgattatagctatgttgatgttacccaagacctaaaagtcacactctctaattacacttccctcctgtgttctgggtcctcttggaccagtccttactctggctcccctcctggatgtctcccagacttctaattagaattactgtttcctatatcaagctaattatctttcccaccaacctcctccatccttgggtgaaagcatcacttggttgcaaaagtcagaaatctgggtttcattcttgcggtaggtagaataatgcccccaggccccaggttttgacatccgaatccctgggactttgcagatgtgattcagtttaggattttgagatggggagattatctgggagagcctgatgtcatcataaggttcttataagagggaggcaggagggttagagtgagtagtaagagatgcaacagtggaagcaagaggttggggtgatgtggccacaagcccaggagtgctgacagacatcagaagctggaagggacaaggaatggtttctcctctggagcctccagaaagaaccagccctgctgacaccttgattttagccttggaagactcattttggacttctgaccttgaacgttgtaagagaataaatttacatattttaaactggaatgtttat

SEQ ID NO: 75832 - DNA, 626 bp, Homo sapiens
gcagaaaccccagcaaattcttacaggggttagtcatgcagttatacattttcattctgggatttctaggggcttaataaaattccttcattggatcatttaatccaacataaattatttccctacacctactttatacttgctccctgatttcataccagtgagtatagcctgatgtaactaaacattctgaattttcagtgatacccagagaagagtgtgataaccaattctctcaaaagcgatttactgcaaatattttcatttacagtaagtccttacttaacattgtggatatgttcttggaaacagtgactttaagccaaacgaggtactgtgtggcttcataactcaactctttttcctatcaattagactatgggaaaactggtttcgtatgcattatgtccttttgcttaaagtggtagtttccaagaacctatcaatgacattaagtgaggacttattgtaatctgatatctgcgggtggataatttaaggaacacatacatagttaagcctgtaaactgctgcaagttccagatattatcagttctatttctccacaattacaattccagttttggggtttctttttgctcattaaatttgaaaagccaattcca

SEQ ID NO: 75833 - DNA, 592 bp, Homo sapiens
taggcgataactgccgtccttctctgctgtctgcccctaccttgggccccaaatggctcagcactaaagtgccttgagcaggctccagcccaaaggtggcctccatggttaccacttcccactctgctgccctgcctcgctttcctcctcggccttcccggatggatgacagatgtcattcccaggttccctaacactcaagcctagcccctcagtttctagcaagcatcaagcttcactgtgtgtctagcctctcaggagtcagacctgagaagtatagcttggtggaaattcagtggcagggaagaaagaaggaaggaaagaagaccctgagctggattcatacacatcatcgcaattcatccacaccacagtcctgtaagaaggctgcaaaacatacagcagaaaggatggcttgaaggcaattgatgtttgtaaaaaaatccacaacaggatccaagctgaagaggtgaacacgtcagcctggtgggacaattctcagcatgtgcaaacataggtaaattctagcctatgttacattaaaaacaatgtcagtgcattttttcatgttaaagtttttttcaaagctaaa

SEQ ID NO: 75834 - DNA, 360 bp, Homo sapiens
aaccaagaaggttacaaccttgacaaagtctctcattaccttcctcctcttgtgtcttttttctccacattatctgttgcgtatctactatagaaggctgcaaaacatacagcagaaaggatggcttgaaggcaattgatgtttgtaaaaaaatccacaacaggatccaagctgaagaggtgaacacgtcagcctggtgggacaattctcagcatgtgcaaacataggtaaattctagcctatgttacattaaaaacaatgtcagtgcattttttcatgttaaagtttttttcaaagctaaagtgtgttccttgttgtgctgaccacaaacgagttttaagagttttgaaagtctggcaa

SEQ ID NO: 75835 - DNA, 2208 bp, Homo sapiens
  misc_feature (3)..(3): n is a, c, g, or t
  misc_feature (5)..(6): n is a, c, g, or t
  misc_feature (8)..(9): n is a, c, g, or t
  misc_feature (573)..(573): n is a, c, g, or t
  misc_feature (646)..(646): n is a, c, g, or t
  misc_feature (1154)..(1155): n is a, c, g, or t
  misc_feature (1433)..(1433): n is a, c, g, or t
  misc_feature (1747)..(1747): n is a, c, g, or t
  misc_feature (1758)..(1759): n is a, c, g, or t
gtntnntnntgagattgcagcagcactttagtcacattgtcaggctccacttctgattctagttctcttgctacttccaccacatatgcggtgacctcttcccctgatgtcttagacccctcaaaatcattccatggattccatggaatggactccttaaacatggaatccactccttacaaagtccagttaatgttgatactttaatctcctcccatgaatcacaaatactctgaatggcatctagaagggtgaatccttttgaggtttcactttacttttcccaaatccatcagatgaaatactatctatggtagctatagtcttataaaatgtattccttaaacaataaggcttgaaagtcggcttccgttgagcaccaagcaagatggcagcctccgagacagttaggccaaggcttcaatttgattacccgccgccagctacccggcactgtagggccttctggcttctgttccacttgaacagatacgagtcgtcacagatctcgttagtctcatccgccaatgcttcggcttcatttctgccctcctaggcccctacctgaagcgnctcctgccccgggcggagagcgtgcgcctggtgagagagaacgaccgcctcagagttaaagtagaagagagangagttgctgagaattctatggtcatcagtaatggtgacactaatctatcacttagaaaagcaaagaagcgggcatttcagttagaggaggatgaagaaactgaaccagattacaaatattcaaagaagcattggaagaggcaagaaaacaataacaataatgagaaggtctttgatctggaaccaaaagctgtcacagatcagactgccagccaaaaaaaaagaaaaaaaagaaaaaagaaagcccactgtggcacagcaggtgatgataacaaagagaccaaaagaaaatcaccaaagaaaaaggagaaatgtgaatataaaaaaaaaggccaagaatcccaagtctcctgaagtacaggcagtaaaagactgggccaatcagagatgtagttctccaaaaggttctgctagaaacagccttgttaaagccaaaaggaaacgtagtgtaagcgtttgctcaaaagagagtcccagttcctcctcggagtctgagtcttgtgatgaanntatcagtgatggtcccagcacagtcactttggaggccagaaattcctcagagaaattaccgactgagttatcaaaggaaggaccctctaccaaaaatacaactgcagacaaactgggtataaaatctggctttagcttacccccagcaagggcaagacctctggaacaacatcttcctatttcagactctagttcagagtcagatgaccaatgcttgatgtcatcaagcaccctggagtgtgctgcgggtttcttaaagacagtaggcctttttgcangaagaggttgtccgggcccagagttgtcatgacagactgtaggtgctgctggatggaggcgttcttgctcaaatggtggcggacaggctcctggtcctcctctcagtgtgtctctccccaccagtttaggaagaagatggggtagaggagataaccttttttcttgaaagggagctaggggacggggcatgcgggggagaggtcgaggacaagggcatcctgtttcctgtgttgtaaatagaagcactgagaaccagaggcaacagcaattaaatgacctggtaacaaattcatctactattatccagaatccngtagagacacnnaagaaggactatagtctgttaccactgttagcagctgcccctcaagttgaagaaaagattgcatttaagcttttagaactaacatccagaagaatattaagccccaatccagagacccagcaagtagatatagaaattgtttcatccttacccgccttgagagaacctgggaaatttgatttggtttatcacaatgaaaatggaacagagatagtggactacgctgtgacacaggagagcaagatcactgtattttggagagagttgattgacccaagactgatgattgaatctccaagtaacacatcaagtacagaacctgcctgagtatgacattatgtggggagtgaatgtagagttgtgaaaattctcacagtttacatcaagtacgtatggaagctgcttaacactttcaatttagaaacctttgtgatacatctgggaaggta

SEQ ID NO: 75836 - DNA, 342 bp, Homo sapiens
gtgagtggcaggtatcatgaaccacattgtggacctggagttgctaggaccttttctgccattacacagaaaaatcctccctgagaacacagccattggaggacacatggcagaggaagataagacaataaacagagacacataattatggccagcgtgggggctcacgcctgtaatcccaaaactttgggaggccgaggtgggcagatcacctaaggtcaggagttcgaggccagcctggccaacatggtgaaaccccgtctctactaaaaatacaaaaattagccgggcgtggtggcacgggcctgtagtcctagctactccagagggtgaggcaggaga

SEQ ID NO: 75837 - DNA, 435 bp, Homo sapiens
agatttaaaaaaaagaaaaatcatagcttctaagatgattacaaagaaattggtgtgggtttccaacctgggcaacatagtgagacctcatctctaccaaaaataaaaaaaattaaccagtcttggtggcacatacctgtagtcccagctacttgggaggctgagccactgactccagcctgggcaacagagtgagactctgtcttaaaaataaataaatgaataaatattgaaggagagaaggaaggaaatattagtttgcatttttctaaagcatccaaactgttggagatggataagtgcatttataccatgaagactttctagatctattgtttcatttcatttattgcctaagcccagaggaacaaagctgcagtgagctatgatcatgccactacactccagcctgggcgacagagtgagacctgtctc

SEQ ID NO: 75838 - DNA, 770 bp, Homo sapiens
gacagtgtggctggagctgagggagcaacagggagagagctgggagatgaagtccaggaagtggtggaatccagatcagatagagcttttgcttttccccatgggagccacaggagagtcttgaacagaggagtgatatcatctaactacagtttcaaggctccctcgggttaccatgagagaatagcacatagaggagcaaggcgggaggagggagaactttcgagaccattgctgttgcacatcaaggatgaaaggataattttaattgcacaaccttgttccatttgtcacaacatgttccctttttaaactgcagtctaaaagccaccttctccaagaaaggctttaaataaccttatggtctccaagccacttatataaaccctcctatttttccttaatctgtacccgcaaattgctttttttcttctatagactaaaggtcattgctgtcttagcctaatagaaacacaggaattaagtcagccaagtgatataacatggctacttcctaagaaatgacagtggagcaggcttaaaaggctcatcagtctagaacactcttgtctgattagggcctccgttccgacagcatcttcactgtgaagtgagacgaccttgagaatacaaagtgatcaaccagaactcatcttgtgggtcctctggtgtttttccgatttttaattcaacatagtgcacggacttcgatgttcaagtgacagcttaaccagttgtatttaaataatggcatgagcctgttcatcact

SEQ ID NO: 75839 - DNA, 1740 bp, Homo sapiens
cccctgggtggctgcggctggaccttcaccacctcttacaagctcaagaggcacctgcagtcgcacgataaactgcggcccttcggctgccctgcggagggctgtggcaagagcttcaccaccgtgtacaacctcaaggcgcacatgaagggccatgagcaggagaactcgttcaaatgtgaggtgtgcgaggagagcttccccacgcaggccaaactcggcgcccaccagcgcagccacttcgaacccgagaggccttaccagtgcgcgttttctggctgcaagaagacatttatcacagtgagtgctctgttttcccataaccgcgcccatttcagggaacaggaactgttttcctgctctttccctggctgcagcaagcaatatgacaaggcttgtaggctgaaaattcacctgcggagtcacaccggcgagagacctttcctttgtgactttgatggctgtggctggaacttcaccagcatgtccaaactcttaaggcacaaaaggaagcacgacgatgaccggaggttcatgtgccctgtggaaggctgtgggaaatctttcacgagggccgaacatctgaaaggccacagcattacccacctgggcacaaagcctttcgtgtgtcctgtggcaggctgctgtgccaggttctctgctcgcagtagcctctacattcactccaagaaacacctgcaggatgtggacacttggaaaagccgttgcccgatctcctcttgtaataaactcttcacatccaagcacagcatgaagacgcacatggttaaaaggcataaggtgggccaggatctcttagctcagctagaagcagcaaattctcttacacccagcagtgaacttaccagccagagacagaatgatctcagtgatgcagagatagtgtctctcttctctgatgtacctgacagtacttctgctgcattgctggacacagcattggtgaactctggaatcttgactattgatgtggcttctgtgagctcgactctggcagggcacctccctgctaataataataattccgtagggcaggctgtggaccctccgtccttgatggccaccagcgaccctcctcaaagtctggatacctctctcttttttggaacggcggccactggttttcagcagagctccttaaatatggatgaggtctcaagtgtaagtgtggggccattgggatctctggactctttggccatgaaaaactccagtccagagcctcaggctttgacacccagcagtaagctaacagtggacacagatactctgactccttcgagcaccctttgtgaaaacagtgtctcagaactactgacaccagccaaagcggagtggagcgtacatcctaactctgacttctttggacaggagggagaaacccagtttggattccccaatgcagcaggaaaccatggttctcagaaagaaagaaatcttatcactgtgactggcagctcatttttggtatgaagcaactctattcattccttgccatgtggctaacttttattacagtcaattttgaggatattctggactaaatatttaagtgcagtcatttctttttggtttgcaaaaagagcacagccctggactatgagtttggagatctaaattctgatcttgagtctggaactgacaagttgtgtgaccctcagcaagtcacttaacctatctgagccttaatttccttatttataaattgtggtggtttga

SEQ ID NO: 75840 - DNA, 562 bp, Homo sapiens
gagtatcgcttgaatccgggaggtggaggttgcagtgagccgagattgtgccactgcactccaacttggagacagagcgagactccgtctcaaaaaaaaaaaaagtgtgatcatttctgaatacaggggagcaatggattcaagtatcctgattggcttttttgttttctgttttgatttttttttttactgtattttgttaggtcatgttttgatctttttcttttaaccttatccattgccagctctttctcatatattgttttccttccaggcagctcagtctgtatcttcctgcctctttgggtgtctcaaaactgtctgattcatccagttctttaaaatatcaatcacccttcaatactaacaaaacccagcacttattgagtgcctgctgtgcacaaggcactggttagcactcacatgtagttactcattggaatctcataatcacccgatgaagaatgttattattctctctgtattttacataccaaattgttggtatcagcaaatagcaaattatatgagtgtgatctcattaacaagttctgtgcttttc

SEQ ID NO: 75841 - DNA, 2505 bp, Homo sapiens
gcttccggctccggcgtggggtttgatgtctacggagtggcttttgcttagcgtcttgaaggggggaaaaaaatcctctaagctggtgatttcacgttctttgacaaacttcaatagcaacaggcaacgataccactttaagaaaattccaaggaaaagacctcattttaaaattcccacctctggctcccaaagattggtttgcaaacttcgacaaaatactcttctccactcgctattgatggagtctcgctctgtcacccaggctggagtatagtggtgtgatcttggctcactgcaacctctgcctcccaggttcaagcgattctcctgcctcagcctctcgagtagctggaattacaggtctggcagaaggaacagtatcaactgactgagtaggtctcattggcagttgtgattcagagacctagaaagctgaacccacggctggcaagaagaggatggtttgtgggacctgggctgatgtctgatgaaattttaagccccagctatagctactacaaagaaaagtggctgatgataagcatgtaactcaaaaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgagtacaaacaggccgtccatgagcttgtgcgttgcgtagcactgacaagaatttgctatggagactcacattggaaactagcagaggcacatgttaatctggctcaaggctacctccagctgaaaggactgtcactgcaagcaaaacaacatgcagaaaaagccagacaaatcctcgccaactccattgtgcctccctatagtgagaatacagatgttttcaagttttccattgagcttttccataccatgggcagagctttactctcccttcaaaaatttaaggaagctgcagagaatttgacaaaagcagagagactttcaaaggagctgctacaatgtggaagaattataaaggaagaatggatagaaattgaagcacggatcagattatcatttgcacaggtgtatcaaggtcagaagaagtcaaaagaagctttgtcccactatcaagcagctttggaatatgttgagatcagtaaaggtgaaacaagtcgtgagtgtgtacccatattgagagaattagcaggtgtagagcaagccctgggactccacgatgtatccatcaaccacttcctccaggcacatctcatcatcctgagtagaagcccctctcaagtggaggcagcagactcggcacacatcgtcgcccatgctgctgtcgcttcagggagacacgagcaccatgatgtagctgagcagtattttcaagagagcatggctcatcttaaggattctgaagggatgggaagaaccaaatttctttcaattcaagatgaattttgccattttctacaaatgactggacaaaaagagagagcaacctcgatcctgagagagtccctggaagccaaagtggaagcatttggcgatttcagtcccgaggtggcagagacataccggctcctgggaggagcagacctggcgcaggggaaccacagtggggcccgcaagaaactgaagaaggtaaagctggaaccagtactaacacgagactaggctctccctcccctctccaaggtcaatttctctcccttgtggtggttcttttaaatgaaactttagaagtggcttgtttagataggatgacatcacttttgtggtagatctaacctgatacttttgggtaaaagacatagtaagcctcttagacatacatattttttaaatgaattatcagtttttactatgcaaatatttttaattttttacgtagtacaattgatcagtcctttatgtttgcggtgctctctctatactgagtttatagaggaattctcttacactttcttcaattgtcattcttctttaaatttggagtttatttgtgtggatggcatgaggaatggatctaatcttaccttttttccaaatggccacccagttgtccagcaccatttaattagagagcccatctatgctccagtgacttcagataacaccttcatcatatactgattttccttatggacttaagtctatttctagatttctcttctcttccactagtctttctgtttattcatgtgtcaatatttcagttttaattacagagattttatagaatgatttaatatgtgataggagtagacaccccttatggcttttcttttactagaatatcaggtgttctagctattcttccgtgtttatttttctacatgaatttttgtatcaatttgtctaactccataaagagcttactagtatttttattgcattatttataaataaatcttgtgagaattga

SEQ ID NO: 75842 - DNA, 268 bp, Homo sapiens
tgcagtcttgttcccatcagagagagatgatctctctctccaccatgtgaggacacagtgagaagacagccgtctgcaggcccggaagagagccctcaccaggaaatgaaactgttggcaccttgagacttcccagcttccagaactgtaagaaataaatgtttgttgtttaagcctttcaggctacggctttctgttacagcagcctgaactgagagtccatgccgagtttttgaaataaatgtgaattctgatgttaaaaaaaact

SEQ ID NO: 75843 - DNA, 3805 bp, Homo sapiens
gcttccggctccggcgtggggtttgatgtctacggagtggcttttgcttagcgtcttgaaggggggaaaaaaatcctctaagctggtgatttcacgttctttgacaaacttcaatagcaacaggcaacgataccactttaagaaaattccaaggaaaagacctcattttaaaattcccacctctggctcccaaagattggtttgcaaacttcgacaaaatactcttctccactcgctattgatggagtctcgctctgtcacccaggctggagtatagtggtgtgatcttggctcactgcaacctctgcctcccaggttcaagcgattctcctgcctcagcctctcgagtagctggaattacaggtctggcagaaggaacagtatcaactgactgagtaggtctcattggcagttgtgattcagagacctagaaagctgaacccacggctggcaagaagaggatggtttgtgggacctgggctgatgtctgatgaaattttaagccccagctatagctactacaaagaaaagtggctgatgataagcatgtaactcaaaaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgagtacaaacaggccgtccatgagcttgtgcgttgcgtagcactgacaagaatttgctatggagactcacattggaaactagcagaggcacatgttaatctggctcaaggctacctccagctgaaaggactgtcactgcaagcaaaacaacatgcagaaaaagccagacaaatcctcgccaactccattgtgcctccctatagtgagaatacagatgttttcaagttttccattgagcttttccataccatgggcagagctttactctcccttcaaaagtatccttttgcctctaacttttacaaatagaaatactattcacgtaacacttacacgccaagtaaaaagctgatgctgatggatgacttaggaagtgtgattggaagtatgggagccaaggaagttcaggacatggggtgtagaatctagaaccaagtggaaaatttcctgaacacaattcagatttaaggaagctgcagagaatttgacaaaagcagagagactttcaaaggagctgctacaatgtggaagaattataaaggaagaatggatagaaattgaagcacggatcagattatcatttgcacaggtgtatcaaggtcagaagaagtcaaaagaagctttgtcccactatcaagcagctttggaatatgttgagatcagtaaaggtgaaacaagtcgtgagtgtgtacccatattgagagaattagcaggtgtagagcaagccctgggactccacgatgtatccatcaaccacttcctccaggcacatctcatcatcctgagtagaagcccctctcaagtggaggcagcagactcggcacacatcgtcgcccatgctgctgtcgcttcagggagacacgagcaccatgatgtagctgagcagtattttcaagagagcatggctcatcttaaggattctgaagggatgggaagaaccaaatttctttcaattcaagatgaattttgccattttctacaaatgactggacaaaaagagagagcaacctcgatcctgagagagtccctggaagccaaagtggaagcatttggcgatttcagtcccgaggtggcagagacataccggctcctgggaggagcagacctggcgcaggggaaccacagtggggcccgcaagaaactgaagaagtgtctccagatccagaccctcttatatggaccgcaggacaaaaggactctggccacccagcaggccatgggcatgctgtccacggcccccaaggttgcttcgaagccaaggcaggcatcaaaagccaaagtggccttctgcaccagcatccctcaggacaccctgctggggaaggcccggcccggcacaacagcagactgaggcccccaccctgaaaaagcctaggacattcctgggcactgtcatttagggtgctgtacaaatcacctccgcctagaaaatggaattcaacagtcaggatacagatttccaaggccaactgttggccccaacatgcaacagtgagaccataagcctcccgtgggccacattttgacagtggatgcccttcagggtgatatatgctataaagcagttttctatcacctaagtggtttttcttgccaacaagaatttttacccatcagcactactgtggctgaaaaacttctcttcaacagttcagtgcgccctgtgcaggagtcagcccggcatctgcttgtacacacagctccttgcataggtgtggagttagatctggacagtgaacttcaggaagtcctttcttataggaggctaatagggattgagaataacatgagaagaaaacgctaataaagggaaacctgaacacgctgctgtcagcatgtgttttcaaagtgcagcctgcctcagagttcttcggagcctgaaaaggggtttgagaaagagcccagtaggaggggcaggaggccgacacacctgacttggcctggggcccaggaggcaggtgtaagggagtgaaaagaaaggctagccggaggctgcggggggaagaccgcagactccctgctgcttcgcatccctcctgtggcctccactgcaggcaggacaaacctggatgccacctggagctgcttcctgagttggcacactatcgtgtacacagcagtcttcagccccctggaaggaggccatagtcgtgtgaggatggcaaagtcgaacaggaagctttgagtgccttcctccacgatgtcaacgaggagatccagtgccagatcgaggtggatggaacacccaggggtaggggtgcaggtgtgggcagtgatgtcccttcccctccctcccctggtcccacagactgtggccatgaggctgcaggctggtgctatgacagcagattgcagcacagggccctcccctccagcccccagtgggacatcaaaaccaccctggggccatttgtgcagggcaccacctccagtattgatggggaaaataaactcagtagagccacgacagggtggagagaagcagggaccattgtcttcctcaggagcgtgacagctgaccccacagaccatgcttgctggtacacactggtcccagacccaggcctgtcggacatcagcagtgtgctaaaaacgtgtaagatgtggtcactactcaccgtgtgtcctatctagttgacatgggtggagtcagctaaggggtgaatgttcatatgctcccaattcacgttgaagccctaatccccaaagggatggtattgggggtggggtcttggagaggtgattaggttatgagggtggagccctgatgaatgggattagtgctttataaggagagacaccagagagatgatctctctctccaccatgtgaggacacagtgagaagacagccgtctgcaggcccggaagagagccctcaccaggaaatgaaactgttggcaccttgagacttcccagcttccagaactgtaagaaataaatgtttgttgtttaagcctttcaggctacggctttctgttacagcagcctgaactgagagtccatgccgagtttttgaaataaatgtgaattctgatgttaaaaaaaact

SEQ ID NO: 75844 - DNA, 3773 bp, Homo sapiens
ggacgcgtgggtccggacgcgtggtgtcgacccacgcgtgcggtgaggtacccgcttgctttatgggaaaaggctgctccggaactgccctactttagactttttcatggttatcaatctgtacaaagaatcaccaaactgataaagcaggaaccagagggcaaatcacgctgccaagacaactgtgtaattcgctcgaaaaagaaacgatggagtctcgctctgtcacccaggctggagtatagtggtgtgatcttggctcactgcaacctctgcctcccaggttcaagcgattctcctgcctcagcctctcgagtagctggaattacaggtctggcagaaggaacagtatcaactgactgagtaggtctcattggcagttgtgattcagagacctagaaagctgaacccacggctggcaagaagaggatggtttgtgggacctgggctgatgtctgatgaaattttaagccccagctatagctactacaaagaaaagtggctgatgataagcatgtaactcaaaaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgagtacaaacaggccgtccatgagcttgtgcgttgcgtagcactgacaagaatttgctatggagactcacattggaaactagcagaggcacatgttaatctggctcaaggctacctccagctgaaaggactgtcactgcaagcaaaacaacatgcagaaaaagccagacaaatcctcgccaactccattgtgcctccctatagtgagaatacagatgttttcaagttttccattgagcttttccataccatgggcagagctttactctcccttcaaaagtatccttttgcctctaacttttacaaatagaaatactattcacgtaacacttacacgccaagtaaaaagctgatgctgatggatgacttaggaagtgtgattggaagtatgggagccaaggaagttcaggacatggggtgtagaatctagaaccaagtggaaaatttcctgaacacaattcagatttaaggaagctgcagagaatttgacaaaagcagagagactttcaaaggagctgctacaatgtggaagaattataaaggaagaatggatagaaattgaagcacggatcagattatcatttgcacaggtgtatcaaggtcagaagaagtcaaaagaagctttgtcccactatcaagcagctttggaatatgttgagatcagtaaaggtgaaacaagtcgtgagtgtgtacccatattgagagaattagcaggtgtagagcaagccctgggactccacgatgtatccatcaaccacttcctccaggcacatctcatcatcctgagtagaagcccctctcaagtggaggcagcagactcggcacacatcgtcgcccatgctgctgtcgcttcagggagacacgagcaccatgatgtagctgagcagtattttcaagagagcatggctcatcttaaggattctgaagggatgggaagaaccaaatttctttcaattcaagatgaattttgccattttctacaaatgactggacaaaaagagagagcaacctcgatcctgagagagtccctggaagccaaagtggaagcatttggcgatttcagtcccgaggtggcagagacataccggctcctgggaggagcagacctggcgcaggggaaccacagtggggcccgcaagaaactgaagaagtgtctccagatccagaccctcttatatggaccgcaggacaaaaggactctggccacccagcaggccatgggcatgctgtccacggcccccaaggttgcttcgaagccaaggcaggcatcaaaagccaaagtggccttctgcaccagcatccctcaggacaccctgctggggaaggcccggcccggcacaacagcagactgaggcccccaccctgaaaaagcctaggacattcctgggcactgtcatttagggtgctgtacaaatcacctccgcctagaaaatggaattcaacagtcaggatacagatttccaaggccaactgttggccccaacatgcaacagtgagaccataagcctcccgtgggccacattttgacagtggatgcccttcagggtgatatatgctataaagcagttttctatcacctaagtggtttttcttgccaacaagaatttttacccatcagcactactgtggctgaaaaacttctcttcaacagttcagtgcgccctgtgcaggagtcagcccggcatctgcttgtacacacagctccttgcataggtgtggagttagatctggacagtgaacttcaggaagtcctttcttataggaggctaatagggattgagaataacatgagaagaaaacgctaataaagggaaacctgaacacgctgctgtcagcatgtgttttcaaagtgcagcctgcctcagagttcttcggagcctgaaaaggggtttgagaaagagcccagtaggaggggcaggaggccgacacacctgacttggcctggggcccaggaggcaggtgtaagggagtgaaaagaaaggctagccggaggctgcggggggaagaccgcagactccctgctgcttcgcatccctcctgtggcctccactgcaggcaggacaaacctggatgccacctggagctgcttcctgagttggcacactatcgtgtacacagcagtcttcagccccctggaaggaggccatagtcgtgtgaggatggcaaagtcgaacaggaagctttgagtgccttcctccacgatgtcaacgaggagatccagtgccagatcgaggtggatggaacacccaggggtaggggtgcaggtgtgggcagtgatgtcccttcccctccctcccctggtcccacagactgtggccatgaggctgcaggctggtgctatgacagcagattgcagcacagggccctcccctccagcccccagtgggacatcaaaaccaccctggggccatttgtgcagggcaccacctccagtattgatggggaaaataaactcagtagagccacgacagggtggagagaagcagggaccattgtcttcctcaggagcgtgacagctgaccccacagaccatgcttgctggtacacactggtcccagacccaggcctgtcggacatcagcagtgtgctaaaaacgtgtaagatgtggtcactactcaccgtgtgtcctatctagttgacatgggtggagtcagctaaggggtgaatgttcatatgctcccaattcacgttgaagccctaatccccaaagggatggtattgggggtggggtcttggagaggtgattaggttatgagggtggagccctgatgaatgggattagtgctttataaggagagacaccagagagatgatctctctctccaccatgtgaggacacagtgagaagacagccgtctgcaggcccggaagagagccctcaccaggaaatgaaactgttggcaccttgagacttcccagcttccagaactgtaagaaataaatgtttgttgtttaagcctttcaggctacggctttctgttacagcagcctgaactgagagtccatgccgagtttttgaaataaatgtgaattctgatgttaaaaaaaact

SEQ ID NO: 75845 - DNA, 3702 bp, Homo sapiens
ggacgcgtgggtccggacgcgtggtgtcgacccacgcgtgcggtgaggtacccgcttgctttatgggaaaaggctgctccggaactgccctactttagactttttcatggttatcaatctgtacaaagaatcaccaaactgataaagcaggaaccagagggcaaatcacgctgccaagacaactgtgtaattcgctcgaaaaagaaacggtgagcctctccagcagactgggtaaactggcaagggattttacgacatagttggagattggagagttacagaaacttttccggttttttacaagttttaaaggagtgattgagtgtcaaaggaaaagcagagaaaatacaggcacaatttaaagacagcaggaagaagagtgttcagagagcatttttctctttagggtgaagtttgaaagcatcatgcccagattatcagtggatttttgaaagaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgagtacaaacaggccgtccatgagcttgtgcgttgcgtagcactgacaagaatttgctatggagactcacattggaaactagcagaggcacatgttaatctggctcaaggctacctccagctgaaaggactgtcactgcaagcaaaacaacatgcagaaaaagccagacaaatcctcgccaactccattgtgcctccctatagtgagaatacagatgttttcaagttttccattgagcttttccataccatgggcagagctttactctcccttcaaaagtatccttttgcctctaacttttacaaatagaaatactattcacgtaacacttacacgccaagtaaaaagctgatgctgatggatgacttaggaagtgtgattggaagtatgggagccaaggaagttcaggacatggggtgtagaatctagaaccaagtggaaaatttcctgaacacaattcagatttaaggaagctgcagagaatttgacaaaagcagagagactttcaaaggagctgctacaatgtggaagaattataaaggaagaatggatagaaattgaagcacggatcagattatcatttgcacaggtgtatcaaggtcagaagaagtcaaaagaagctttgtcccactatcaagcagctttggaatatgttgagatcagtaaaggtgaaacaagtcgtgagtgtgtacccatattgagagaattagcaggtgtagagcaagccctgggactccacgatgtatccatcaaccacttcctccaggcacatctcatcatcctgagtagaagcccctctcaagtggaggcagcagactcggcacacatcgtcgcccatgctgctgtcgcttcagggagacacgagcaccatgatgtagctgagcagtattttcaagagagcatggctcatcttaaggattctgaagggatgggaagaaccaaatttctttcaattcaagatgaattttgccattttctacaaatgactggacaaaaagagagagcaacctcgatcctgagagagtccctggaagccaaagtggaagcatttggcgatttcagtcccgaggtggcagagacataccggctcctgggaggagcagacctggcgcaggggaaccacagtggggcccgcaagaaactgaagaagtgtctccagatccagaccctcttatatggaccgcaggacaaaaggactctggccacccagcaggccatgggcatgctgtccacggcccccaaggttgcttcgaagccaaggcaggcatcaaaagccaaagtggccttctgcaccagcatccctcaggacaccctgctggggaaggcccggcccggcacaacagcagactgaggcccccaccctgaaaaagcctaggacattcctgggcactgtcatttagggtgctgtacaaatcacctccgcctagaaaatggaattcaacagtcaggatacagatttccaaggccaactgttggccccaacatgcaacagtgagaccataagcctcccgtgggccacattttgacagtggatgcccttcagggtgatatatgctataaagcagttttctatcacctaagtggtttttcttgccaacaagaatttttacccatcagcactactgtggctgaaaaacttctcttcaacagttcagtgcgccctgtgcaggagtcagcccggcatctgcttgtacacacagctccttgcataggtgtggagttagatctggacagtgaacttcaggaagtcctttcttataggaggctaatagggattgagaataacatgagaagaaaacgctaataaagggaaacctgaacacgctgctgtcagcatgtgttttcaaagtgcagcctgcctcagagttcttcggagcctgaaaaggggtttgagaaagagcccagtaggaggggcaggaggccgacacacctgacttggcctggggcccaggaggcaggtgtaagggagtgaaaagaaaggctagccggaggctgcggggggaagaccgcagactccctgctgcttcgcatccctcctgtggcctccactgcaggcaggacaaacctggatgccacctggagctgcttcctgagttggcacactatcgtgtacacagcagtcttcagccccctggaaggaggccatagtcgtgtgaggatggcaaagtcgaacaggaagctttgagtgccttcctccacgatgtcaacgaggagatccagtgccagatcgaggtggatggaacacccaggggtaggggtgcaggtgtgggcagtgatgtcccttcccctccctcccctggtcccacagactgtggccatgaggctgcaggctggtgctatgacagcagattgcagcacagggccctcccctccagcccccagtgggacatcaaaaccaccctggggccatttgtgcagggcaccacctccagtattgatggggaaaataaactcagtagagccacgacagggtggagagaagcagggaccattgtcttcctcaggagcgtgacagctgaccccacagaccatgcttgctggtacacactggtcccagacccaggcctgtcggacatcagcagtgtgctaaaaacgtgtaagatgtggtcactactcaccgtgtgtcctatctagttgacatgggtggagtcagctaaggggtgaatgttcatatgctcccaattcacgttgaagccctaatccccaaagggatggtattgggggtggggtcttggagaggtgattaggttatgagggtggagccctgatgaatgggattagtgctttataaggagagacaccagagagatgatctctctctccaccatgtgaggacacagtgagaagacagccgtctgcaggcccggaagagagccctcaccaggaaatgaaactgttggcaccttgagacttcccagcttccagaactgtaagaaataaatgtttgttgtttaagcctttcaggctacggctttctgttacagcagcctgaactgagagtccatgccgagtttttgaaataaatgtgaattctgatgttaaaaaaaact

SEQ ID NO: 75846 - DNA, 3657 bp, Homo sapiens
ggacgcgtgggtccggacgcgtggtgtcgacccacgcgtgcggtgaggtacccgcttgctttatgggaaaaggctgctccggaactgccctactttagactttttcatggttatcaatctgtacaaagaatcaccaaactgataaagcaggaaccagagggcaaatcacgctgccaagacaactgtgtaattcgctcgaaaaagaaacgatggagtctcgctctgtcacccaggctggagtatagtggtgtgatcttggctcactgcaacctctgcctcccaggttcaagcgattctcctgcctcagcctctcgagtagctggaattacaggtctggcagaaggaacagtatcaactgactgagtaggtctcattggcagttgtgattcagagacctagaaagctgaacccacggctggcaagaagaggatggtttgtgggacctgggctgatgtctgatgaaattttaagccccagctatagctactacaaagaaaagtggctgatgataagcatgtaactcaaaaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgagtacaaacaggccgtccatgagcttgtgcgttgcgtagcactgacaagaatttgctatggagactcacattggaaactagcagaggcacatgttaatctggctcaaggctacctccagctgaaaggactgtcactgcaagcaaaacaacatgcagaaaaagccagacaaatcctcgccaactccattgtgcctccctatagtgagaatacagatgttttcaagttttccattgagcttttccataccatgggcagagctttactctcccttcaaaaatttaaggaagctgcagagaatttgacaaaagcagagagactttcaaaggagctgctacaatgtggaagaattataaaggaagaatggatagaaattgaagcacggatcagattatcatttgcacaggtgtatcaaggtcagaagaagtcaaaagaagctttgtcccactatcaagcagctttggaatatgttgagatcagtaaaggtgaaacaagtcgtgagtgtgtacccatattgagagaattagcaggtgtagagcaagccctgggactccacgatgtatccatcaaccacttcctccaggcacatctcatcatcctgagtagaagcccctctcaagtggaggcagcagactcggcacacatcgtcgcccatgctgctgtcgcttcagggagacacgagcaccatgatgtagctgagcagtattttcaagagagcatggctcatcttaaggattctgaagggatgggaagaaccaaatttctttcaattcaagatgaattttgccattttctacaaatgactggacaaaaagagagagcaacctcgatcctgagagagtccctggaagccaaagtggaagcatttggcgatttcagtcccgaggtggcagagacataccggctcctgggaggagcagacctggcgcaggggaaccacagtggggcccgcaagaaactgaagaagggagaccttagtttcctgctctcagcgacacttccatagcctcatgatagctgcttggtgttctacagtgtctccagatccagaccctcttatatggaccgcaggacaaaaggactctggccacccagcaggccatgggcatgctgtccacggcccccaaggttgcttcgaagccaaggcaggcatcaaaagccaaagtggccttctgcaccagcatccctcaggacaccctgctggggaaggcccggcccggcacaacagcagactgaggcccccaccctgaaaaagcctaggacattcctgggcactgtcatttagggtgctgtacaaatcacctccgcctagaaaatggaattcaacagtcaggatacagatttccaaggccaactgttggccccaacatgcaacagtgagaccataagcctcccgtgggccacattttgacagtggatgcccttcagggtgatatatgctataaagcagttttctatcacctaagtggtttttcttgccaacaagaatttttacccatcagcactactgtggctgaaaaacttctcttcaacagttcagtgcgccctgtgcaggagtcagcccggcatctgcttgtacacacagctccttgcataggtgtggagttagatctggacagtgaacttcaggaagtcctttcttataggaggctaatagggattgagaataacatgagaagaaaacgctaataaagggaaacctgaacacgctgctgtcagcatgtgttttcaaagtgcagcctgcctcagagttcttcggagcctgaaaaggggtttgagaaagagcccagtaggaggggcaggaggccgacacacctgacttggcctggggcccaggaggcaggtgtaagggagtgaaaagaaaggctagccggaggctgcggggggaagaccgcagactccctgctgcttcgcatccctcctgtggcctccactgcaggcaggacaaacctggatgccacctggagctgcttcctgagttggcacactatcgtgtacacagcagtcttcagccccctggaaggaggccatagtcgtgtgaggatggcaaagtcgaacaggaagctttgagtgccttcctccacgatgtcaacgaggagatccagtgccagatcgaggtggatggaacacccaggggtaggggtgcaggtgtgggcagtgatgtcccttcccctccctcccctggtcccacagactgtggccatgaggctgcaggctggtgctatgacagcagattgcagcacagggccctcccctccagcccccagtgggacatcaaaaccaccctggggccatttgtgcagggcaccacctccagtattgatggggaaaataaactcagtagagccacgacagggtggagagaagcagggaccattgtcttcctcaggagcgtgacagctgaccccacagaccatgcttgctggtacacactggtcccagacccaggcctgtcggacatcagcagtgtgctaaaaacgtgtaagatgtggtcactactcaccgtgtgtcctatctagttgacatgggtggagtcagctaaggggtgaatgttcatatgctcccaattcacgttgaagccctaatccccaaagggatggtattgggggtggggtcttggagaggtgattaggttatgagggtggagccctgatgaatgggattagtgctttataaggagagacaccagagagatgatctctctctccaccatgtgaggacacagtgagaagacagccgtctgcaggcccggaagagagccctcaccaggaaatgaaactgttggcaccttgagacttcccagcttccagaactgtaagaaataaatgtttgttgtttaagcctttcaggctacggctttctgttacagcagcctgaactgagagtccatgccgagtttttgaaataaatgtgaattctgatgttaaaaaaaact

SEQ ID NO: 75847 - DNA, 4389 bp, Homo sapiens
tggctgcttgcattttaattttcttgaagacctaaaaatggttggcagatcagaatgaataaacaggcttcagtagtaagtccccaaaccctcacacttttttttactcaagctatttatgtagcacaattcatccgatttttaaaaaatatattatgaaacatttgttatgcagaaaagtatggataacataacaaagacctttgaactcaccattcagtataagaaataaaacatgacccatccagttgaagtcccctctatacctaccccatccccagataactacttttttaaatttgatatcattcccatgctcttcttattttactatggttttgttttgcatgttttaaaacttcatattaaattataatacatattatatgcattcatctgtcgttttctttttccccttgactttgtaatcatgagattcatctatgtggttatatatacacatacatatatcaaacatttatatatcacatacatatataatatatacatatcacagtttacatattcattactaaatattgctaaattgttttacaaaggggctataccagtttgaatacccactatcaatatataaaagaattcttgttgctttgtatctttaacaaaacttggtagtttttgcagtctggtgggtgaaatggtacctacctcattgaggttttagtttgtatttctggttgttaatgagattaagcatgtttatttcatcagatttcaactctttgaataatctgtttatatcttttgagtgttattctattgagaggttttggtttggtttggtatttctcattaccttataggaattcttcatgtattctgaatgttaaacctttctcatttctgtgcactgcaagaatctttcctcagcgtggcttgtctttctactttgcttatggtgaattttggtgcacaaatattttaggttttcacatagttacattttatcagtctttcacttttgctttgtctagatcttgtctaagaaatacttccctacctcaagatcgtattttccggtcaggcatggtggctcactcctataatccccgcactttgggaggccaaggcaggtggatcacctgcagtcaggagtttgagaccagcctggccaacatggtgaaacctcatctctactaaaaatgcaaaaattagctgagtgtggtggcgggcacctgtaatctcagctactcgggaggctgaggcaggaaaatcacatgaacccaggaggtggaggttgcagtgagccaaaatcaccccacttgcactccagtctgggcgacagagtgagactccatcaaaaaatatatatatatatattttccagtattttcatctaaaagctccaagttttgcatttcacacttagtccttcaaatctttcttgagcttaatatttgtgtttgatttggggtagtgatccattttcttccatttggaaaaccagcggtcccagtacccatttattgactagcccacctcttcctcaccaatcccgcaaggccatttctgtcatctgtcaaggcttgggctctctgccctgttccactggtctttttgtctaccccgggtgacaaacatgctgtcttaattactttatttaaaaaaataaaagggtctttggcattcagtaaagcaagttcctccacctctccacctcattctttctcaaaattattttggccattttgggcacaactttaatctttctcctctcctgatttgccctagcctactacaagcaatcaaatggcaagacttaaagtaagcagaagggagaaatcaagccaaagccagccctgggtagtccataagctgaatatttggttcctaataactaagacattgctgtgtagtcaagagtatagacagcctatatattaataaaagtagagtatgtgtttacaaaaaaaacaaaactatttttttaaatcttttccaggctataacaagggccacatttaaaaatagaaactggagcccatcctctggtcagtaccaaggttcttgcctttatttttaaaaatactacttttaaatctattttttgcatacagatagccacagagagttttgtgaaatagtgctaaaactgttcacttttgcctagatccctcagaacatccaaaccaaaggtcagtcactaggagacatcccaggagcatgctaattccatcacagcagggcctaagaatgaggtcatctttctctcattcaagggagaccttagtttcctgctctcagcgacacttccatagcctcatgatagctgcttggtgttctacagtgtctccagatccagaccctcttatatggaccgcaggacaaaaggactctggccacccagcaggccatgggcatgctgtccacgatggcgcgtccctcacactttctctatctcattccctttccattcagaatctcaagagaaagctggttctagaaggttctgtgtaaccttctctggaatgttttgctgacttcccataacttgcataaaggacaagttcctttgaaacccgagttgtaaaagatcttccttgcccagggcccccaaggttgcttcgaagccaaggcaggcatcaaaagccaaagtggccttctgcaccagcatccctcaggacaccctgctggggaaggcccggcccggcacaacagcagactgaggcccccaccctgaaaaagcctaggacattcctgggcactgtcatttagggtgctgtacaaatcacctccgcctagaaaatggaattcaacagtcaggatacagatttccaaggccaactgttggccccaacatgcaacagtgagaccataagcctcccgtgggccacattttgacagtggatgcccttcagggtgatatatgctataaagcagttttctatcacctaagtggtttttcttgccaacaagaatttttacccatcagcactactgtggctgaaaaacttctcttcaacagttcagtgcgccctgtgcaggagtcagcccggcatctgcttgtacacacagctccttgcataggtgtggagttagatctggacagtgaacttcaggaagtcctttcttataggaggctaatagggattgagaataacatgagaagaaaacgctaataaagggaaacctgaacacgctgctgtcagcatgtgttttcaaagtgcagcctgcctcagagttcttcggagcctgaaaaggggtttgagaaagagcccagtaggaggggcaggaggccgacacacctgacttggcctggggcccaggaggcaggtgtaagggagtgaaaagaaaggctagccggaggctgcggggggaagaccgcagactccctgctgcttcgcatccctcctgtggcctccactgcaggcaggacaaacctggatgccacctggagctgcttcctgagttggcacactatcgtgtacacagcagtcttcagccccctggaaggaggccatagtcgtgtgaggatggcaaagtcgaacaggaagctttgagtgccttcctccacgatgtcaacgaggagatccagtgccagatcgaggtggatggaacacccaggggtaggggtgcaggtgtgggcagtgatgtcccttcccctccctcccctggtcccacagactgtggccatgaggctgcaggctggtgctatgacagcagattgcagcacagggccctcccctccagcccccagtgggacatcaaaaccaccctggggccatttgtgcagggcaccacctccagtattgatggggaaaataaactcagtagagccacgacagggtggagagaagcagggaccattgtcttcctcaggagcgtgacagctgaccccacagaccatgcttgctggtacacactggtcccagacccaggcctgtcggacatcagcagtgtgctaaaaacgtgtaagatgtggtcactactcaccgtgtgtcctatctagttgacatgggtggagtcagctaaggggtgaatgttcatatgctcccaattcacgttgaagccctaatccccaaagggatggtattgggggtggggtcttggagaggtgattaggttatgagggtggagccctgatgaatgggattagtgctttataaggagagacaccagagagatgatctctctctccaccatgtgaggacacagtgagaagacagccgtctgcaggcccggaagagagccctcaccaggaaatgaaactgttggcaccttgagacttcccagcttccagaactgtaagaaataaatgtttgttgtttaagcctttcaggctacggctttctgttacagcagcctgaactgagagtccatgccgagtttttgaaataaatgtgaattctgatgttaaaaaaaact

SEQ ID NO: 75848 - DNA, 3852 bp, Homo sapiens
gcttccggctccggcgtggggtttgatgtctacggagtggcttttgcttagcgtcttgaaggggggaaaaaaatcctctaagctggtgatttcacgttctttgacaaacttcaatagcaacaggcaacgataccactttaagaaaattccaaggaaaagacctcattttaaaattcccacctctggctcccaaagattggtttgcaaacttcgacaaaatactcttctccactcgctattgatggagtctcgctctgtcacccaggctggagtatagtggtgtgatcttggctcactgcaacctctgcctcccaggttcaagcgattctcctgcctcagcctctcgagtagctggaattacaggtctggcagaaggaacagtatcaactgactgagtaggtctcattggcagttgtgattcagagacctagaaagctgaacccacggctggcaagaagaggatggtttgtgggacctgggctgatgtctgatgaaattttaagccccagctatagctactacaaagaaaagtggctgatgataagcatgtaactcaaaaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgagtacaaacaggccgtccatgagcttgtgcgttgcgtagcactgacaagaatttgctatggagactcacattggaaactagcagaggcacatgttaatctggctcaaggctacctccagctgaaaggactgtcactgcaagcaaaacaacatgcagaaaaagccagacaaatcctcgccaactccattgtgcctccctatagtgagaatacagatgttttcaagttttccattgagcttttccataccatgggcagagctttactctcccttcaaaagtatccttttgcctctaacttttacaaatagaaatactattcacgtaacacttacacgccaagtaaaaagctgatgctgatggatgacttaggaagtgtgattggaagtatgggagccaaggaagttcaggacatggggtgtagaatctagaaccaagtggaaaatttcctgaacacaattcagatttaaggaagctgcagagaatttgacaaaagcagagagactttcaaaggagctgctacaatgtggaagaattataaaggaagaatggatagaaattgaagcacggatcagattatcatttgcacaggtgtatcaaggtcagaagaagtcaaaagaagctttgtcccactatcaagcagctttggaatatgttgagatcagtaaaggtgaaacaagtcgtgagtgtgtacccatattgagagaattagcaggtgtagagcaagccctgggactccacgatgtatccatcaaccacttcctccaggcacatctcatcatcctgagtagaagcccctctcaagtggaggcagcagactcggcacacatcgtcgcccatgctgctgtcgcttcagggagacacgagcaccatgatgtagctgagcagtattttcaagagagcatggctcatcttaaggattctgaagggatgggaagaaccaaatttctttcaattcaagatgaattttgccattttctacaaatgactggacaaaaagagagagcaacctcgatcctgagagagtccctggaagccaaagtggaagcatttggcgatttcagtcccgaggtggcagagacataccggctcctgggaggagcagacctggcgcaggggaaccacagtggggcccgcaagaaactgaagaagaatctcaagagaaagctggttctagaaggttctgtgtaaccttctctggaatgttttgctgacttcccataacttgcataaaggacaagttcctttgaaacccgagttgtaaaagatcttccttgcccagggcccccaaggttgcttcgaagccaaggcaggcatcaaaagccaaagtggccttctgcaccagcatccctcaggacaccctgctggggaaggcccggcccggcacaacagcagactgaggcccccaccctgaaaaagcctaggacattcctgggcactgtcatttagggtgctgtacaaatcacctccgcctagaaaatggaattcaacagtcaggatacagatttccaaggccaactgttggccccaacatgcaacagtgagaccataagcctcccgtgggccacattttgacagtggatgcccttcagggtgatatatgctataaagcagttttctatcacctaagtggtttttcttgccaacaagaatttttacccatcagcactactgtggctgaaaaacttctcttcaacagttcagtgcgccctgtgcaggagtcagcccggcatctgcttgtacacacagctccttgcataggtgtggagttagatctggacagtgaacttcaggaagtcctttcttataggaggctaatagggattgagaataacatgagaagaaaacgctaataaagggaaacctgaacacgctgctgtcagcatgtgttttcaaagtgcagcctgcctcagagttcttcggagcctgaaaaggggtttgagaaagagcccagtaggaggggcaggaggccgacacacctgacttggcctggggcccaggaggcaggtgtaagggagtgaaaagaaaggctagccggaggctgcggggggaagaccgcagactccctgctgcttcgcatccctcctgtggcctccactgcaggcaggacaaacctggatgccacctggagctgcttcctgagttggcacactatcgtgtacacagcagtcttcagccccctggaaggaggccatagtcgtgtgaggatggcaaagtcgaacaggaagctttgagtgccttcctccacgatgtcaacgaggagatccagtgccagatcgaggtggatggaacacccaggggtaggggtgcaggtgtgggcagtgatgtcccttcccctccctcccctggtcccacagactgtggccatgaggctgcaggctggtgctatgacagcagattgcagcacagggccctcccctccagcccccagtgggacatcaaaaccaccctggggccatttgtgcagggcaccacctccagtattgatggggaaaataaactcagtagagccacgacagggtggagagaagcagggaccattgtcttcctcaggagcgtgacagctgaccccacagaccatgcttgctggtacacactggtcccagacccaggcctgtcggacatcagcagtgtgctaaaaacgtgtaagatgtggtcactactcaccgtgtgtcctatctagttgacatgggtggagtcagctaaggggtgaatgttcatatgctcccaattcacgttgaagccctaatccccaaagggatggtattgggggtggggtcttggagaggtgattaggttatgagggtggagccctgatgaatgggattagtgctttataaggagagacaccagagagatgatctctctctccaccatgtgaggacacagtgagaagacagccgtctgcaggcccggaagagagccctcaccaggaaatgaaactgttggcaccttgagacttcccagcttccagaactgtaagaaataaatgtttgttgtttaagcctttcaggctacggctttctgttacagcagcctgaactgagagtccatgccgagtttttgaaataaatgtgaattctgatgttaaaaaaaact

SEQ ID NO: 75849 - DNA, 2809 bp, Homo sapiens
tggctgcttgcattttaattttcttgaagacctaaaaatggttggcagatcagaatgaataaacaggcttcagtagtaagtccccaaaccctcacacttttttttactcaagctatttatgtagcacaattcatccgatttttaaaaaatatattatgaaacatttgttatgcagaaaagtatggataacataacaaagacctttgaactcaccattcagtataagaaataaaacatgacccatccagttgaagtcccctctatacctaccccatccccagataactacttttttaaatttgatatcattcccatgctcttcttattttactatggttttgttttgcatgttttaaaacttcatattaaattataatacatattatatgcattcatctgtcgttttctttttccccttgactttgtaatcatgagattcatctatgtggttatatatacacatacatatatcaaacatttatatatcacatacatatataatatatacatatcacagtttacatattcattactaaatattgctaaattgttttacaaaggggctataccagtttgaatacccactatcaatatataaaagaattcttgttgctttgtatctttaacaaaacttggtagtttttgcagtctggtgggtgaaatggtacctacctcattgaggttttagtttgtatttctggttgttaatgagattaagcatgtttatttcatcagatttcaactctttgaataatctgtttatatcttttgagtgttattctattgagaggttttggtttggtttggtatttctcattaccttataggaattcttcatgtattctgaatgttaaacctttctcatttctgtgcactgcaagaatctttcctcagcgtggcttgtctttctactttgcttatggtgaattttggtgcacaaatattttaggttttcacatagttacattttatcagtctttcacttttgctttgtctagatcttgtctaagaaatacttccctacctcaagatcgtattttccggtcaggcatggtggctcactcctataatccccgcactttgggaggccaaggcaggtggatcacctgcagtcaggagtttgagaccagcctggccaacatggtgaaacctcatctctactaaaaatgcaaaaattagctgagtgtggtggcgggcacctgtaatctcagctactcgggaggctgaggcaggaaaatcacatgaacccaggaggtggaggttgcagtgagccaaaatcaccccacttgcactccagtctgggcgacagagtgagactccatcaaaaaatatatatatatatattttccagtattttcatctaaaagctccaagttttgcatttcacacttagtccttcaaatctttcttgagcttaatatttgtgtttgatttggggtagtgatccattttcttccatttggaaaaccagcggtcccagtacccatttattgactagcccacctcttcctcaccaatcccgcaaggccatttctgtcatctgtcaaggcttgggctctctgccctgttccactggtctttttgtctaccccgggtgacaaacatgctgtcttaattactttatttaaaaaaataaaagggtctttggcattcagtaaagcaagttcctccacctctccacctcattctttctcaaaattattttggccattttgggcacaactttaatctttctcctctcctgatttgccctagcctactacaagcaatcaaatggcaagacttaaagtaagcagaagggagaaatcaagccaaagccagccctgggtagtccataagctgaatatttggttcctaataactaagacattgctgtgtagtcaagagtatagacagcctatatattaataaaagtagagtatgtgtttacaaaaaaaacaaaactatttttttaaatcttttccaggctataacaagggccacatttaaaaatagaaactggagcccatcctctggtcagtaccaaggttcttgcctttatttttaaaaatactacttttaaatctattttttgcatacagatagccacagagagttttgtgaaatagtgctaaaactgttcacttttgcctagatccctcagaacatccaaaccaaaggtcagtcactaggagacatcccaggagcatgctaattccatcacagcagggcctaagaatgaggtcatctttctctcattcaagggagaccttagtttcctgctctcagcgacacttccatagcctcatgatagctgcttggtgttctacagtgtctccagatccagaccctcttatatggaccgcaggacaaaaggactctggccacccagcaggccatgggcatgctgtccacgatggcgcgtccctcacactttctctatctcattccctttccattcagaatctcaagagaaagctggttctagaaggttctgtgtaaccttctctggaatgttttgctgacttcccataacttgcataaaggacaagttcctttgaaacccgagttgtaaaagatcttccttgcccaggtatttaaaaataattcatcctttaagtcagaaatatatgctggatgttgtcttcctgcagaccagcccctgcaggctaaggcacctgctgcagggggagggccccgggaatccctgtggcctcctgcagccctgcttccggcttccctctgccctcggatgcccgtcaggactggagccggaaggttcactgactgaccttaaaggctggcccctaggacgcgccatcgtgcgctt

SEQ ID NO: 75850 - DNA, 2197 bp, Homo sapiens
gcttccggctccggcgtggggtttgatgtctacggagtggcttttgcttagcgtcttgaaggggggaaaaaaatcctctaagctggtgatttcacgttctttgacaaacttcaatagcaacaggcaacgataccactttaagaaaattccaaggaaaagacctcattttaaaattcccacctctggctcccaaagattggtttgcaaacttcgacaaaatactcttctccactcgctattgatggagtctcgctctgtcacccaggctggagtatagtggtgtgatcttggctcactgcaacctctgcctcccaggttcaagcgattctcctgcctcagcctctcgagtagctggaattacaggtctggcagaaggaacagtatcaactgactgagtaggtctcattggcagttgtgattcagagacctagaaagctgaacccacggctggcaagaagaggatggtttgtgggacctgggctgatgtctgatgaaattttaagccccagctatagctactacaaagaaaagtggctgatgataagcatgtaactcaaaaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgagtacaaacaggccgtccatgagcttgtgcgttgcgtagcactgacaagaatttgctatggagactcacattggaaactagcagaggcacatgttaatctggctcaaggctacctccagctgaaaggactgtcactgcaagcaaaacaacatgcagaaaaagccagacaaatcctcgccaactccattgtgcctccctatagtgagaatacagatgttttcaagttttccattgagcttttccataccatgggcagagctttactctcccttcaaaagtatccttttgcctctaacttttacaaatagaaatactattcacgtaacacttacacgccaagtaaaaagctgatgctgatggatgacttaggaagtgtgattggaagtatgggagccaaggaagttcaggacatggggtgtagaatctagaaccaagtggaaaatttcctgaacacaattcagatttaaggaagctgcagagaatttgacaaaagcagagagactttcaaaggagctgctacaatgtggaagaattataaaggaagaatggatagaaattgaagcacggatcagattatcatttgcacaggtgtatcaaggtcagaagaagtcaaaagaagctttgtcccactatcaagcagctttggaatatgttgagatcagtaaaggtgaaacaagtcgtgagtgtgtacccatattgagagaattagcaggtgtagagcaagccctgggactccacgatgtatccatcaaccacttcctccaggcacatctcatcatcctgagtagaagcccctctcaagtggaggcagcagactcggcacacatcgtcgcccatgctgctgtcgcttcagggagacacgagcaccatgatgtagctgagcagtattttcaagagagcatggctcatcttaaggattctgaagggatgggaagaaccaaatttctttcaattcaagatgaattttgccattttctacaaatgactggacaaaaagagagagcaacctcgatcctgagagagtccctggaagccaaagtggaagcatttggcgatttcagtcccgaggtggcagagacataccggctcctgggaggagcagacctggcgcaggggaaccacagtggggcccgcaagaaactgaagaagcttgaaagacctcaaagacctcagggaaagactgacgggcctggcttgaatccagggcccacccctggctcagtcagccaaggccaggagagtggtgaaaggctgcagaaagaattcctgaaggcggcttcatggatcaggaacatctcaggagtatactgagcccaagaacactgaagtcggatttgggtccagtcatcatctggcctccgtattaggtactatcttcagcagggttcagtccactgcctcactactttagctgtgggcattaaacatttccacacacaaa

SEQ ID NO: 75851 - DNA, 537 bp, Homo sapiens
ggacgcgtgggtccggacgcgtggtgtcgacccacgcgtgcggtgaggtacccgcttgctttatgggaaaaggctgctccggaactgccctactttagactttttcatggttatcaatctgtacaaagaatcaccaaactgataaagcaggaaccagagggcaaatcacgctgccaagacaactgtgtaattcgctcgaaaaagaaacgaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgaggtaaggagacttttgtttctgtatttctactctgagaattgagctatatggtataatcaagagaagtagaatgttttggattacattcctaatctcagcagtttgatacaagaaagtatataagacag

SEQ ID NO: 75852 - DNA, 200 bp, Homo sapiens
gcacatctcatcatcctgagtagaagcccctctcaagtggaggcagcagactcggcacacatcgtcgcccatgctgctgtcgcttcagggagacacgagcaccatggtgagaagaatccttttctcttcctgtctcacaggcatctgggtctataaacgagctgccttctagatgggttaacaggtggacagagccgcga

SEQ ID NO: 75853 - DNA, 1014 bp, Homo sapiens
ggcttgtgcctgtcgtcctagctacttgggagactaaggtggaaggatcaccctagcccaggagttcaaggttgcagtgagctgtgattgagccattgcattccagcctgggcaagagtgagaccctatctccaaaaggaaagagagaaacgaagtcctgtccctatcagcagccactccacatcctgcaccccagcctctggcactacgcgtccccttcctgtctctgaattatcctgttctagacatttcttagaaatgggatcacacactgtgtggccttttgtgtctggcgtctctcactgaatgtggcgtcctcaaggtgcatccacgctgtggcctgtgtcagagcctcgctccttttcatggctgagtatgtcccatcgtgtggatgggcgtttgtccgttcatccattgaaggcgtctgggctgcttccaccttctggctcctggggacatccgtgtagaagtgatggtgtggatgcgtgctcatttttcgggcagatacctaagagtggcgtggccgggtcatctggaaactcagtgaagagctgtcaggcttttccaacatggctgttccatcttacatcccaaccatgatgacggtgtgttgggttgggtgcttgtcatcctgtagtgtgacctcatgtgacacacagggcaacccattggtgggtgtccttatgtcctggagaggatgagttgccggcgcttgtccatggcaggctgagagcagagccccgtgtctgagagcaggtctgtgtttacctggctgccttgttgcgagctctccagtcgggttatgcccaagcagctgttagggcctggccccagatcttagaacgagaccccttcccagtctggccctgctgctgtaaccccaaggtggaagaagattgcttttagggctgtccctcacatacctgttctccgtggggtcttttctcaagaatgtgacctaaattccatgtctggaatgttctggacatgtgagccatcctcccagagccgggg

SEQ ID NO: 75854 - DNA, 2944 bp, Homo sapiens
  misc_feature (312)..(312): n is a, c, g, or t
  misc_feature (321)..(321): n is a, c, g, or t
  misc_feature (329)..(329): n is a, c, g, or t
  misc_feature (335)..(335): n is a, c, g, or t
  misc_feature (354)..(354): n is a, c, g, or t
  misc_feature (358)..(358): n is a, c, g, or t
  misc_feature (374)..(374): n is a, c, g, or t
  misc_feature (386)..(386): n is a, c, g, or t
cagactggagtgccagcaggccttgtcacactggctgtcaaaccaggtaccccgccgggcgggggagagacggtgcccagccatggccccccgggcccgcagcgcctcccaggaccggttggaggaggtggctgccccccgcccgtggccctgctccacctcccaggatgctttgagccagctgggccatggagggctggcaccgagctcgctcagatgactacttgagccgggccacccgttctgccgaggcactggggccaggggcactggtgtcaccccgctttgagcggtgtggctgggcttcccagncgttcgtcntgcccgcnaccccncgcctgcccaactctgggnaccntgccagggccccaggnccccaacccccngtctggcctgcagggcctggatgacctcgggtacatcggctaccggagctacagcccatcattccagcgaccggaccggcctcctccatgcgctctccttccgggactcaccctttggggggctgcctaccttcaacctggcccagtcccctgcgtcattcccaccagaggcctccgagccacccagggttgtacggccggaacccagcacccgggccctggagcctcctgcggaggatcgcggcgatgaggtggtcctgaggcagaagcccccgacgggccgcaaggttcagctgacccccgcaagacagatgaaccttggatttggtgacgagtccccagagccagaggccagtgggcgaggggaacgcctgggcaggaaggtggcccctttggccaccaccgaagactctctggcttccatcccctttattgatgagcccaccagccccagcattgacctccaagccaagcacgtccctgcctctgctgtggtctccagtgccatgaactcagcccctgtcctgggcaccagcccatcttccccgaccttcactttcaccctcggacgccattactcgcaggactgcagcagcatcaaggctggccgccgctcctcctacctgctggccatcaccacggagcgctccaagtcctgcgatgatggactcaacaccttccgcgacgagggccgggttctgcggcgcctgccaaaccgcatacccagcctgcggatgctccggagcttcttcaccgacgggtccttggatagctggggcacctctgaagatgctgacgctccttctaagcgacactcaacctctgacctctcagatgcgaccttcagcgatatcaggagagaaggctggttgtattataagcagattctcaccaagaaggggaagaaagcgggcagcggcctgcgccagtggaagcgggtgtacgccgcgctgcgggcgcgctcgctctcgctgagcaaggagcggcgggagcccgggccggcggcggcgggggctgcggcggccggcgcaggtgaggacgaggcggcgcccgtctgcatcggctcctgcctcgtggacatctcctacagcgagaccaagaggaggcacgtgttccggctgaccaccgctgacttctgtgaatatctctttcaggctgaggaccgggatgacatgctgggctggatcagagcgatccgggagaacagcagggccgagggcgaggaccccggctgtgccaaccaagctctgatcagcaagaagcttaatgattatcgcaaagtgagccatagctctgggcccaaagctgattcctcccccaaaggctctcgcggcctggggggcctcaagtctgagttcctcaagcagagtgcggcacgtggcctcaggactcaggacctgcccgcagggagcaaggatgacagtgctgcagcccccaaaaccccctggggcatcaacatcatcaagaaaaataagaaggccgctccgagggcgtttggggtcaggctggaggagtgccagccagccacggagaaccagcgcgtccccttaatcgtggctgcatgctgtcgcattgtggaggcacgagggctggagtccacaggcatttaccgagtgcccggcaacaatgcagtggtgtccagcctacaggagcagctcaaccgcgggcctggtgacatcaacctgcaggatgagcgctggcaagacctcaatgtgatcagcagcctgctcaagtccttcttccgaaagctgcccgagcctcttttcactgatgacaaatacaacgacttcatcgaggccaaccgcattgaggacgcgcgggagcgaatgaggacgctgcggaagctgatccgggatctcccaggacactactatgaaacgctcaaattccttgtgggccatctcaagaccatcgctgaccactctgagaaaaacaagatggaaccccggaacctggccctggtctttgggccgacactggtgaggacgtctgaggacaacatgacagacatggtgacccacatgcctgaccgctacaagatcgtggagacactgatccagcactcagactggttcttcagtgacgaagaggacaagggagagagaacccctgtgggcgacaaggagcctcaggcagtgcccaacattgagtacctcctgcccaacattggcaggacagtgccccctggcgacccggggtcagcggacctgttggagatttaaaggattctaccacctgtagttcagccaagtccaagggttcgtgggcccccaagaaggagccgtacgcccgggagatgctggcgatctccttcatctcggccgtcaaccgcaagcgcaagaagcggcgggaggcgcgggggctgggcagcagcaccgacgacgactcggagcaggaggcgcacaagcctggggcgggggccacagcgccggggactcaggagcggccgcaggggccgctgcctggcgccgtcgcccccgaggcccccggacgcctcagtcccccggcggcgccggaggagcggccggccgcggacacgcgctccattgtgtcgggct

SEQ ID NO: 75855 - DNA, 598 bp, Homo sapiens
  misc_feature (16)..(16): n is a, c, g, or t
atcggtaaatgagggngccagtggctggcagcctgatgtcacttcctgcctctagaggaagtggcagttaacatcattttctcctccatccctctcccatagatggacatcagatgtccatcatactcctagggcctggggagatctcatgtttcagaattccctggtttctgaagcctttgaggagagggaattgtgtgcataagactcagctttcttttttcctgatgcaactttcatttttttttctgtctttcaccaacagattctaccacctgtagttcagccaagtccaagggttcgtgggcccccaagaaggagccgtacgcccgggagatgctggcgatctccttcatctcggccgtcaaccgcaagcgcaagaagcggcgggaggcgcgggggctgggcagcagcaccgacgacgactcggagcaggaggcgcacaagcctggggcgggggccacagcgccggggactcaggagcggccgcaggggccgctgcctggcgccgtcgcccccgaggcccccggacgcctcagtcccccggcggcgccggaggagcggccggccgcggacacgcgctccattgtgtcgggct

SEQ ID NO: 75856 - DNA, 2799 bp, Homo sapiens
  misc_feature (312)..(312): n is a, c, g, or t
  misc_feature (321)..(321): n is a, c, g, or t
  misc_feature (329)..(329): n is a, c, g, or t
  misc_feature (335)..(335): n is a, c, g, or t
  misc_feature (354)..(354): n is a, c, g, or t
  misc_feature (358)..(358): n is a, c, g, or t
  misc_feature (374)..(374): n is a, c, g, or t
  misc_feature (386)..(386): n is a, c, g, or t
cagactggagtgccagcaggccttgtcacactggctgtcaaaccaggtaccccgccgggcgggggagagacggtgcccagccatggccccccgggcccgcagcgcctcccaggaccggttggaggaggtggctgccccccgcccgtggccctgctccacctcccaggatgctttgagccagctgggccatggagggctggcaccgagctcgctcagatgactacttgagccgggccacccgttctgccgaggcactggggccaggggcactggtgtcaccccgctttgagcggtgtggctgggcttcccagncgttcgtcntgcccgcnaccccncgcctgcccaactctgggnaccntgccagggccccaggnccccaacccccngtctggcctgcagggcctggatgacctcgggtacatcggctaccggagctacagcccatcattccagcgaccggaccggcctcctccatgcgctctccttccgggactcaccctttggggggctgcctaccttcaacctggcccagtcccctgcgtcattcccaccagaggcctccgagccacccagggttgtacggccggaacccagcacccgggccctggagcctcctgcggaggatcgcggcgatgaggtggtcctgaggcagaagcccccgacgggccgcaaggttcagctgacccccgcaagacagatgaaccttggatttggtgacgagtccccagagccagaggccagtgggcgaggggaacgcctgggcaggaaggtggcccctttggccaccaccgaagactctctggcttccatcccctttattgatgagcccaccagccccagcattgacctccaagccaagcacgtccctgcctctgctgtggtctccagtgccatgaactcagcccctgtcctgggcaccagcccatcttccccgaccttcactttcaccctcggacgccattactcgcaggactgcagcagcatcaaggctggccgccgctcctcctacctgctggccatcaccacggagcgctccaagtcctgcgatgatggactcaacaccttccgcgacgagggccgggttctgcggcgcctgccaaaccgcatacccagcctgcggatgctccggagcttcttcaccgacgggtccttggatagctggggcacctctgaagatgctgacgctccttctaagcgacactcaacctctgacctctcagatgcgaccttcagcgatatcaggagagaaggctggttgtattataagcagattctcaccaagaaggggaagaaagcgggcagcggcctgcgccagtggaagcgggtgtacgccgcgctgcgggcgcgctcgctctcgctgagcaaggagcggcgggagcccgggccggcggcggcgggggctgcggcggccggcgcaggctgaggaccgggatgacatgctgggctggatcagagcgatccgggagaacagcagggccgagggcgaggaccccggctgtgccaaccaagctctgatcagcaagaagcttaatgattatcgcaaagtgagccatagctctgggcccaaagctgattcctcccccaaaggctctcgcggcctggggggcctcaagtctgagttcctcaagcagagtgcggcacgtggcctcaggactcaggacctgcccgcagggagcaaggatgacagtgctgcagcccccaaaaccccctggggcatcaacatcatcaagaaaaataagaaggccgctccgagggcgtttggggtcaggctggaggagtgccagccagccacggagaaccagcgcgtccccttaatcgtggctgcatgctgtcgcattgtggaggcacgagggctggagtccacaggcatttaccgagtgcccggcaacaatgcagtggtgtccagcctacaggagcagctcaaccgcgggcctggtgacatcaacctgcaggatgagcgctggcaagacctcaatgtgatcagcagcctgctcaagtccttcttccgaaagctgcccgagcctcttttcactgatgacaaatacaacgacttcatcgaggccaaccgcattgaggacgcgcgggagcgaatgaggacgctgcggaagctgatccgggatctcccaggacactactatgaaacgctcaaattccttgtgggccatctcaagaccatcgctgaccactctgagaaaaacaagatggaaccccggaacctggccctggtctttgggccgacactggtgaggacgtctgaggacaacatgacagacatggtgacccacatgcctgaccgctacaagatcgtggagacactgatccagcactcagactggttcttcagtgacgaagaggacaagggagagagaacccctgtgggcgacaaggagcctcaggcagtgcccaacattgagtacctcctgcccaacattggcaggacagtgccccctggcgacccggggtcagattctaccacctgtagttcagccaagtccaagggttcgtgggcccccaagaaggagccgtacgcccgggagatgctggcgatctccttcatctcggccgtcaaccgcaagcgcaagaagcggcgggaggcgcgggggctgggcagcagcaccgacgacgactcggagcaggaggcgcacaagcctggggcgggggccacagcgccggggactcaggagcggccgcaggggccgctgcctggcgccgtcgcccccgaggcccccggacgcctcagtcccccggcggcgccggaggagcggccggccgcggacacgcgctccattgtgtcgggct

SEQ ID NO: 75857 - DNA, 3197 bp, Homo sapiens
  misc_feature (312)..(312): n is a, c, g, or t
  misc_feature (321)..(321): n is a, c, g, or t
  misc_feature (329)..(329): n is a, c, g, or t
  misc_feature (335)..(335): n is a, c, g, or t
  misc_feature (354)..(354): n is a, c, g, or t
  misc_feature (358)..(358): n is a, c, g, or t
  misc_feature (374)..(374): n is a, c, g, or t
  misc_feature (386)..(386): n is a, c, g, or t
cagactggagtgccagcaggccttgtcacactggctgtcaaaccaggtaccccgccgggcgggggagagacggtgcccagccatggccccccgggcccgcagcgcctcccaggaccggttggaggaggtggctgccccccgcccgtggccctgctccacctcccaggatgctttgagccagctgggccatggagggctggcaccgagctcgctcagatgactacttgagccgggccacccgttctgccgaggcactggggccaggggcactggtgtcaccccgctttgagcggtgtggctgggcttcccagncgttcgtcntgcccgcnaccccncgcctgcccaactctgggnaccntgccagggccccaggnccccaacccccngtctggcctgcagggcctggatgacctcgggtacatcggctaccggagctacagcccatcattccagcgaccggaccggcctcctccatgcgctctccttccgggactcaccctttggggggctgcctaccttcaacctggcccagtcccctgcgtcattcccaccagaggcctccgagccacccagggttgtacggccggaacccagcacccgggccctggagcctcctgcggaggatcgcggcgatgaggtggtcctgaggcagaagcccccgacgggccgcaaggttcagctgacccccgcaagacagatgaaccttggatttggtgacgagtccccagagccagaggccagtgggcgaggggaacgcctgggcaggaaggtggcccctttggccaccaccgaagactctctggcttccatcccctttattgatgagcccaccagccccagcattgacctccaagccaagcacgtccctgcctctgctgtggtctccagtgccatgaactcagcccctgtcctgggcaccagcccatcttccccgaccttcactttcaccctcggacgccattactcgcaggactgcagcagcatcaaggctggccgccgctcctcctacctgctggccatcaccacggagcgctccaagtcctgcgatgatggactcaacaccttccgcgacgagggccgggttctgcggcgcctgccaaaccgcatacccagcctgcggatgctccggagcttcttcaccgacgggtccttggatagctggggcacctctgaagatgctgacgctccttctaagcgacactcaacctctgacctctcagatgcgaccttcagcgatatcaggagagaaggctggttgtattataagcagattctcaccaagaaggggaagaaagcgggcagcggcctgcgccagtggaagcgggtgtacgccgcgctgcgggcgcgctcgctctcgctgagcaaggagcggcgggagcccgggccggcggcggcgggggctgcggcggccggcgcaggtgaggacgaggcggcgcccgtctgcatcggctcctgcctcgtggacatctcctacagcgagaccaagaggaggcacgtgttccggctgaccaccgctgacttctgtgaatatctctttcaggctgaggaccgggatgacatgctgggctggatcagagcgatccgggagaacagcagggccgagggcgaggaccccggctgtgccaaccaagctctgatcagcaagaagcttaatgattatcgcaaagtgagccatagctctgggcccaaagctgattcctcccccaaaggctctcgcggcctggggggcctcaagtctgagttcctcaagcagagtgcggcacgtggcctcaggactcaggacctgcccgcagggagcaaggatgacagtgctgcagcccccaaaaccccctggggcatcaacatcatcaagaaaaataagaaggccgctccgagggcgtttggggtcaggctggaggagtgccagccagccacggagaaccagcgcgtccccttaatcgtggctgcatgctgtcgcattgtggaggcacgagggctggagtccacaggcatttaccgagtgcccggcaacaatgcagtggtgtccagcctacaggagcagctcaaccgcgggcctggtgacatcaacctgcaggatgagcgctggcaagacctcaatgtgatcagcagcctgctcaagtccttcttccgaaagctgcccgagcctcttttcactgatgacaaatacaacgacttcatcgaggccaaccgcattgaggacgcgcgggagcgaatgaggacgctgcggaagctgatccgggatctcccaggacactactatgaaacgctcaaattccttgtgggccatctcaagaccatcgctgaccactctgagaaaaacaagatggaaccccggaacctggccctggtctttgggccgacactggtgaggacgtctgaggacaacatgacagacatggtgacccacatgcctgaccgctacaagatcgtggagacactgatccagcactcagactggttcttcagtgacgaagaggacaagggagagagaacccctgtgggcgacaaggagcctcaggcagtgcccaacattgagtacctcctgcccaacattggcaggacagtgccccctggcgacccggggtcagattctaccacctgtagttcagccaagtccaaggtacgtatgaaggcaattctgaaggcttgatccctgtacaaggcagcccactttggtttttgttcaagggaattgagggaatggcagttggaccatggggaaagttgatggtccctgggagggaaggcaggaggtaccgagtgcccaaggtaagctgagaaattgcttaccttggcagtgtttggtgaggcatctgctgtagtagaaggacctggcctgggagttatgtggctaggaggcaatgtcactcagtagttagaagcacagactctgcagtcagacagtcctgggtttgagttctggctccaccatttagtagtttgggacattgggcaagttacttaaccactttctgatccttagcttcctcatctataaaatgggaatatcagtaaatctgtggggtgctataataaataaaacagatatcctttaaggtctttggagagcctaaagcaagcagaaggaaataaagagaggagcagaaatccatgaaatagaaaacagttgaaaaaaagcaatgaaaccaaaagctggttctttgaaaaaaaatcagtgaaattgataaacctctagc

SEQ ID NO: 75858 - DNA, 970 bp, Homo sapiens
gaagcgcacgatggcgcgctcaatgcggttggcctcttttcactgatggtgcccttctcttctgacctgctgaaccttggtgtccatgtcctggagacgggggcagggaccccttttctgggatcagcatgcagctcagatggtattgcctcccaaatgaacacagctgggctaccccaggtcaggtgcacacccgagtgtagctgtgacaaatacaacgacttcatcgaggccaaccgcattgaggacgcgcgggagcgaatgaggacgctgcggaagctgatccgggatctcccaggacactactatgaaacgctcaaattccttgtgggccatctcaagaccatcgctgaccactctgagaaaaacaagatggaaccccggaacctggccctggtctttgggccgacactggtgaggacgtctgaggacaacatgacagacatggtgacccacatgcctgaccgctacaagatcgtggagacactgatccagcactcagactggttcttcagtgacgaagaggacaagggagagagaacccctgtgggcgacaaggagcctcaggcagtgcccaacattgagtacctcctgcccaacattggcaggacagtgccccctggcgacccggggtcagattctaccacctgtagttcagccaagtccaagggttcgtgggcccccaagaaggagccgtacgcccgggagatgctggcgatctccttcatctcggccgtcaaccgcaagcgcaagaagcggcgggaggcgcgggggctgggcagcagcaccgacgacgactcggagcaggaggcgcacaagcctggggcgggggccacagcgccggggactcaggagcggccgcaggggccgctgcctggcgccgtcgcccccgaggcccccggacgcctcagtcccccggcggcgccggaggagcggccggccgcggacacgcgctccattgtgtcgggct

SEQ ID NO: 75859 - DNA, 2411 bp, Homo sapiens
  misc_feature (312)..(312): n is a, c, g, or t
  misc_feature (321)..(321): n is a, c, g, or t
  misc_feature (329)..(329): n is a, c, g, or t
  misc_feature (335)..(335): n is a, c, g, or t
  misc_feature (354)..(354): n is a, c, g, or t
  misc_feature (358)..(358): n is a, c, g, or t
  misc_feature (374)..(374): n is a, c, g, or t
  misc_feature (386)..(386): n is a, c, g, or t
  misc_feature (2363)..(2364): n is a, c, g, or t
cagactggagtgccagcaggccttgtcacactggctgtcaaaccaggtaccccgccgggcgggggagagacggtgcccagccatggccccccgggcccgcagcgcctcccaggaccggttggaggaggtggctgccccccgcccgtggccctgctccacctcccaggatgctttgagccagctgggccatggagggctggcaccgagctcgctcagatgactacttgagccgggccacccgttctgccgaggcactggggccaggggcactggtgtcaccccgctttgagcggtgtggctgggcttcccagncgttcgtcntgcccgcnaccccncgcctgcccaactctgggnaccntgccagggccccaggnccccaacccccngtctggcctgcagggcctggatgacctcgggtacatcggctaccggagctacagcccatcattccagcgaccggaccggcctcctccatgcgctctccttccgggactcaccctttggggggctgcctaccttcaacctggcccagtcccctgcgtcattcccaccagaggcctccgagccacccagggttgtacggccggaacccagcacccgggccctggagcctcctgcggaggatcgcggcgatgaggtggtcctgaggcagaagcccccgacgggccgcaaggttcagctgacccccgcaagacagatgaaccttggatttggtgacgagtccccagagccagaggccagtgggcgaggggaacgcctgggcaggaaggtggcccctttggccaccaccgaagactctctggcttccatcccctttattgatgagcccaccagccccagcattgacctccaagccaagcacgtccctgcctctgctgtggtctccagtgccatgaactcagcccctgtcctgggcaccagcccatcttccccgaccttcactttcaccctcggacgccattactcgcaggactgcagcagcatcaaggctggccgccgctcctcctacctgctggccatcaccacggagcgctccaagtcctgcgatgatggactcaacaccttccgcgacgagggccgggttctgcggcgcctgccaaaccgcatacccagcctgcggatgctccggagcttcttcaccgacgggtccttggatagctggggcacctctgaagatgctgacgctccttctaagcgacactcaacctctgacctctcagatgcgaccttcagcgatatcaggagagaaggctggttgtattataagcagattctcaccaagaaggggaagaaagcgggcagcggcctgcgccagtggaagcgggtgtacgccgcgctgcgggcgcgctcgctctcgctgagcaaggagcggcgggagcccgggccggcggcggcgggggctgcggcggccggcgcaggtgaggacgaggcggcgcccgtctgcatcggctcctgcctcgtggacatctcctacagcgagaccaagaggaggcacgtgttccggctgaccaccgctgacttctgtgaatatctctttcaggctgaggaccgggatgacatgctgggctggatcagagcgatccgggagaacagcagggccgagggcgaggaccccggctgtgccaaccaagctctgatcagcaagaagcttaatgattatcgcaaagtgagccatagctctgggcccaaagctgattcctcccccaaaggctctcgcggcctggggggcctcaagtctgagttcctcaagcagagtgcggcacgtggcctcaggactcaggacctgcccgcagggagcaaggatgacagtgctgcagcccccaaaaccccctggggcatcaacatcatcaagaaaaataagaaggccgctccgagggcgtttggggtcaggctggaggagtgccagccagccacggagaaccagcgcgtccccttaatcgtggctgcatgctgtcgcattgtggaggcacgagggctggagtccacaggcatttaccgagtgcccggcaacaatgcagtggtgtccagcctacaggagcagctcaaccgcgggcctggtgacatcaacctgcaggatgagcgctggcaagacctcaatgtgatcagcagcctgctcaagtccttcttccgaaagctgcccgagcctcttttcactgatggtgcccttctcttctgacctgctgaaccttggtgtccatgtcctggagacgggggcagggaccccttttctgggatcagcatgcagctcagatggtattgcctcccaaatgaacacagctgggctaccccaggtcaggtgcacacccgagtgtagctgtgacaaatacaacgacttcatcgaggccaaccgcattgaggacgtnnttcctggttacaaggatactctagaataactatgagctgtacgtcgc

SEQ ID NO: 75860 - DNA, 2386 bp, Homo sapiens
  misc_feature (312)..(312): n is a, c, g, or t
  misc_feature (321)..(321): n is a, c, g, or t
  misc_feature (329)..(329): n is a, c, g, or t
  misc_feature (335)..(335): n is a, c, g, or t
  misc_feature (354)..(354): n is a, c, g, or t
  misc_feature (358)..(358): n is a, c, g, or t
  misc_feature (374)..(374): n is a, c, g, or t
  misc_feature (386)..(386): n is a, c, g, or t
cagactggagtgccagcaggccttgtcacactggctgtcaaaccaggtaccccgccgggcgggggagagacggtgcccagccatggccccccgggcccgcagcgcctcccaggaccggttggaggaggtggctgccccccgcccgtggccctgctccacctcccaggatgctttgagccagctgggccatggagggctggcaccgagctcgctcagatgactacttgagccgggccacccgttctgccgaggcactggggccaggggcactggtgtcaccccgctttgagcggtgtggctgggcttcccagncgttcgtcntgcccgcnaccccncgcctgcccaactctgggnaccntgccagggccccaggnccccaacccccngtctggcctgcagggcctggatgacctcgggtacatcggctaccggagctacagcccatcattccagcgaccggaccggcctcctccatgcgctctccttccgggactcaccctttggggggctgcctaccttcaacctggcccagtcccctgcgtcattcccaccagaggcctccgagccacccagggttgtacggccggaacccagcacccgggccctggagcctcctgcggaggatcgcggcgatgaggtggtcctgaggcagaagcccccgacgggccgcaaggttcagctgacccccgcaagacagatgaaccttggatttggtgacgagtccccagagccagaggccagtgggcgaggggaacgcctgggcaggaaggtggcccctttggccaccaccgaagactctctggcttccatcccctttattgatgagcccaccagccccagcattgacctccaagccaagcacgtccctgcctctgctgtggtctccagtgccatgaactcagcccctgtcctgggcaccagcccatcttccccgaccttcactttcaccctcggacgccattactcgcaggactgcagcagcatcaaggctggccgccgctcctcctacctgctggccatcaccacggagcgctccaagtcctgcgatgatggactcaacaccttccgcgacgagggccgggttctgcggcgcctgccaaaccgcatacccagcctgcggatgctccggagcttcttcaccgacgggtccttggatagctggggcacctctgaagatgctgacgctccttctaagcgacactcaacctctgacctctcagatgcgaccttcagcgatatcaggagagaaggctggttgtattataagcagattctcaccaagaaggggaagaaagcgggcagcggcctgcgccagtggaagcgggtgtacgccgcgctgcgggcgcgctcgctctcgctgagcaaggagcggcgggagcccgggccggcggcggcgggggctgcggcggccggcgcaggtgaggacgaggcggcgcccgtctgcatcggctcctgcctcgtggacatctcctacagcgagaccaagaggaggcacgtgttccggctgaccaccgctgacttctgtgaatatctctttcaggctgaggaccgggatgacatgctgggctggatcagagcgatccgggagaacagcagggccgagggcgaggaccccggctgtgccaaccaagctctgatcagcaagaagcttaatgattatcgcaaagtgagccatagctctgggcccaaagctgattcctcccccaaaggctctcgcggcctggggggcctcaagtctgagttcctcaagcagagtgcggcacgtggcctcaggactcaggacctgcccgcagggagcaaggatgacagtgctgcagcccccaaaaccccctggggcatcaacatcatcaagaaaaataagaaggccgctccgagggcgtttggggtcaggctggaggagtgccagccagccacggagaaccagcgcgtccccttaatcgtggctgcatgctgtcgcattgtggaggcacgagggctggagtccacaggcatttaccgagtgcccggcaacaatgcagtggtgtccagcctacaggagcagctcaaccgcgggcctggtgacatcaacctgcaggatgagcgctggcaagacctcaatgtgatcagcagcctgctcaagtccttcttccgaaagctgcccgagcctcttttcactgatggtgcccttctcttctgacctgctgaaccttggtgtccatgtcctggagacgggggcagggaccccttttctgggatcagcatgcagctcagatggtattgcctcccaaatgaacacagctgggctaccccaggtcaggtgcacacccgagtgtagctgtggtgctcgacgatatacaacgacatttatcgatggcctttacgaacgtgagtgacgtggcgcttgctg

SEQ ID NO: 75861 - DNA, 157 bp, Homo sapiens
caagacctcaatgtgatcagcagcctgctcaagtccttcttccgaaagctgcccgagcctcttttcactgatggtgagtaggaggtggaagtggggcggggaggggacaccagtccgtgcctcaccctgaccactacttttgcatttggtttgttgg

SEQ ID NO: 75862 - DNA, 2921 bp, Homo sapiens
  misc_feature (312)..(312): n is a, c, g, or t
  misc_feature (321)..(321): n is a, c, g, or t
  misc_feature (329)..(329): n is a, c, g, or t
  misc_feature (335)..(335): n is a, c, g, or t
  misc_feature (354)..(354): n is a, c, g, or t
  misc_feature (358)..(358): n is a, c, g, or t
  misc_feature (374)..(374): n is a, c, g, or t
  misc_feature (386)..(386): n is a, c, g, or t
cagactggagtgccagcaggccttgtcacactggctgtcaaaccaggtaccccgccgggcgggggagagacggtgcccagccatggccccccgggcccgcagcgcctcccaggaccggttggaggaggtggctgccccccgcccgtggccctgctccacctcccaggatgctttgagccagctgggccatggagggctggcaccgagctcgctcagatgactacttgagccgggccacccgttctgccgaggcactggggccaggggcactggtgtcaccccgctttgagcggtgtggctgggcttcccagncgttcgtcntgcccgcnaccccncgcctgcccaactctgggnaccntgccagggccccaggnccccaacccccngtctggcctgcagggcctggatgacctcgggtacatcggctaccggagctacagcccatcattccagcgaccggaccggcctcctccatgcgctctccttccgggactcaccctttggggggctgcctaccttcaacctggcccagtcccctgcgtcattcccaccagaggcctccgagccacccagggttgtacggccggaacccagcacccgggccctggagcctcctgcggaggatcgcggcgatgaggtggtcctgaggcagaagcccccgacgggccgcaaggttcagctgacccccgcaagacagatgaaccttggatttggtgacgagtccccagagccagaggccagtgggcgaggggaacgcctgggcaggaaggtggcccctttggccaccaccgaagactctctggcttccatcccctttattgatgagcccaccagccccagcattgacctccaagccaagcacgtccctgcctctgctgtggtctccagtgccatgaactcagcccctgtcctgggcaccagcccatcttccccgaccttcactttcaccctcggacgccattactcgcaggactgcagcagcatcaaggctggccgccgctcctcctacctgctggccatcaccacggagcgctccaagtcctgcgatgatggactcaacaccttccgcgacgagggccgggttctgcggcgcctgccaaaccgcatacccagcctgcggatgctccggagcttcttcaccgacgggtccttggatagctggggcacctctgaagatgctgacgctccttctaagcgacactcaacctctgacctctcagatgcgaccttcagcgatatcaggagagaaggctggttgtattataagcagattctcaccaagaaggggaagaaagcgggcagcggcctgcgccagtggaagcgggtgtacgccgcgctgcgggcgcgctcgctctcgctgagcaaggagcggcgggagcccgggccggcggcggcgggggctgcggcggccggcgcaggtgaggacgaggcggcgcccgtctgcatcggctcctgcctcgtggacatctcctacagcgagaccaagaggaggcacgtgttccggctgaccaccgctgacttctgtgaatatctctttcaggctgaggaccgggatgacatgctgggctggatcagagcgatccgggagaacagcagggccgagggcgaggaccccggctgtgccaaccaagctctgatcagcaagaagcttaatgattatcgcaaagtgagccatagctctgggcccaaagctgattcctcccccaaaggctctcgcggcctggggggcctcaagtctgagttcctcaagcagagtgcggcacgtggcctcaggactcaggacctgcccgcagggagcaaggatgacagtgctgcagcccccaaaaccccctggggcatcaacatcatcaagaaaaataagaaggccgctccgagggcgtttggggtcaggctggaggagtgccagccagccacggagaaccagcgcgtccccttaatcgtggctgcatgctgtcgcattgtggaggcacgagggctggagtccacaggcatttaccgagtgcccggcaacaatgcagtggtgtccagcctacaggagcagctcaaccgcgggcctggtgacatcaacctgcaggatgagcgctggcaagacctcaatgtgatcagcagcctgctcaagtccttcttccgaaagctgcccgagcctcttttcactgatgacaaatacaacgacttcatcgaggccaaccgcattgaggacgcgcgggagcgaatgaggacgctgcggaagctgatccgggatctcccaggacactactatgaaacgctcaaattccttgtgggccatctcaagaccatcgctgaccactctgagaaaaacaagatggaaccccggaacctggccctggtctttgggccgacactggtgaggacgtctgaggacaacatgacagacatggtgacccacatgcctgaccgctacaagatcgtggagacactgatccagcactcagactggttcttcagtgacgaagaggacaagggagagagaacccctgtgggcgacaaggagcctcaggcagtgcccaacattgagtacctcctgcccaacattggcaggacagtgccccctggcgacccggggtcagattctaccacctgtagttcagccaagtccaagggttcgtgggcccccaagaaggagccgtacgcccgggagatgctggcgatctccttcatctcggccgtcaaccgcaagcgcaagaagcggcgggaggcgcgggggctgggcagcagcaccgacgacgactcggagcaggaggcgcacaagcctggggcgggggccacagcgccggggactcaggagcggccgcaggggccgctgcctggcgccgtcgcccccgaggcccccggacgcctcagtcccccggcggcgccggaggagcggccggccgcggacacgcgctccattgtgtcgggct

SEQ ID NO: 75863 - DNA, 1032 bp, Homo sapiens
  misc_feature (32)..(32): n is a, c, g, or t
gagctgatctagaggatcccgaagcgcacganaggcgcgtccccttaatcgtggctgcatgctgtcgcattgtggaggcacgagggctggagtccacaggcatttaccgagtgcccggcaacaatgcagtggtgtccagcctacaggagcagctcaaccgcgggcctggtgacatcaacctgcaggatgagcgctggcaagacctcaatgtgatcagcagcctgctcaagtccttcttccgaaagctgcccgagcctcttttcactgatgacaaatacaacgacttcatcgaggccaaccgcattgaggacgcgcgggagcgaatgaggacgctgcggaagctgatccgggatctcccaggacactactatgaaacgctcaaattccttgtgggccatctcaagaccatcgctgaccactctgagaaaaacaagatggaaccccggaacctggccctggtctttgggccgacactggtgaggacgtctgaggacaacatgacagacatggtgacccacatgcctgaccgctacaagatcgtggagacactgatccagcactcagactggttcttcagtgacgaagaggacaagggagagagaacccctgtgggcgacaaggagcctcaggcagtgcccaacattgagtacctcctgcccaacattggcaggacagtgccccctggcgacccggggtcagattctaccacctgtagttcagccaagtccaagggttcgtgggcccccaagaaggagccgtacgcccgggagatgctggcgatctccttcatctcggccgtcaaccgcaagcgcaagaagcggcgggaggcgcgggggctgggcagcagcaccgacgacgactcggagcaggaggcgcacaagcctggggcgggggccacagcgccggggactcaggagcggccgcaggggccgctgcctggcgccgtcgcccccgaggcccccggacgcctcagtcccccggcggcgccggaggagcggccggccgcggacacgcgctccattgtgtcgggct

SEQ ID NO: 75864 - DNA, 3081 bp, Homo sapiens
  misc_feature (312)..(312): n is a, c, g, or t
  misc_feature (321)..(321): n is a, c, g, or t
  misc_feature (329)..(329): n is a, c, g, or t
  misc_feature (335)..(335): n is a, c, g, or t
  misc_feature (354)..(354): n is a, c, g, or t
  misc_feature (358)..(358): n is a, c, g, or t
  misc_feature (374)..(374): n is a, c, g, or t
  misc_feature (386)..(386): n is a, c, g, or t
cagactggagtgccagcaggccttgtcacactggctgtcaaaccaggtaccccgccgggcgggggagagacggtgcccagccatggccccccgggcccgcagcgcctcccaggaccggttggaggaggtggctgccccccgcccgtggccctgctccacctcccaggatgctttgagccagctgggccatggagggctggcaccgagctcgctcagatgactacttgagccgggccacccgttctgccgaggcactggggccaggggcactggtgtcaccccgctttgagcggtgtggctgggcttcccagncgttcgtcntgcccgcnaccccncgcctgcccaactctgggnaccntgccagggccccaggnccccaacccccngtctggcctgcagggcctggatgacctcgggtacatcggctaccggagctacagcccatcattccagcgaccggaccggcctcctccatgcgctctccttccgggactcaccctttggggggctgcctaccttcaacctggcccagtcccctgcgtcattcccaccagaggcctccgagccacccagggttgtacggccggaacccagcacccgggccctggagcctcctgcggaggatcgcggcgatgaggtggtcctgaggcagaagcccccgacgggccgcaaggttcagctgacccccgcaagacagatgaaccttggatttggtgacgagtccccagagccagaggccagtgggcgaggggaacgcctgggcaggaaggtggcccctttggccaccaccgaagactctctggcttccatcccctttattgatgagcccaccagccccagcattgacctccaagccaagcacgtccctgcctctgctgtggtctccagtgccatgaactcagcccctgtcctgggcaccagcccatcttccccgaccttcactttcaccctcggacgccattactcgcaggactgcagcagcatcaaggctggccgccgctcctcctacctgctggccatcaccacggagcgctccaagtcctgcgatgatggactcaacaccttccgcgacgagggccgggttctgcggcgcctgccaaaccgcatacccagcctgcggatgctccggagcttcttcaccgacgggtccttggatagctggggcacctctgaagatgctgacgctccttctaagcgacactcaacctctgacctctcagatgcgaccttcagcgatatcaggagagaaggctggttgtattataagcagattctcaccaagaaggggaagaaagcgggcagcggcctgcgccagtggaagcgggtgtacgccgcgctgcgggcgcgctcgctctcgctgagcaaggagcggcgggagcccgggccggcggcggcgggggctgcggcggccggcgcaggtgaggacgaggcggcgcccgtctgcatcggctcctgcctcgtggacatctcctacagcgagaccaagaggaggcacgtgttccggctgaccaccgctgacttctgtgaatatctctttcaggctgaggaccgggatgacatgctgggctggatcagagcgatccgggagaacagcagggccgagggcgaggaccccggctgtgccaaccaagctctgatcagcaagaagcttaatgattatcgcaaagtgagccatagctctgggcccaaagctgattcctcccccaaaggctctcgcggcctggggggcctcaagtctgagttcctcaagcagagtgcggcacgtggcctcaggactcaggacctgcccgcagggagcaaggatgacagtgctgcagcccccaaaaccccctggggcatcaacatcatcaagaaaaataagaaggccgctccgagggcgtttggggtcaggctggaggagtgccagccagccacggagaaccagcgcgtccccttaatcgtggctgcatgctgtcgcattgtggaggcacgagggctggagtccacaggcatttaccgagtgcccggcaacaatgcagtggtgtccagcctacaggagcagctcaaccgcgggcctggtgacatcaacctgcaggatgagcgctggcaagacctcaatgtgatcagcagcctgctcaagtccttcttccgaaagctgcccgagcctcttttcactgatggtgcccttctcttctgacctgctgaaccttggtgtccatgtcctggagacgggggcagggaccccttttctgggatcagcatgcagctcagatggtattgcctcccaaatgaacacagctgggctaccccaggtcaggtgcacacccgagtgtagctgtgacaaatacaacgacttcatcgaggccaaccgcattgaggacgcgcgggagcgaatgaggacgctgcggaagctgatccgggatctcccaggacactactatgaaacgctcaaattccttgtgggccatctcaagaccatcgctgaccactctgagaaaaacaagatggaaccccggaacctggccctggtctttgggccgacactggtgaggacgtctgaggacaacatgacagacatggtgacccacatgcctgaccgctacaagatcgtggagacactgatccagcactcagactggttcttcagtgacgaagaggacaagggagagagaacccctgtgggcgacaaggagcctcaggcagtgcccaacattgagtacctcctgcccaacattggcaggacagtgccccctggcgacccggggtcagattctaccacctgtagttcagccaagtccaagggttcgtgggcccccaagaaggagccgtacgcccgggagatgctggcgatctccttcatctcggccgtcaaccgcaagcgcaagaagcggcgggaggcgcgggggctgggcagcagcaccgacgacgactcggagcaggaggcgcacaagcctggggcgggggccacagcgccggggactcaggagcggccgcaggggccgctgcctggcgccgtcgcccccgaggcccccggacgcctcagtcccccggcggcgccggaggagcggccggccgcggacacgcgctccattgtgtcgggct

SEQ ID NO: 75865 - DNA, 2450 bp, Homo sapiens
  misc_feature (312)..(312): n is a, c, g, or t
  misc_feature (321)..(321): n is a, c, g, or t
  misc_feature (329)..(329): n is a, c, g, or t
  misc_feature (335)..(335): n is a, c, g, or t
  misc_feature (354)..(354): n is a, c, g, or t
  misc_feature (358)..(358): n is a, c, g, or t
  misc_feature (374)..(374): n is a, c, g, or t
  misc_feature (386)..(386): n is a, c, g, or t
cagactggagtgccagcaggccttgtcacactggctgtcaaaccaggtaccccgccgggcgggggagagacggtgcccagccatggccccccgggcccgcagcgcctcccaggaccggttggaggaggtggctgccccccgcccgtggccctgctccacctcccaggatgctttgagccagctgggccatggagggctggcaccgagctcgctcagatgactacttgagccgggccacccgttctgccgaggcactggggccaggggcactggtgtcaccccgctttgagcggtgtggctgggcttcccagncgttcgtcntgcccgcnaccccncgcctgcccaactctgggnaccntgccagggccccaggnccccaacccccngtctggcctgcagggcctggatgacctcgggtacatcggctaccggagctacagcccatcattccagcgaccggaccggcctcctccatgcgctctccttccgggactcaccctttggggggctgcctaccttcaacctggcccagtcccctgcgtcattcccaccagaggcctccgagccacccagggttgtacggccggaacccagcacccgggccctggagcctcctgcggaggatcgcggcgatgaggtggtcctgaggcagaagcccccgacgggccgcaaggttcagctgacccccgcaagacagatgaaccttggatttggtgacgagtccccagagccagaggccagtgggcgaggggaacgcctgggcaggaaggtggcccctttggccaccaccgaagactctctggcttccatcccctttattgatgagcccaccagccccagcattgacctccaagccaagcacgtccctgcctctgctgtggtctccagtgccatgaactcagcccctgtcctgggcaccagcccatcttccccgaccttcactttcaccctcggacgccattactcgcaggactgcagcagcatcaaggctggccgccgctcctcctacctgctggccatcaccacggagcgctccaagtcctgcgatgatggactcaacaccttccgcgacgagggccgggttctgcggcgcctgccaaaccgcatacccagcctgcggatgctccggagcttcttcaccgacgggtccttggatagctggggcacctctgaagatgctgacgctccttctaagcgacactcaacctctgacctctcagatgcgaccttcagcgatatcaggagagaaggctggttgtattataagcagattctcaccaagaaggggaagaaagcgggcagcggcctgcgccagtggaagcgggtgtacgccgcgctgcgggcgcgctcgctctcgctgagcaaggagcggcgggagcccgggccggcggcggcgggggctgcggcggccggcgcaggtgaggacgaggcggcgcccgtctgcatcggctcctgcctcgtggacatctcctacagcgagaccaagaggaggcacgtgttccggctgaccaccgctgacttctgtgaatatctctttcaggctgaggaccgggatgacatgctgggctggatcagagcgatccgggagaacagcagggccgagggcgaggaccccggctgtgccaaccaagctctgatcagcaagaagcttaatgattatcgcaaagtgagccatagctctgggcccaaagctgattcctcccccaaaggctctcgcggcctggggggcctcaagtctgagttcctcaagcagagtgcggcacgtggcctcaggactcaggacctgcccgcagggagcaaggatgacagtgctgcagcccccaaaaccccctggggcatcaacatcatcaagaaaaataagaaggccgctccgagggcgtttggggtcaggctggaggagtgccagccagccacggagaaccagcgcgtccccttaatcgtggctgcatgctgtcgcattgtggaggcacgagggctggagtccacaggcatttaccgagtgcccggcaacaatgcagtggtgtccagcctacaggagcagctcaaccgcgggcctggtgacatcaacctgcaggatgaggtgggtgaagctggggggtctgtggaaggggggctgagatggtgtgtgggtggtgctccgcttggagagttctgtggtctattgtgttgcatgcattgtgccctatgacatgcccggcattggtccagaacaccaagatgggcaagatgggacctgcccccgctggccagcccggggatgggcatcaccccaggctgaagctgaccaagtaaatgcagtcatggcctggggagctctgaggcagaggctcacagatggcagttttgtccgagtgtttaggatgagtagagttcaccaaaggccggtgaaagccaggtgagggcattccaggcagcagaatggcctgctcaatggtgtagacgcggaaagt

SEQ ID NO: 75866 - DNA, 452 bp, Homo sapiens
ccaacattggcaggacagtgccccctggcgacccggggtcaggtgagcgcaggggcctgggagtggggaggcgggaggttggacactgcattcctgagggtcccaggtgcctggccagatgcccagcttccctgtgccaccccagcggggccctcccctgccggccaccatggagatggggctggggggggccttctccctccctagggaagtccagcttgccccgtgcccacctcctgtctgcgcagctgccccgccccgggcagggtcggagctttgttcgccctctctcactggtttctttcctcagcctttaatttctcatgggctggctgtgtccttctgggcatgttcctctttttaatttttcttccttttctccttgcacccccgcctctccctcctcttctccccgtgctctcctcccacccccttctcttctcctccccctc

SEQ ID NO: 75867 - DNA, 433 bp, Homo sapiens
ttgcttgctgggggtactccattctaagaattttaaacctctatggcacgaatgcagttaatagactgttgacatgaaaattacatgagatagcacagttctgtctgtgagaacaagggtggtaagaaatgacattaaggcagctgggtgcagtggctcacatctgtaatcccagcactttggaaggccgaggcaggcagatcagaaggtcagaagatcatagaccatcctggctaacatggtgaaaccccgtctctactaaaaatacaaaaaaaaaaaaaaattagccgggcatggtggcaggcgtctgtagtcccagctactcaggaggctgaggcaggagaatggtgtgaacccgggaggcagaggttgcagtgagccgaggtcgtgccactgcactccagcctgggcgacaatgcaagactccatctca

SEQ ID NO: 75868 - DNA, 490 bp, Homo sapiens
ctaataaagacacacctgagactgggtaatttataaagaaaaagaggtttagtggactcacagttccacatggctggggaggcctcacactcatggcagaaggtgaaagacacgtcttacatggtggcagacaagagtgaacttgtccaaggaaacttccccttataaaaccatcagatcttgtgagacccattcactaccatgagaacggtatgggggaaaccactcccacaattcaattatctcccatcaagtccctcccacaacaggtggtagttatgggagctaaaattcaagatgagatttggctgggggcacagcaaaccatatcaaggaatttgtttctaattcgctaattctattcatccattcaccaaatgactattagcctctcctagaggatctctttcagatgcaatgaagagaaaaaacaaactgatactaaattgtaataggcagatcaagagaggagtcacactgcattcactgc

SEQ ID NO: 75869 - DNA, 591 bp, Homo sapiens
gtgagtgagtggccgtattgtgttatttcatttcgcatttcttgatagcgcctacatttgaacacattttcatatcacctcacatcacttagatatcctttccatgaagtacacattttggggttgggttgctgtagtaaaactaaaaaatgcagataaagtgtttgccatgaaaatattgaataaatgggaaatgctgaaaagagctgagacagcatgttttcgtgaagaaagggatgtattagtgaatggagacaataaatggattacaaccttgcactatgctttccaggatgacaataacttatacctggttatggattattatgttggtggggatttgcttactctactcagcaaatttgaagatagattgcctgaagatatggctagattttacttggctgagatggtgatagcaattgactcagttcatcagctacattatgtacacaggtaaaacagtccttcattgtacctggctgtgagttaccatgtaatatctagcaacagaggcctatttcttgccagatttattaattatggtcttggatacatttatcgtcaaccaaaaaaaattattttgagatg

SEQ ID NO: 75870 - DNA, 3433 bp, Homo sapiens
tccgcaagcctccgcctctgtgcgcgggactggaggagcctcgctgagcccagggcgcgacggcgagaggagagggaaggcgggggagggctggaagggagaggaagggagtggttgggagccgggctgccgcagcctctagtctcctcagccgcggaagcacccctcctcctgcgccgcggccgcctccctcctcgctgtggaaagatgcccttagcccaggggtgtgaagaagggggagaagtagctgccagagccgcccgcgccgccgccgcagctgctgctcgttgtgtcctttgaattcagagaagcacccccccgcctggggcgtcgggagcctccgggcggcggccgcggtgcgggtgtcggggagaccgggctctctgcccgcgcggcgcggcgcggctcggcccacgagcgaccaccgacatggagtgggctcgggcggccaagtagccgcttctccggagcccggtgccagtgccgcccgcagcccgccttccacccccggccgcgccgccggtcaggccctagggtgaagccgggaggaaaatgaagagttttcaccggaatccgttgaaaataggactgactgcaaagccttaaagaaagaaggacctcgggaggagaaacgaaaagccgcctccgggcaagacttggcgtgctccgagccgaggggctgcttcagggacctcgccccctccctttcccgctggagaaattgccgctgatgcattatccaagtggtggttgggaggatttgcagcaacatttttggttttccctcccccttctatgcattctgtttttttcctcccttttctgtttttcttcttcccgggaagtgaattgctgatgcaaatcggactttattcattaatgatgcaaccggattcgtttcaggattacgttgcacgagttgaattttgaatgaaggagaagagtttttttttttttttaaagaagtgttgactctctagttcgttgtacttttaattattattttatttaaatatacgacttaattgtattcttttaaaaatgcattaagtatatattttatggtaatttaccctcaaaatatatgtatatgggtgaaattgaagacgccttcagttaagtgaggttactggtgtgttggatgtttaattcagcaccagcattgcatgacagttgtttgaataacaagtggtttatttttaaaaccataccttttaaaatttaggttcagataatagtaaaagtcatcataataatttaaaggaaaaccagcagaaatcgaagcaaacatgtctggagaagtgcgtttgaggcagttggagcagtttattttggacgggcccgctcagaccaatgggcagtacttcagtgtggagacattactggatatactcatctgcctttatgatgaatgcaataattctccattgagaagagagaagaacattctcgaatacctagaatgggctaaaccatttacttctaaagtgaaacaaatgcgattacatagagaagactttgaaatattaaaggtgattggtcgaggagcttttggggaggttgctgtagtaaaactaaaaaatgcagataaagtgtttgccatgaaaatattgaataaatgggaaatgctgaaaagagctgagacagcatgttttcgtgaagaaagggatgtattagtgaatggagacaataaatggattacaaccttgcactatgctttccaggatgacaataacttatacctggttatggattattatgttggtggggatttgcttactctactcagcaaatttgaagatagattgcctgaagatatggctagattttacttggctgagatggtgatagcaattgactcagttcatcagctacattatgtacacagagacattaaacctgacaatatactgatggatatgaatggacatattcggttagcagattttggttcttgtctgaagctgatggaagatggaacggttcagtcctcagtggctgtaggaactccagattatatctctcctgaaatccttcaagccatggaagatggaaaagggagatatggacctgaatgtgactggtggtctttgggggtctgtatgtatgaaatgctttacggagaaacaccattttatgcagaatcgctggtggagacatacggaaaaatcatgaaccacaaagagaggtttcagtttccagcccaagtgactgatgtgtctgaaaatgctaaggatcttattcgaaggctcatttgtagcagagaacatcgacttggtcaaaatggaatagaagactttaagaaacacccatttttcagtggaattgattgggataatattcggaactgtgaagcaccttatattccagaagttagtagcccaacagatacatcgaattttgatgtagatgatgattgtttaaaaaattctgaaacgatgcccccaccaacacatactgcattttctggccaccatctgccatttgttggttttacatatactagtagctgtgtactttctgatcggagctgtttaagagttacggctggtcccacctcactggatcttgatgttaatgttcagaggactctagacaacaacttagcaactgaagcttatgaaagaagaattaagcgccttgagcaagaaaaacttgaactcagtagaaaacttcaagagtcaacacagactgtccaagctctgcagtattcaactgttgatggtccactaacagcaagcaaagatttagaaataaaaaacttaaaagaagaaattgaaaaactaagaaaacaagtaacagaatcaagtcatttggaacagcaacttgaagaagctaatgctgtgaggcaagaactagatgatgcttttagacaaatcaaggcttatgaaaaacaaatcaaaacgttacaacaagaaagagaagatctaaataaggaactagtccaggctagtgagcgattaaaaaaccaatccaaagagctgaaagacgcacactgtcagaggaaactggccatgcaggaattcatggagatcaatgagcggctaacagaattgcacacccaaaaacagaaacttgctcgccatgtccgagataaggaagaagaggtggacctggtgatgcaaaaagttgaaagcttaaggcaagaactgcgcagaacagaaagagccaaaaaagagctggaagttcatacagaagctctagctgctgaagcatctaaagacaggaagctacgtgaacagagtgagcactattctaagcaactggaaaatgaattggagggactgaagcaaaaacaaattagttactcaccaggagtatgcagcatagaacatcagcaagagataaccaaactaaagactgatttggaaaagaaaagtatcttttatgaagaagaattatctaaaagagaaggaatacatgcaaatgaaat

SEQ ID NO: 75871 - DNA, 3873 bp, Homo sapiens
tccgcaagcctccgcctctgtgcgcgggactggaggagcctcgctgagcccagggcgcgacggcgagaggagagggaaggcgggggagggctggaagggagaggaagggagtggttgggagccgggctgccgcagcctctagtctcctcagccgcggaagcacccctcctcctgcgccgcggccgcctccctcctcgctgtggaaagatgcccttagcccaggggtgtgaagaagggggagaagtagctgccagagccgcccgcgccgccgccgcagctgctgctcgttgtgtcctttgaattcagagaagcacccccccgcctggggcgtcgggagcctccgggcggcggccgcggtgcgggtgtcggggagaccgggctctctgcccgcgcggcgcggcgcggctcggcccacgagcgaccaccgacatggagtgggctcgggcggccaagtagccgcttctccggagcccggtgccagtgccgcccgcagcccgccttccacccccggccgcgccgccggtcaggccctagggtgaagccgggaggaaaatgaagagttttcaccggaatccgttgaaaataggactgactgcaaagccttaaagaaagaaggacctcgggaggagaaacgaaaagccgcctccgggcaagacttggcgtgctccgagccgaggggctgcttcagggacctcgccccctccctttcccgctggagaaattgccgctgatgcattatccaagtggtggttgggaggatttgcagcaacatttttggttttccctcccccttctatgcattctgtttttttcctcccttttctgtttttcttcttcccgggaagtgaattgctgatgcaaatcggactttattcattaatgatgcaaccggattcgtttcaggattacgttgcacgagttgaattttgaatgaaggagaagagtttttttttttttttaaagaagtgttgactctctagttcgttgtacttttaattattattttatttaaatatacgacttaattgtattcttttaaaaatgcattaagtatatattttatggtaatttaccctcaaaatatatgtatatgggtgaaattgaagacgccttcagttaagtgaggttactggtgtgttggatgtttaattcagcaccagcattgcatgacagttgtttgaataacaagtggtttatttttaaaaccataccttttaaaatttaggttcagataatagtaaaagtcatcataataatttaaaggaaaaccagcagaaatcgaagcaaacatgtctggagaagtgcgtttgaggcagttggagcagtttattttggacgggcccgctcagaccaatgggcagtacttcagtgtggagacattactggatatactcatctgcctttatgatgaatgcaataattctccattgagaagagagaagaacattctcgaatacctagaatgggctaaaccatttacttctaaagtgaaacaaatgcgattacatagagaagactttgaaatattaaaggtgattggtcgaggagcttttggggaggttgctgtagtaaaactaaaaaatgcagataaagtgtttgccatgaaaatattgaataaatgggaaatgctgaaaagagctgagacagcatgttttcgtgaagaaagggatgtattagtgaatggagacaataaatggattacaaccttgcactatgctttccaggatgacaataacttatacctggttatggattattatgttggtggggatttgcttactctactcagcaaatttgaagatagattgcctgaagatatggctagattttacttggctgagatggtgatagcaattgactcagttcatcagctacattatgtacacagagacattaaacctgacaatatactgatggatatgaatggacatattcggttagcagattttggttcttgtctgaagctgatggaagatggaacggttcagtcctcagtggctgtaggaactccagattatatctctcctgaaatccttcaagccatggaagatggaaaagggagatatggacctgaatgtgactggtggtctttgggggtctgtatgtatgaaatgctttacggagaaacaccattttatgcagaatcgctggtggagacatacggaaaaatcatgaaccacaaagagaggtttcagtttccagcccaagtgactgatgtgtctgaaaatgctaaggatcttattcgaaggctcatttgtagcagagaacatcgacttggtcaaaatggaatagaagactttaagaaacacccatttttcagtggaattgattgggataatattcggaactgtgaagcaccttatattccagaagttagtagcccaacagatacatcgaattttgatgtagatgatgattgtttaaaaaattctgaaacgatgcccccaccaacacatactgcattttctggccaccatctgccatttgttggttttacatatactagtagctgtgtactttctgatcggagctgtttaagagttacggctggtcccacctcactggatcttgatgttaatgttcagaggactctagacaacaacttagcaactgaagcttatgaaagaagaattaagcgccttgagcaagaaaaacttgaactcagtagaaaacttcaagagtcaacacagactgtccaagctctgcagtattcaactgttgatggtccactaacagcaagcaaagatttagaaataaaaaacttaaaagaagaaattgaaaaactaagaaaacaagtaacagaatcaagtcatttggaacagcaacttgaagaagctaatgctgtgaggcaagaactagatgatgcttttagacaaatcaaggcttatgaaaaacaaatcaaaacgttacaacaagaaagagaagatctaaataaggaactagtccaggctagtgagcgattaaaaaaccaatccaaagagctgaaagacgcacactgtcagaggaaactggccatgcaggaattcatggagatcaatgagcggctaacagaattgcacacccaaaaacagaaacttgctcgccatgtccgagataaggaagaagaggtggacctggtgatgcaaaaagttgaaagcttaaggcaagaactgcgcagaacagaaagagccaaaaaagagctggaagttcatacagaagctctagctgctgaagcatctaaagacaggaagctacgtgaacagagtgagcactattctaagcaactggaaaatgaattggagggactgaagcaaaaacaaattagttactcaccaggagtatgcagcatagaacatcagcaagagataaccaaactaaagactgatttggaaaagaaaagtatcttttatgaagaagaattatctaaaagagaaggaatacatgcaaatgaaataaaaaatcttaagaaagaactgcatgattcagaaggtcagcaacttgctctcaacaaagaaattatgattttaaaagacaaattggaaaaaaccagaagagaaagtcaaagtgaaagggaggaatttgaaagtgagttcaaacaacaatatgaacgagaaaaagtgttgttaactgaagaaaataaaaagctgacgagtgaacttgataagcttactactttgtatgagaacttaagtatacacaaccagcagttagaagaagaggttaaagatctagcagacaagaaagaatcagttgcacattgggaagcccaaatcacagaaataattcagtgggtcagcgatgaaaaggatgcacgagggtatcttcaggccttagcttctaaaatgactgaagaattggaggcattaagaaattccagcttgggtacacgagcaa

SEQ ID NO: 75872 - DNA, 2001 bp, Homo sapiens
gtgagtgagtggccgtattgtgttatttcatttcgcatttcttgatagcgcctacatttgaacacattttcatatcacctcacatcacttagatatcctttccatgaagtacacattttggggttgggttgctgtagtaaaactaaaaaatgcagataaagtgtttgccatgaaaatattgaataaatgggaaatgctgaaaagagctgagacagcatgttttcgtgaagaaagggatgtattagtgaatggagacaataaatggattacaaccttgcactatgctttccaggatgacaataacttatacctggttatggattattatgttggtggggatttgcttactctactcagcaaatttgaagatagattgcctgaagatatggctagattttacttggctgagatggtgatagcaattgactcagttcatcagctacattatgtacacagagacattaaacctgacaatatactgatggatatgaatggacatattcggttagcagattttggttcttgtctgaagctgatggaagatggaacggttcagtcctcagtggctgtaggaactccagattatatctctcctgaaatccttcaagccatggaagatggaaaagggagatatggacctgaatgtgactggtggtctttgggggtctgtatgtatgaaatgctttacggagaaacaccattttatgcagaatcgctggtggagacatacggaaaaatcatgaaccacaaagagaggtttcagtttccagcccaagtgactgatgtgtctgaaaatgctaaggatcttattcgaaggctcatttgtagcagagaacatcgacttggtcaaaatggaatagaagactttaagaaacacccatttttcagtggaattgattgggataatattcggaactgtgaagcaccttatattccagaagttagtagcccaacagatacatcgaattttgatgtagatgatgattgtttaaaaaattctgaaacgatgcccccaccaacacatactgcattttctggccaccatctgccatttgttggttttacatatactagtagctgtgtactttctgatcggagctgtttaagagttacggctggtcccacctcactggatcttgatgttaatgttcagaggactctagacaacaacttagcaactgaagcttatgaaagaagaattaagcgccttgagcaagaaaaacttgaactcagtagaaaacttcaagagtcaacacagactgtccaagctctgcagtattcaactgttgatggtccactaacagcaagcaaagatttagaaataaaaaacttaaaagaagaaattgaaaaactaagaaaacaagtaacagaatcaagtcatttggaacagcaacttgaagaagctaatgctgtgaggcaagaactagatgatgcttttagacaaatcaaggcttatgaaaaacaaatcaaaacgttacaacaagaaagagaagatctaaataaggaactagtccaggctagtgagcgattaaaaaaccaatccaaagagctgaaagacgcacactgtcagaggaaactggccatgcaggaattcatggagatcaatgagcggctaacagaattgcacacccaaaaacagaaacttgctcgccatgtccgagataaggaagaagaggtggacctggtgatgcaaaaagttgaaagcttaaggcaagaactgcgcagaacagaaagagccaaaaaagagctggaagttcatacagaagctctagctgctgaagcatctaaagacaggaagctacgtgaacagagtgagcactattctaagcaactggaaaatgaattggagggactgaagcaaaaacaaattagttactcaccaggagtatgcagcatagaacatcagcaagagataaccaaactaaagactgatttggaaaagaaaagtatcttttatgaagaagaattatctaaaagagaaggaatacatgcaaatgaaat

SEQ ID NO: 75873 - DNA, 428 bp, Homo sapiens
tatagtttgggatttttaaatattttgacaattcttaaatcataatttgaatttttgtgtaactaagaaacaccattatttatatctaatttgcatcacattttattaagaaaataattgatattgctctttcatttcagctaaaccatttacttctaaagtgaaacaaatgcgattacatagagaagactttgaaatattaaaggtgattggtcgaggagcttttggggaggtaagagattaagatttgatagaaggtctgctaattattttggaagctgttgaacacaattgtgagagaatttaacaagtattgttacttgttacttgttaaacaatatttgttaagttgtgattgatgtgattgattgtgctgttgtgattgatataatagctcagaaaataaagtgttgaatgaaatatttcta

SEQ ID NO: 75874 - DNA, 395 bp, Homo sapiens
aattagaaatttaaatgtaaagcaagaaatcatgtaagtcccagccaaaaatttgaataaatatgtaatctttgtgtgaagaaaactttttaaaaacagcaacaaagacagactattaaggaatgtaaactgaggaaaatatttgcaatatatggcaggcaaaaagttagtagatttaacatagaattttatttttgttaggatgtacaaaaaatgcagttatatgaatactcatttatattacagaaagaagttatttaaatattttattattcttgtagatgcactaatcttttgttattatttctatagcaaaaacaaattagttactcaccaggagtatgcagcatagaacatcagcaagagataaccaaactaaagactgatttggaaaa

SEQ ID NO: 75875 - DNA, 736 bp, Homo sapiens
ctgtcattcagctgacttttggctcgctaaatatagctgaatatcacaaattctaattgtcaaaaccctccctcattttaatttgaactagaaaactagacaaaatttggtaagaataaatttcagcaaactgtagaattatgatctaaaatatctcaaaattttatcccattttactttgaataatgttagaaatatactatgctaggctgtcagttggatccttttagtactacataagtaagttataaattacttaaattgctctcagtactttcagagaaagctaacattaccataattttggaaaaattagactgacctaaaagcagctcctctgctccttttcaaatctcctcctggttcagcctgcctgcctccacttctgcctccaccatgtccatcagggtgacccagcagccctacaaggtgttcaactctggcccctgggccttcagcagctcctcctacatgagcaggcccagtgcccacatcagctccttgattgtctcccgagtgggcagcagcagcaccagcttccagggtggcctgggtgccggcatgggtctgccactgcactccagcctggctaacagagcgagactgtctcaaaaaaaaaaaaaaagaataaataataataatagtaattataactgatatgccaggaaaggagggaaaatggaatcatataaaatgctcatttaaaaccataaaaggcagaaaaagaatggaaggc

SEQ ID NO: 75876 - DNA, 503 bp, Homo sapiens
cttgaatttagaaagagcgggtgggtggggtgatcagctgggcctcttctgtgcatggtagagcacatttcagaattgtgtgtgtatcagtggtcactgtaatttaagaaaaaagaacaagaattcagaaaattatatcctatccgaaaaaaaggctactctaatgttcctgatgacttcattatcaactggagttatttatttttctaagaatgttatctttggagataattttcatcagtgagtcaacctttgtttgcttgcattggtttcaccttctattattttttacccatgactgtcagcttttaccacttactgaaccctgacggaagaaggacgtctgctcattgacatgctgacaacctgataagtcaccccacacacataccacacacacacgtgcacatccactcattcgactcgctcagacccagtggctagtgtcgatttttctctaaagttgactatataataatcacttcatttcccagaaaaaaatg

SEQ ID NO: 75877 - DNA, 373 bp, Homo sapiens
ctcagcctcccaatgtgctgggattacaggtgtgagctactgcacccgggttgcacagcttttaatatgtttattagcaatctggatttctgcttttgtgaagtactttcttaactcttgagtccatttttcttttaggttatcttcttcttaatgattcaagggcattctttaaatatcttgtttatgagcccctttattctttatatgtgttgcaaatttttttcctatttatgactcctaatttcacactattaggttaatattaaagctagtttttatgtagtcaaatttatccatcttcctttatggttataaaatcattcctgaagcattgtttccacctgaaagtcacatgagaatgtcactcata

SEQ ID NO: 75878 - DNA, 1266 bp, Homo sapiens
ggtggagttaaatcaggttcccggttgattttggcgtttcaggaatccgtgcttaccaagtgtaaattgcattgctacttgttgaggtaaaaactaaaaatacagttggagtgtagagggagcagtttcggttatcctggtgacaggtgggatttttagaacagcaactttactaaaacatactgggtttttaaaaattctgtacttagttttataggtgtactctaaggaaatgcaacttatgggtgttcaattttatatgagtaaggagtgtgtgtttacctgagtgatcctcctgtatcttaggattgttttaggcattaaatttccttagtgaactgaaactattttgatttatacccatctcttaacacacatgcggcaaagtggcctccttgtttttgacattttcctagaattttctgacagtcttaccattgtttgtaatttaaaatgtttgtttgaatttttttttttttttgagacagtctcacgctgtcgcccaggctggagtgcagtggcgcgatttcggctcatttcaacctctgccaccctggttcaaaagattctcccgtctcagcctcccgagtagctgggattacagacgcccgccaccgcgccgtgttaatttttgtagttttcgtagagacggggttttgccatgttggccagactggatcacgaggtcaggagatggagactatctcttgagcctggtgtggtggcgggcgcctgcagtcccagctactcccgaggctgagacaggagaatcgcttgaacccgggaggtggaggttgcctgggcgacagagagagactctctccaaaaaaacaaaacaaaaaaaacacataagcaaacaactatacaagcagtataaagcatgtctaatactgccatatcacaatggcatatttcaatagggaaatggtattttaaataccattttttaaaaaccttttattctggaaaacatgcgaaactcgaatagtatggagaaccccatgtgttagtcactcacttagctttgacaattattaactcatagccaaggtcggttttgtttcatgttgtatccccccacacaaactagattattttgaaacaaatcttaaacattgtgtcacaacattagcgattttgacttttaccagattgccccagattaaggtcacaaaatttacttttagtagaataatagttctcatttttgtttgttgggcttcccttctctgtttatacatgatttctgtacagcagaaaagaaga

SEQ ID NO: 75879 - DNA, 329 bp, Homo sapiens
ctgggtaatttataataaacataaatttatgatgcatgcacttgctctccccaagggaccaaggacaagcctgctacgtactaccacccatggtaaccccacccatacaattggcagagcatacacttctccaaggactgaggaccagttaaccaaatgcctagcaaaactgtgccactacctccataaatgcccacagtctacatcactgaggaactcaaatatgtcactgatttgattaaagtcaaagaaatcacatgaagactacactcctgtgtccaccaagaacaaaaggtgaagcatcctacccaattgacactataggccac

SEQ ID NO: 75880 - DNA, 281 bp, Homo sapiens
gcagtcttgagggacatacaggagtttaggcactaggggacagaatgtgctgaggtccagagccaagaaagcatgactttgaaagctctgcaaatacagaaacacttcattatggttggagtatgaaaggaaagttggccaaaaatgagactaacgtaggagtttgacgattttaatgtccaacatttcaaagcctttgatgtaaagaacatttaaaggtaacagaatagtatctatttgagtcaaatatgacaggaataatatctgtgatgctcaaaggg

SEQ ID NO: 75881 - DNA, 762 bp, Homo sapiens
gcagataaatgctgatactgacacttctcaccagaaaaagagaaatacccatcatgaggaagagaaatgacttttgttcagttatgctcccgggtcccctttcactggagggatatctcagctttctgagcccctggttactgcaatcctcggttccagaacccagcaattcctatcatcacaattgtttcaagtcttatccaagccctgtatatttcagatcatccttaatttcttgttctgtacccagaggagatcaggaaaacctttaagtctctatgtgaggcaaatacatcctcctcactgccccagccccatgtgattgatgaagcaactgaggaagagaagtagggtgcttctggcactggaggagcgcagtgctgagaaactccgggctccattcggaaatagcactgatttcttagtgtacttttttttggtgttaatatagaaaacatcaaaaacacagttaaaagaatgaagcatgtctacatacgtgtggccagaaagactgaccagaagctggtagcagtgagggatgacagtgcttgcccctgggttgaatagtggaagagttaggggggaaacagtctgctctttgagaccctttcaatttcatgtgatggatttacagagacagatgaattaaacattatataaaaaaggaataaaaccactggtaggatctgtattccaggaagaaaaaagcatattacataataggtcaatgcacagaaataaaaaaaggaatttaactagagc

SEQ ID NO: 75882 - DNA, 383 bp, Homo sapiens
aatatcttgatgaaatgcacaggaatatctgcaaggtcaatgtttcatggacatttatttaggagaagtcattaaaaatgtattttttcctagtccgttgtgacagtatttggttcttaggtgcatgagttttagcaggaggattgcattattcaccttctgagccttgacagaaactgcttattttccgtaatgtggtcaatacatgtgtagtttctgaactgtaaaatccacagagaattaatactttgcagttattgctagatgggataagcaagcctattatgtcagcaaaattgatgattccttaatatgggctaaagtctccacctacttaattttctctaaaaccaagacattagtggtttgctttaaagattcaa

SEQ ID NO: 75883 - DNA, 549 bp, Homo sapiens
agtcctaagcagacttaaagccaagaaaataagaagaggaaagagagagggcctgccttaaccagctgtggtgctgacttggacaattccaggtcaagaggaactgtctactttcgactttgtgtgatagtaactttttaagcagtggaccgggagcccaagactcagatgcagcaagctttgcaaggctgacgagagctgagatcttcagtggccgatgggtacagggctgctgggagcgtagccacgtctgctccaaggtggcttgaatgaggcagtgcccaagtccttttgactggctgaggtgagcctgtggctcagtcacactttgtccctctcgtaataagtgcatttcccagacagcagctccttggtgtcatgcaactgaggaacctaattggctgggtgggttgttcccatccaacttccacctgtcacgaaggttgctttttcagatcagtctccacagctaccatcttgtcgggcacagagccgggcatcaacaagtgtatgttgaataaagaatgaattgatgaaatgaagtgaatg

SEQ ID NO: 75884 - DNA, 393 bp, Homo sapiens
tgggggattctccaaggtggcatggacatacaggatggaaatgggagacgtgtcaggcctggagatatgggttttggaacaacctgcattaaaattggaaggattagagagagtaggtgagatctccgagacagaggaaacagagcgaggaagctaagacctaggctggggcaaatgtctgaatttacctgagtgggggaagacagagaagctggcatgttggacagagatgactggtcaccaagacagaaggaagaatcaggccgtttaacaggatcaagagggtctagtgtttaaagagagatctttccaactgctacaggaaagtaaaatgttatggctccagacacctgctgaaattggtgcatgatcccctcaaagacagtgtttcct

SEQ ID NO: 75885 - DNA, 390 bp, Homo sapiens
ttttagtagagacggggtttcaccatgttggccaggctggtcacgaacttgacctcaagtgatcgacctgcctggcctctcaaagtgctgggattacaggtatgagccaccatgcctgacctgttcctgtattttctaattctctttatacttaggttctctatcacacctgaatgcaccaacacttatagttaaaatttagaaagtgcactcaagtctaacatgttggaagactggattgtaatttgagtcaacctgttattttgtacttggttcaaagtcagtcaatactattttttatatctatggcacatttatgttactagtactgcagtagatttttaacaacttcgtgtcttaggggagatactctgttaatttcaaataggt

SEQ ID NO: 75886 - DNA, 3478 bp, Homo sapiens
agagcagcttccggcgtggctggtgtaggcgggtggagaaggatcggggccctcgccgctctgtctcattccctcgcgctctctcgggcaacatggcgggtgtggaggaggtagcggcctccgggagccacctgaatggcgacctggatccagacgacagggaagaaggagctgcctctacggctgaggaagcagccaagaaaaaaagacgaaagaagaagaagagcaaagggccttctgcagcaggggaacaggaacctgataaagaatcaggagcctcagtggatgaagtagcaagacagttggaaagatcagcattggaagataaagaaagagatgaagatgatgaagatggagatggcgatggagatggagcaactggaaagaagaagaaaaagaagaagaagaagagaggaccaaaagttcaaacagaccctccctcagttccaatatgtgacctgtatcctaatggtgtatttcccaaaggacaagaatgcgaatacccacccacacaagatgggcgaacagctgcttggagaactacaagtgaagaaaagaaagcattagatcaggcaagtgaagagatttggaatgattttcgagaagctgcagaagcacatcgacaagttagaaaatacgtaatgagctggatcaagcctgggatgacaatgatagaaatctgtgaaaagttggaagactgttcacgcaagttaataaaagagaatggattaaatgcaggcctggcatttcctactggatgttctctcaataattgtgctgcccattatactcccaatgccggtgacacaacagtattacagtatgatgacatctgtaaaatagactttggaacacatataagtggtaggattattgactgtgcttttactgtcacttttaatcccaaatatgatacgttattaaaagctgtaaaagatgctactaacactggaataaagtgtgctggaattgatgttcgtctgtgtgatgttggtgaggccatccaagaagttatggagtcctatgaagttgaaatagatgggaagacatatcaagtgaaaccaatccgtaatctaaatggacattcaattgggcaatatagaatacatgctggaaaaacagtgccgattgtgaaaggaggggaggcaacaagaatggaggaaggagaagtatatgcaattgaaacctttggtagtacaggaaaaggtgttgttcatgatgatatggaatgttcacattacatgaaaaattttgatgttggacatgtgccaataaggcttccaagaacaaaacacttgttaaatgtcatcaatgaaaactttggaacccttgccttctgccgcagatggctggatcgcttgggagaaagtaaatacttgatggctctgaagaatctgtgtgacttgggcattgtagatccatatccaccattatgtgacattaaaggatcatatacagcgcaatttgaacataccatcctgttgcgtccaacatgtaaagaagttgtcagcagaggagatgactattaaacttagtccaaagccacctcaacacctttattttctgagctttgttggaaaacatgataccagaattaatttgccacatgttgtctgttttaacagtggacccatgtaatacttttatccatgtttaaaaaagaaggaatttggacaaaggcaaaccgtctaatgtaattaaccaacgaaaaagctttccggacttttaaatgctaactgtttttccccttcctgtctaggaaaatgctataaagctcaaattagttaggaatgacttatacgttttgttttgaatacctaagagatactttttggatatttatattgccatattcttacttgaatgctttgaatgactacatccagttctgcacctataccctctggtgttgctttttaaccttcctggaatccattttctaaaaaataaagacattttcagatctgagagctacatctcaatgtctgtggttataattctggacaggataaatagctaaacttaatgtaggcaaatgcagagacatttatctgaaatgtagacctctacactgagacttttctggcatagtggctaaaacaagatctacacatgcataaaaagggacaatcaccttttcttcataaatatacagctttaggaatatttcaccattctttgtaggacatagtagtccttgtctttttttctcctgacattggaaagatgtgctaattgaaacttgacttagtaggaacattgtgccaactcaaaaccttgatttagtaaaaatctcaatgtttagatcctttgtccagtggtggtgtttatcagggaatgtattcagcttgctcagaaaaccaaaagggtattaaagccacaaaagcaaagaagaaaaaaaaaaacttcccatgtttggatcttgttctagttagaaaaattaagttgaaattcttggactttttcattcatgaggcaaatgctgtaataccttcccctttgacaggtttggattcttaacattactagtggtatttcaggaagtgacgttacagttactttccttatagcggctaagtgtattaagttgaatgtaacgatggtaatattaatttgtttgaactgaggcccactactgattctttgacaaattgaattcttatatttaaataattttatgggaatgttccatcataatttctaaatcatttatatatcaaggtagccttaatttgtatatgtttcagtacaatgagattttattgcctctgggatgctgtttagtttgtattttgttgaacgtttttatcctaggaagagaaacctatgacttgtgtacctagatcatctgttacattaaaaagctgctctttcagcattagagctataaatgaatgttaccttgtcgggaaacaatctaggttttagctgtatgagctatgtttattatggtgctaatgttcagtagccacatttgactaatgtctccattctctgtgatgctgtggctagcagcagagctcgccagttcatgcctggacatactgtcagggctgggccctccagctagctcctttggggttgagtccgtatctttttgatgtggaagtataaagcaagtatcttgatttctaaacccagcaattttagaattgacctttatgagtgaagacttttggagcttttaaagaccttggcagtcatgatctcaaaccaattaggagctccaagctcccttcccaggtaactgttgggagcaatggcatcactgtatgcccttgtaatggctggaagggacatgatcttgtaagtaggaaagctgtaactaaaaattgtattgtttgcttattagccatgtatctcttaaaattttgttatgtttacaacgatgtaccttattggcaacaagttattagtttgatgtttaacaatagtgcctttagtaaattattttacaactaaaaaaaattgttttttg

SEQ ID NO: 75887 - DNA, 3482 bp, Homo sapiens
gttcctagaggatccccgttattttccttctatattggggagaaggatcggggccctcgccgctctgtctcattccctcgcgctctctcgggcaacatggcgggtgtggaggaggtagcggcctccgggagccacctgaatggcgacctggatccagacgacagggaagaaggagctgcctctacggctgaggaagcagccaagaaaaaaagacgaaagaagaagaagagcaaagggccttctgcagcaggggaacaggaacctgataaagaatcaggagcctcagtggatgaagtagcaagacagttggaaagatcagcattggaagataaagaaagagatgaagatgatgaagatggagatggcgatggagatggagcaactggaaagaagaagaaaaagaagaagaagaagagaggaccaaaagttcaaacagaccctccctcagttccaatatgtgacctgtatcctaatggtgtatttcccaaaggacaagaatgcgaatacccacccacacaagatgggcgaacagctgcttggagaactacaagtgaagaaaagaaagcattagatcaggcaagtgaagagatttggaatgattttcgagaagctgcagaagcacatcgacaagttagaaaatacgtaatgagctggatcaagcctgggatgacaatgatagaaatctgtgaaaagttggaagactgttcacgcaagttaataaaagagaatggattaaatgcaggcctggcatttcctactggatgttctctcaataattgtgctgcccattatactcccaatgccggtgacacaacagtattacagtatgatgacatctgtaaaatagactttggaacacatataagtggtaggattattgactgtgcttttactgtcacttttaatcccaaatatgatacgttattaaaagctgtaaaagatgctactaacactggaataaagtgtgctggaattgatgttcgtctgtgtgatgttggtgaggccatccaagaagttatggagtcctatgaagttgaaatagatgggaagacatatcaagtgaaaccaatccgtaatctaaatggacattcaattgggcaatatagaatacatgctggaaaaacagtgccgattgtgaaaggaggggaggcaacaagaatggaggaaggagaagtatatgcaattgaaacctttggtagtacaggaaaaggtgttgttcatgatgatatggaatgttcacattacatgaaaaattttgatgttggacatgtgccaataaggcttccaagaacaaaacacttgttaaatgtcatcaatgaaaactttggaacccttgccttctgccgcagatggctggatcgcttgggagaaagtaaatacttgatggctctgaagaatctgtgtgacttgggcattgtagatccatatccaccattatgtgacattaaaggatcatatacagcgcaatttgaacataccatcctgttgcgtccaacatgtaaagaagttgtcagcagaggagatgactattaaacttagtccaaagccacctcaacacctttattttctgagctttgttggaaaacatgataccagaattaatttgccacatgttgtctgttttaacagtggacccatgtaatacttttatccatgtttaaaaaagaaggaatttggacaaaggcaaaccgtctaatgtaattaaccaacgaaaaagctttccggacttttaaatgctaactgtttttccccttcctgtctaggaaaatgctataaagctcaaattagttaggaatgacttatacgttttgttttgaatacctaagagatactttttggatatttatattgccatattcttacttgaatgctttgaatgactacatccagttctgcacctataccctctggtgttgctttttaaccttcctggaatccattttctaaaaaataaagacattttcagatctgagagctacatctcaatgtctgtggttataattctggacaggataaatagctaaacttaatgtaggcaaatgcagagacatttatctgaaatgtagacctctacactgagacttttctggcatagtggctaaaacaagatctacacatgcataaaaagggacaatcaccttttcttcataaatatacagctttaggaatatttcaccattctttgtaggacatagtagtccttgtctttttttctcctgacattggaaagatgtgctaattgaaacttgacttagtaggaacattgtgccaactcaaaaccttgatttagtaaaaatctcaatgtttagatcctttgtccagtggtggtgtttatcagggaatgtattcagcttgctcagaaaaccaaaagggtattaaagccacaaaagcaaagaagaaaaaaaaaaacttcccatgtttggatcttgttctagttagaaaaattaagttgaaattcttggactttttcattcatgaggcaaatgctgtaataccttcccctttgacaggtttggattcttaacattactagtggtatttcaggaagtgacgttacagttactttccttatagcggctaagtgtattaagttgaatgtaacgatggtaatattaatttgtttgaactgaggcccactactgattctttgacaaattgaattcttatatttaaataattttatgggaatgttccatcataatttctaaatcatttatatatcaaggtagccttaatttgtatatgtttcagtacaatgagattttattgcctctgggatgctgtttagtttgtattttgttgaacgtttttatcctaggaagagaaacctatgacttgtgtacctagatcatctgttacattaaaaagctgctctttcagcattagagctataaatgaatgttaccttgtcgggaaacaatctaggttttagctgtatgagctatgtttattatggtgctaatgttcagtagccacatttgactaatgtctccattctctgtgatgctgtggctagcagcagagctcgccagttcatgcctggacatactgtcagggctgggccctccagctagctcctttggggttgagtccgtatctttttgatgtggaagtataaagcaagtatcttgatttctaaacccagcaattttagaattgacctttatgagtgaagacttttggagcttttaaagaccttggcagtcatgatctcaaaccaattaggagctccaagctcccttcccaggtaactgttgggagcaatggcatcactgtatgcccttgtaatggctggaagggacatgatcttgtaagtaggaaagctgtaactaaaaattgtattgtttgcttattagccatgtatctcttaaaattttgttatgtttacaacgatgtaccttattggcaacaagttattagtttgatgtttaacaatagtgcctttagtaaattattttacaactaaaaaaaattgttttttg

SEQ ID NO: 75888 - DNA, 3425 bp, Homo sapiens
agagcagcttccggcgtggctggtgtaggcgggtggagaaggatcggggccctcgccgctctgtctcattccctcgcgctctctcgggcaacatggcgggtgtggaggaggtagcggcctccgggagccacctgaatggcgacctggatccagacgacagggaagaaggagctgcctctacggctgaggaagcagccaagaaaaaaagacgaaagaagaagaagagcaaagggccttctgcagcaggggaacaggaacctgataaagaatcaggagcctcagtggatgaagtagcaagacagttggaaagatcagcattggaagataaagaaagagatgaagatgatgaagatggagatggcgatggagatggagcaactggaaagaagaagaaaaagaagaagaagaagagaggaccaaaagttcaaacagaccctccctcagttccaatatgtgacctgtatcctaatggtgtatttcccaaaggacaagaatgcgaatacccacccacacaagatgggcgaacagctgcttggagaactacaagtgaagaaaagaaagcattagatcaggcaagtgaagagatttggaatgattttcgagaagctgcagaagcacatcgacaagttagaaaatacgtaatgagctggatcaagcctgggatgacaatgatagaaatctgtgaaaagttggaagactgttcacgcaagttaataaaagagaatggattaaatgcaggcctggcatttcctactggatgttctctcaataattgtgctgcccattatactcccaatgccggtgacacaacagtattacagtatgatgacatctgtaaaatagactttggaacacatataagtggtaggattattgactgtgcttttactgtcacttttaatcccaaatatgatacgttattaaaagctgtgtgatgttggtgaggccatccaagaagttatggagtcctatgaagttgaaatagatgggaagacatatcaagtgaaaccaatccgtaatctaaatggacattcaattgggcaatatagaatacatgctggaaaaacagtgccgattgtgaaaggaggggaggcaacaagaatggaggaaggagaagtatatgcaattgaaacctttggtagtacaggaaaaggtgttgttcatgatgatatggaatgttcacattacatgaaaaattttgatgttggacatgtgccaataaggcttccaagaacaaaacacttgttaaatgtcatcaatgaaaactttggaacccttgccttctgccgcagatggctggatcgcttgggagaaagtaaatacttgatggctctgaagaatctgtgtgacttgggcattgtagatccatatccaccattatgtgacattaaaggatcatatacagcgcaatttgaacataccatcctgttgcgtccaacatgtaaagaagttgtcagcagaggagatgactattaaacttagtccaaagccacctcaacacctttattttctgagctttgttggaaaacatgataccagaattaatttgccacatgttgtctgttttaacagtggacccatgtaatacttttatccatgtttaaaaaagaaggaatttggacaaaggcaaaccgtctaatgtaattaaccaacgaaaaagctttccggacttttaaatgctaactgtttttccccttcctgtctaggaaaatgctataaagctcaaattagttaggaatgacttatacgttttgttttgaatacctaagagatactttttggatatttatattgccatattcttacttgaatgctttgaatgactacatccagttctgcacctataccctctggtgttgctttttaaccttcctggaatccattttctaaaaaataaagacattttcagatctgagagctacatctcaatgtctgtggttataattctggacaggataaatagctaaacttaatgtaggcaaatgcagagacatttatctgaaatgtagacctctacactgagacttttctggcatagtggctaaaacaagatctacacatgcataaaaagggacaatcaccttttcttcataaatatacagctttaggaatatttcaccattctttgtaggacatagtagtccttgtctttttttctcctgacattggaaagatgtgctaattgaaacttgacttagtaggaacattgtgccaactcaaaaccttgatttagtaaaaatctcaatgtttagatcctttgtccagtggtggtgtttatcagggaatgtattcagcttgctcagaaaaccaaaagggtattaaagccacaaaagcaaagaagaaaaaaaaaaacttcccatgtttggatcttgttctagttagaaaaattaagttgaaattcttggactttttcattcatgaggcaaatgctgtaataccttcccctttgacaggtttggattcttaacattactagtggtatttcaggaagtgacgttacagttactttccttatagcggctaagtgtattaagttgaatgtaacgatggtaatattaatttgtttgaactgaggcccactactgattctttgacaaattgaattcttatatttaaataattttatgggaatgttccatcataatttctaaatcatttatatatcaaggtagccttaatttgtatatgtttcagtacaatgagattttattgcctctgggatgctgtttagtttgtattttgttgaacgtttttatcctaggaagagaaacctatgacttgtgtacctagatcatctgttacattaaaaagctgctctttcagcattagagctataaatgaatgttaccttgtcgggaaacaatctaggttttagctgtatgagctatgtttattatggtgctaatgttcagtagccacatttgactaatgtctccattctctgtgatgctgtggctagcagcagagctcgccagttcatgcctggacatactgtcagggctgggccctccagctagctcctttggggttgagtccgtatctttttgatgtggaagtataaagcaagtatcttgatttctaaacccagcaattttagaattgacctttatgagtgaagacttttggagcttttaaagaccttggcagtcatgatctcaaaccaattaggagctccaagctcccttcccaggtaactgttgggagcaatggcatcactgtatgcccttgtaatggctggaagggacatgatcttgtaagtaggaaagctgtaactaaaaattgtattgtttgcttattagccatgtatctcttaaaattttgttatgtttacaacgatgtaccttattggcaacaagttattagtttgatgtttaacaatagtgcctttagtaaattattttacaactaaaaaaaattgttttttg

SEQ ID NO: 75889 - DNA, 2643 bp, Homo sapiens
agagcagcttccggcgtggctggtgtaggcgggtggagaaggatcggggccctcgccgctctgtctcattccctcgcgctctctcgggcaacatggcgggtgtggaggaggtagcggcctccgggagccacctgaatggcgacctggatccagacgacagggaagaaggagctgcctctacggctgaggaagcagccaagaaaaaaagacgaaagaagaagaagagcaaagggccttctgcagcaggggaacaggaacctgataaagaatcaggagcctcagtggatgaagtagcaagacagttggaaagatcagcattggaagataaagaaagagatgaagatgatgaagatggagatggcgatggagatggagcaactggaaagaagaagaaaaagaagaagaagaagagaggaccaaaagttcaaacagaccctccctcagttccaatatgtgacctgtatcctaatggtgtatttcccaaaggacaagaatgcgaatacccacccacacaagatgggcgaacagctgcttggagaactacaagtgaagaaaagaaagcattagatcaggcaagtgaagagatttggaatgattttcgagaagctgcagaagcacatcgacaagttagaaaatacgtaatgagctggatcaagcctgggatgacaatgatagaaatctgtgaaaagttggaagactgttcacgcaagttaataaaagagaatggattaaatgcaggcctggcatttcctactggatgttctctcaataattgtgctgcccattatactcccaatgccggtgacacaacagtattacagtatgatgacatctgtaaaatagactttggaacacatataagtggtaggattattgactgtgcttttactgtcacttttaatcccaaatatgatacgttattaaaagctgtaaaagatgctactaacactggaataaagtgtgctggaattgatgttcgtctgtgtgatgttggtgaggccatccaagaagttatggagtcctatgaagttgaaatagatgggaagacatatcaagtgaaaccaatccgtaatctaaatggacattcaattgggcaatatagaatacatgctggaaaaacagtgccgattgtgaaaggaggggaggcaacaagaatggaggaaggagaagtatatgcaattgaaacctttggtagtacaggaaaaggtgttgttcatgatgatatggaatgttcacattacatgaaaaattttgatgttggacatgtgccaataaggcttccaagaacaaaacacttgttaaatgtcatcaatgaaaactttggaacccttgccttctgccgcagatggctggatcgcttgggagaaagtaaatacttgatggctctgaagaatctgtgtgacttgggcattgtagatccatatccaccattatgtgacattaaaggatcatatacagcgcaatttgaacataccatcctgttgcgtccaacatgtaaagaagttgtcagcagaggagatgactattaaacttagtccaaagccacctcaacacctttattttctgagctttgttggaaaacatgataccagaattaatttgccacatgttgtctgttttaacagtggacccatgtaatacttttatccatgtttaaaaaagaaggaatttggacaaaggcaaaccgtctaatgtaattaaccaacgaaaaagctttccggacttttaaatgctaactgtttttccccttcctgtctaggaaaatgctataaagctcaaattagttaggaatgacttatacgttttgttttgaatacctaagagatactttttggatatttatattgccatattcttacttgaatgctttgaatgactacatccagttctgcacctataccctctggtgttgctttttaaccttcctggaatccattttctaaaaaataaagacattttcattcttctcagcaccacacaacacctattccaaaatcgaccacatatttggaagtaaagctctcctcagcaaatgtaaaagaacagaaattataacaaactgtctctcagaccacagtataaccaaactagaactcaggattaagaaactcactcaaaaccacacaactacatggaaactgaacaacctgctcctgaatgactactggatacataacaaaatgaaggcagaaataaagatgttctttaaaaccaatgagaacaaagacacaacataccagaatctctgggacacattcaaagcagtgtgtagagggaaatttatagcactaaatgcccacaagagaaagcaggaaatatctaaaattgacaccctaacatcacaattaaaagaactagagaagcaagagcaaacacattgaaaagctaagagaaggcaagaaataactaagatcagagcagaactgaaggaaatagagacacaaaaaactcttcaaaaaatcaatgaatccaggagctggttttttgaaacgatcaacaaaattgatagacactagcaagactaataaagaagaaaggagagaagaatcaaatagaagcaataaaaaatgataaaggggatatcaccaccaatcccacagaaataaaccaccatcagagaatactacaaacacctctacgcaa

SEQ ID NO: 75890 - DNA, 2972 bp, Homo sapiens
gatccctgatgtttaggacatagactgttctgcccactcccatacccccaagctgtgtgcgtgttgctccaggaacacgagccaaccatgagtttatggaacggtatgtagcagtgctgctactgtgctgagagctaaaatggatggaaataaccacacttgaccatcccattattcccctggaagttgcaaggcttcagtagactccagagttcccaagtacttacattagacagattttgtcagtgcacttgttgtctatttagggaggcagattcctggtgcttaatacttcactatcctcccataatcctctgcaaagtattttaaacaggaagttacaatgtacaaagcagtttttctgattgtcccttgtttttaaatgttacaaaattaagttgctatgaaaattttgcactttgaataataaagcatatgttactctttttttagtgtgctggaattgatgttcgtctgtgtgatgttggtgaggccatccaagaagttatggagtcctatgaagttgaaatagatgggaagacatatcaagtgaaaccaatccgtaatctaaatggacattcaattgggcaatatagaatacatgctggaaaaacagtgccgattgtgaaaggaggggaggcaacaagaatggaggaaggagaagtatatgcaattgaaacctttggtagtacaggaaaaggtgttgttcatgatgatatggaatgttcacattacatgaaaaattttgatgttggacatgtgccaataaggcttccaagaacaaaacacttgttaaatgtcatcaatgaaaactttggaacccttgccttctgccgcagatggctggatcgcttgggagaaagtaaatacttgatggctctgaagaatctgtgtgacttgggcattgtagatccatatccaccattatgtgacattaaaggatcatatacagcgcaatttgaacataccatcctgttgcgtccaacatgtaaagaagttgtcagcagaggagatgactattaaacttagtccaaagccacctcaacacctttattttctgagctttgttggaaaacatgataccagaattaatttgccacatgttgtctgttttaacagtggacccatgtaatacttttatccatgtttaaaaaagaaggaatttggacaaaggcaaaccgtctaatgtaattaaccaacgaaaaagctttccggacttttaaatgctaactgtttttccccttcctgtctaggaaaatgctataaagctcaaattagttaggaatgacttatacgttttgttttgaatacctaagagatactttttggatatttatattgccatattcttacttgaatgctttgaatgactacatccagttctgcacctataccctctggtgttgctttttaaccttcctggaatccattttctaaaaaataaagacattttcagatctgagagctacatctcaatgtctgtggttataattctggacaggataaatagctaaacttaatgtaggcaaatgcagagacatttatctgaaatgtagacctctacactgagacttttctggcatagtggctaaaacaagatctacacatgcataaaaagggacaatcaccttttcttcataaatatacagctttaggaatatttcaccattctttgtaggacatagtagtccttgtctttttttctcctgacattggaaagatgtgctaattgaaacttgacttagtaggaacattgtgccaactcaaaaccttgatttagtaaaaatctcaatgtttagatcctttgtccagtggtggtgtttatcagggaatgtattcagcttgctcagaaaaccaaaagggtattaaagccacaaaagcaaagaagaaaaaaaaaaacttcccatgtttggatcttgttctagttagaaaaattaagttgaaattcttggactttttcattcatgaggcaaatgctgtaataccttcccctttgacaggtttggattcttaacattactagtggtatttcaggaagtgacgttacagttactttccttatagcggctaagtgtattaagttgaatgtaacgatggtaatattaatttgtttgaactgaggcccactactgattctttgacaaattgaattcttatatttaaataattttatgggaatgttccatcataatttctaaatcatttatatatcaaggtagccttaatttgtatatgtttcagtacaatgagattttattgcctctgggatgctgtttagtttgtattttgttgaacgtttttatcctaggaagagaaacctatgacttgtgtacctagatcatctgttacattaaaaagctgctctttcagcattagagctataaatgaatgttaccttgtcgggaaacaatctaggttttagctgtatgagctatgtttattatggtgctaatgttcagtagccacatttgactaatgtctccattctctgtgatgctgtggctagcagcagagctcgccagttcatgcctggacatactgtcagggctgggccctccagctagctcctttggggttgagtccgtatctttttgatgtggaagtataaagcaagtatcttgatttctaaacccagcaattttagaattgacctttatgagtgaagacttttggagcttttaaagaccttggcagtcatgatctcaaaccaattaggagctccaagctcccttcccaggtaactgttgggagcaatggcatcactgtatgcccttgtaatggctggaagggacatgatcttgtaagtaggaaagctgtaactaaaaattgtattgtttgcttattagccatgtatctcttaaaattttgttatgtttacaacgatgtaccttattggcaacaagttattagtttgatgtttaacaatagtgcctttagtaaattattttacaactaaaaaaaattgttttttg

SEQ ID NO: 75891 - DNA, 2182 bp, Homo sapiens
agagcagcttccggcgtggctggtgtaggcgggtggagaaggatcggggccctcgccgctctgtctcattccctcgcgctctctcgggcaacatggcgggtgtggaggaggtagcggcctccgggagccacctgaatggcgacctggatccagacgacagggaagaaggagctgcctctacggctgaggaagcagccaagaaaaaaagacgaaagaagaagaagagcaaagggccttctgcagcaggggaacaggaacctgataaagaatcaggagcctcagtggatgaagtagcaagacagttggaaagatcagcattggaagataaagaaagagatgaagatgatgaagatggagatggcgatggagatggagcaactggaaagaagaagaaaaagaagaagaagaagagaggaccaaaagttcaaacagaccctccctcagttccaatatgtgacctgtatcctaatggtgtatttcccaaaggacaagaatgcgaatacccacccacacaagatgggcgaacagctgcttggagaactacaagtgaagaaaagaaagcattagatcaggcaagtgaagagatttggaatgattttcgagaagctgcagaagcacatcgacaagttagaaaatacgtaatgagctggatcaagcctgggatgacaatgatagaaatctgtgaaaagttggaagactgttcacgcaagttaataaaagagaatggattaaatgcaggcctggcatttcctactggatgttctctcaataattgtgctgcccattatactcccaatgccggtgacacaacagtattacagtatgatgacatctgtaaaatagactttggaacacatataagtggtaggattattgactgtgcttttactgtcacttttaatcccaaatatgatacgttattaaaagctgtaaaagatgctactaacactggaataaagtgtgctggaattgatgttcgtctgtgtgatgttggtgaggccatccaagaagttatggagtcctatgaagttgaaatagatgggaagacatatcaagtgaaaccaatccgtaatctaaatggacattcaattgggcaatatagaatacatgctggaaaaacagtgccgattgtgaaaggaggggaggcaacaagaatggaggaaggagaagtatatgcaattgaaacctttggtagtacaggaaaaggtgttgttcatgatgatatggaatgttcacattacatgaaaaattttgatgttggacatgtgccaataaggcttccaagaacaaaacacttgttaaatgtcatcaatgaaaactttggaacccttgccttctgccgcagatggctggatcgcttgggagaaagtaaatacttgatggctctgaagaatctgtgtgacttgggcattgtagatccatatccaccattatgtgacattaaaggatcatatacagcgcaatttgaacataccatcctgttgcgtccaacatgtaaagaagttgtcagcagaggagatgactattaaacttagtccaaagccacctcaacacctttattttctgagctttgttggaaaacatgataccagaattaatttgccacatgttgtctgttttaacagtggacccatgtaatacttttatccatgtttaaaaaagaaggaatttggacaaaggcaaaccgtctaatgtaattaaccaacgaaaaagctttccggacttttaaatgctaactgtttttccccttcctgtctaggaaaatgctataaagctcaaattagttaggaatgacttatacgttttgttttgaatacctaagagatactttttggatatttatattgccatattcttacttgaatgctttgaatgactacatccagttctgcacctataccctctggtgttgctttttaaccttcctggaatccattttctaaaaaataaagacattttaaaaaaaaaaaaaaaaaaaaaaaaaaaaaaaaaaaataaaaaaaaaaaaaaaaaaaaaaaaaaaaaataaaaaaaaaaaaaaaaaaaacataaatgtcaattttttcatttcatattattaattttatcattatttttcttactctaatcgttcctaactcttcaactttataaattttcatctcatttatttatctcacattttttctctttttctattcct

SEQ ID NO: 75892 - DNA, 2001 bp, Homo sapiens
  misc_feature (1971)..(1971): n is a, c, g, or t
agagcagcttccggcgtggctggtgtaggcgggtggagaaggatcggggccctcgccgctctgtctcattccctcgcgctctctcgggcaacatggcgggtgtggaggaggtagcggcctccgggagccacctgaatggcgacctggatccagacgacagggaagaaggagctgcctctacggctgaggaagcagccaagaaaaaaagacgaaagaagaagaagagcaaagggccttctgcagcaggggaacaggaacctgataaagaatcaggagcctcagtggatgaagtagcaagacagttggaaagatcagcattggaagataaagaaagagatgaagatgatgaagatggagatggcgatggagatggagcaactggaaagaagaagaaaaagaagaagaagaagagaggaccaaaagttcaaacagaccctccctcagttccaatatgtgacctgtatcctaatggtgtatttcccaaaggacaagaatgcgaatacccacccacacaagatgggcgaacagctgcttggagaactacaagtgaagaaaagaaagcattagatcaggcaagtgaagagatttggaatgattttcgagaagctgcagaagcacatcgacaagttagaaaatacgtaatgagctggatcaagcctgggatgacaatgatagaaatctgtgaaaagttggaagactgttcacgcaagttaataaaagagaatggattaaatgcaggcctggcatttcctactggatgttctctcaataattgtgctgcccattatactcccaatgccggtgacacaacagtattacagtatgatgacatctgtaaaatagactttggaacacatataagtggtaggattattgactgtgcttttactgtcacttttaatcccaaatatgatacgttattaaaagctgtaaaagatgctactaacactggaataaagtgtgctggaattgatgttcgtctgtgtgatgttggtgaggccatccaagaagttatggagtcctatgaagttgaaatagatgggaagacatatcaagtgaaaccaatccgtaatctaaatggacattcaattgggcaatatagaatacatgctggaaaaacagtgccgattgtgaaaggaggggaggcaacaagaatggaggaaggagaagtatatgcaattgaaacctttggtagtacaggaaaaggtgttgttcatgatgatatggaatgttcacattacatgaaaaattttgatgttggacatgtgccaataaggcttccaagaacaaaacacttgttaaatgtcatcaatgaaaactttggaacccttgccttctgccgcagatggctggatcgcttgggagaaagtaaatacttgatggctctgaagaatctgtgtgacttgggcattgtagatccatatccaccattatgtgacattaaaggatcatatacagcgcaatttgaacataccatcctgttgcgtccaacatgtaaagaagttgtcagcagaggagatgactattaaacttagtccaaagccacctcaacacctttattttctgagctttgttggaaaacatgataccagaattaatttgccacatgttgtctgttttaacagtggacccatgtaatacttttatccatgtttaaaaaagaaggaatttggacaaaggcaaaccgtctaatgtaattaaccaacgaaaaagctttccggacttttaaatgctaactgtttttccccttcctgtctaggaaaatgctataaagctcaaattagttaggaatgacttatacgttttgttttgaatacctaagagatactttttggatatttatattgccatattcttacttgaatgctttgaatgactacatccagttctgcacctataccctctggtgttgctttttaaccttcctggaatccattttctaaaaaataaagacattttgatgcggccaancttttttttttgtatctgactccgcctcgc

SEQ ID NO: 75893 - DNA, 2085 bp, Homo sapiens
agagcagcttccggcgtggctggtgtaggcgggtggagaaggatcggggccctcgccgctctgtctcattccctcgcgctctctcgggcaacatggcgggtgtggaggaggtagcggcctccgggagccacctgaatggcgacctggatccagacgacagggaagaaggagctgcctctacggctgaggaagcagccaagaaaaaaagacgaaagaagaagaagagcaaagggccttctgcagcaggggaacaggaacctgataaagaatcaggagcctcagtggatgaagtagcaagacagttggaaagatcagcattggaagataaagaaagagatgaagatgatgaagatggagatggcgatggagatggagcaactggaaagaagaagaaaaagaagaagaagaagagaggaccaaaagttcaaacagaccctccctcagttccaatatgtgacctgtatcctaatggtgtatttcccaaaggacaagaatgcgaatacccacccacacaagatgggcgaacagctgcttggagaactacaagtgaagaaaagaaagcattagatcaggcaagtgaagagatttggaatgattttcgagaagctgcagaagcacatcgacaagttagaaaatacgtaatgagctggatcaagcctgggatgacaatgatagaaatctgtgaaaagttggaagactgttcacgcaagttaataaaagagaatggattaaatgcaggcctggcatttcctactggatgttctctcaataattgtgctgcccattatactcccaatgccggtgacacaacagtattacagtatgatgacatctgtaaaatagactttggaacacatataagtggtaggattattgactgtgcttttactgtcacttttaatcccaaatatgatacgttattaaaagctgtaaaagatgctactaacactggaataaagtgtgctggaattgatgttcgtctgtgtgatgttggtgaggccatccaagaagttatggagtcctatgaagttgaaatagatgggaagacatatcaagtgaaaccaatccgtaatctaaatggacattcaattgggcaatatagaatacatgctggaaaaacagtgccgattgtgaaaggaggggaggcaacaagaatggaggaaggagaagtatatgcaattgaaacctttggtagtacaggaaaaggtgttgttcatgatgatatggaatgttcacattacatgaaaaattttgatgttggacatgtgccaataaggcttccaagaacaaaacacttgttaaatgtcatcaatgaaaactttggaacccttgccttctgccgcagatggctggatcgcttgggagaaagtaaatacttgatggctctgaagaatctgtgtgacttgggcattgtagatccatatccaccattatgtgacattaaaggatcatatacagcgcaatttgaacataccatcctgttgcgtccaacatgtaaagaagttgtcagcagaggagatgactattaaacttagtccaaagccacctcaacacctttattttctgagctttgttggaaaacatgataccagaattaatttgccacatgttgtctgttttaacagtggacccatgtaatacttttatccatgtttaaaaaagaaggaatttggacaaaggcaaaccgtctaatgtaattaaccaacgaaaaagctttccggacttttaaatgctaactgtttttccccttcctgtctaggaaaatgctataaagctcaaattagttaggaatgacttatacgttttgttttgaatacctaagagatactttttggatatttatattgccatattcttacttgaatgctttgaatgactacatccagttctgcacctataccctctggtgtggtttacttctggatcattttaaaaaaaaaggggggctaagtacccagggcaataaggtacgtttgtaaagggctaagggggaaaaaagaggggggaagggggaagaagggtgaggaaccggggaatggaccacaagcgaaattggtgtgtgtataataacaagataataaataa

SEQ ID NO: 75894 - DNA, 1952 bp, Homo sapiens
agagcagcttccggcgtggctggtgtaggcgggtggagaaggatcggggccctcgccgctctgtctcattccctcgcgctctctcgggcaacatggcgggtgtggaggaggtagcggcctccgggagccacctgaatggcgacctggatccagacgacagggaagaaggagctgcctctacggctgaggaagcagccaagaaaaaaagacgaaagaagaagaagagcaaagggccttctgcagcaggggaacaggaacctgataaagaatcaggagcctcagtggatgaagtagcaagacagttggaaagatcagcattggaagataaagaaagagatgaagatgatgaagatggagatggcgatggagatggagcaactggaaagaagaagaaaaagaagaagaagaagagaggaccaaaagttcaaacagaccctccctcagttccaatatgtgacctgtatcctaatggtgtatttcccaaaggacaagaatgcgaatacccacccacacaagatgggcgaacagctgcttggagaactacaagtgaagaaaagaaagcattagatcaggcaagtgaagagatttggaatgattttcgagaagctgcagaagcacatcgacaagttagaaaatacgtaatgagctggatcaagcctgggatgacaatgatagaaatctgtgaaaagttggaagactgttcacgcaagttaataaaagagaatggattaaatgcaggcctggcatttcctactggatgttctctcaataattgtgctgcccattatactcccaatgccggtgacacaacagtattacagtatgatgacatctgtaaaatagactttggaacacatataagtggtaggattattgactgtgcttttactgtcacttttaatcccaaatatgatacgttattaaaagctgtaaaagatgctactaacactggaataaagtgtgctggaattgatgttcgtctgtgtgatgttggtgaggccatccaagaagttatggagtcctatgaagttgaaatagatgggaagacatatcaagtgaaaccaatccgtaatctaaatggacattcaattgggcaatatagaatacatgctggaaaaacagtgccgattgtgaaaggaggggaggcaacaagaatggaggaaggagaagtatatgcaattgaaacctttggtagtacaggaaaaggtgttgttcatgatgatatggaatgttcacattacatgaaaaattttgatgttggacatgtgccaataaggcttccaagaacaaaacacttgttaaatgtcatcaatgaaaactttggaacccttgccttctgccgcagatggctggatcgcttgggagaaagtaaatacttgatggctctgaagaatctgtgtgacttgggcattgtagatccatatccaccattatgtgacattaaaggatcatatacagcgcaatttgaacataccatcctgttgcgtccaacatgtaaagaagttgtcagcagaggagatgactattaaacttagtccaaagccacctcaacacctttattttctgagctttgttggaaaacatgataccagaattaatttgccacatgttgtctgttttaacagtggacccatgtaatacttttatccatgtttaaaaaagaaggaatttggacaaaggcaaaccgtctaatgtaattaaccaacgaaaaagctttccggacttttaaatgctaactgtttttccccttcctgtctaggaaaatgctataaagctcaaattagttaggaatgacttatacgttttgttttgaatacctaagagatactttttggatatttatattgccatattcttacttgaatgctttgaatgactacatccagttctgcacctataccctctggtgttgctttttaaccttcctggaaatactggacgggatcctctgg

SEQ ID NO: 75895 - DNA, 1721 bp, Homo sapiens
agagcagcttccggcgtggctggtgtaggcgggtggagaaggatcggggccctcgccgctctgtctcattccctcgcgctctctcgggcaacatggcgggtgtggaggaggtagcggcctccgggagccacctgaatggcgacctggatccagacgacagggaagaaggagctgcctctacggctgaggaagcagccaagaaaaaaagacgaaagaagaagaagagcaaagggccttctgcagcaggggaacaggaacctgataaagaatcaggagcctcagtggatgaagtagcaagacagttggaaagatcagcattggaagataaagaaagagatgaagatgatgaagatggagatggcgatggagatggagcaactggaaagaagaagaaaaagaagaagaagaagagaggaccaaaagttcaaacagaccctccctcagttccaatatgtgacctgtatcctaatggtgtatttcccaaaggacaagaatgcgaatacccacccacacaagatgggcgaacagctgcttggagaactacaagtgaagaaaagaaagcattagatcaggcaagtgaagagatttggaatgattttcgagaagctgcagaagcacatcgacaagttagaaaatacgtaatgagctggatcaagcctgggatgacaatgatagaaatctgtgaaaagttggaagactgttcacgcaagttaataaaagagaatggattaaatgcaggcctggcatttcctactggatgttctctcaataattgtgctgcccattatactcccaatgccggtgacacaacagtattacagtatgatgacatctgtaaaatagactttggaacacatataagtggtaggattattgactgtgcttttactgtcacttttaatcccaaatatgatacgttattaaaagctgtaaaagatgctactaacactggaataaagtgtgctggaattgatgttcgtctgtgtgatgttggtgaggccatccaagaagttatggagtcctatgaagttgaaatagatgggaagacatatcaagtgaaaccaatccgtaatctaaatggacattcaattgggcaatatagaatacatgctggaaaaacagtgccgattgtgaaaggaggggaggcaacaagaatggaggaaggagaagtatatgcaattgaaacctttggtagtacaggaaaaggtgttgttcatgatgatatggaatgttcacattacatgaaaaattttgatgttggacatgtgccaataaggcttccaagaacaaaacacttgttaaatgtcatcaatgaaaactttggaacccttgccttctgccgcagatggctggatcgcttgggagaaagtaaatacttgatggctctgaagaatctgtgtgacttgggcattgtagatccatatccaccattatgtgacattaaaggatcatatacagcgcaatttgaacataccatcctgttgcgtccaacatgtaaagaagttgtcagcagaggagatgactattaaacttagtccaaagccacctcaacacctttattttctgagctttgttggaaaacatgataccagaattaatttgccacatgttgtctgttttaacagtggacccatgtaatacttttatccatgtttaaaaaagaacgatgcggccggttcacgtatattttcatattttttttatttgaatatgatattata

SEQ ID NO: 75896 - DNA, 1648 bp, Homo sapiens
  misc_feature (1538)..(1538): n is a, c, g, or t
  misc_feature (1577)..(1577): n is a, c, g, or t
agagcagcttccggcgtggctggtgtaggcgggtggagaaggatcggggccctcgccgctctgtctcattccctcgcgctctctcgggcaacatggcgggtgtggaggaggtagcggcctccgggagccacctgaatggcgacctggatccagacgacagggaagaaggagctgcctctacggctgaggaagcagccaagaaaaaaagacgaaagaagaagaagagcaaagggccttctgcagcaggggaacaggaacctgataaagaatcaggagcctcagtggatgaagtagcaagacagttggaaagatcagcattggaagataaagaaagagatgaagatgatgaagatggagatggcgatggagatggagcaactggaaagaagaagaaaaagaagaagaagaagagaggaccaaaagttcaaacagaccctccctcagttccaatatgtgacctgtatcctaatggtgtatttcccaaaggacaagaatgcgaatacccacccacacaagatgggcgaacagctgcttggagaactacaagtgaagaaaagaaagcattagatcaggcaagtgaagagatttggaatgattttcgagaagctgcagaagcacatcgacaagttagaaaatacgtaatgagctggatcaagcctgggatgacaatgatagaaatctgtgaaaagttggaagactgttcacgcaagttaataaaagagaatggattaaatgcaggcctggcatttcctactggatgttctctcaataattgtgctgcccattatactcccaatgccggtgacacaacagtattacagtatgatgacatctgtaaaatagactttggaacacatataagtggtaggattattgactgtgcttttactgtcacttttaatcccaaatatgatacgttattaaaagctgtaaaagatgctactaacactggaataaagtgtgctggaattgatgttcgtctgtgtgatgttggtgaggccatccaagaagttatggagtcctatgaagttgaaatagatgggaagacatatcaagtgaaaccaatccgtaatctaaatggacattcaattgggcaatatagaatacatgctggaaaaacagtgccgattgtgaaaggaggggaggcaacaagaatggaggaaggagaagtatatgcaattgaaacctttggtagtacaggaaaaggtgttgttcatgatgatatggaatgttcacattacatgaaaaattttgatgttggacatgtgccaataaggcttccaagaacaaaacacttgttaaatgtcatcaatgaaaactttggaacccttgccttctgccgcagatggctggatcgcttgggagaaagtaaatacttgatggctctgaagaatctgtgtgacttgggcattgtagatccatatccaccattatgtgacattaaaggatcatatacagcgcaatttgaacataccatcctgttgcgtccaacatgtaaagaagttgtcagccccccccgacactgccctccccccatnacttagtttccataagtcccaccctcaaacacccctttnacttttctggaggcttttgtttgggaaaaaaacatggatacccaggatattaaatttccccccaccccgcc

SEQ ID NO: 75897 - DNA, 1979 bp, Homo sapiens
ggatcccccgggctgcaggattcggcacgagcttagtccaaagccacctcaacacctttattttctgagctttgttggaaaacatgataccagaattaatttgccacatgttgtctgttttaacagtggacccatgtaatacttttatccatgtttaaaaaagaaggaatttggacaaaggcaaaccgtctaatgtaattaaccaacgaaaaagctttccggacttttaaatgctaactgtttttccccttcctgtctaggaaaatgctataaagctcaaattagttaggaatgacttatacgttttgttttgaatacctaagagatactttttggatatttatattgccatattcttacttgaatgctttgaatgactacatccagttctgcacctataccctctggtgttgctttttaaccttcctggaatccattttctaaaaaataaagacattttcagatctgagagctacatctcaatgtctgtggttataattctggacaggataaatagctaaacttaatgtaggcaaatgcagagacatttatctgaaatgtagacctctacactgagacttttctggcatagtggctaaaacaagatctacacatgcataaaaagggacaatcaccttttcttcataaatatacagctttaggaatatttcaccattctttgtaggacatagtagtccttgtctttttttctcctgacattggaaagatgtgctaattgaaacttgacttagtaggaacattgtgccaactcaaaaccttgatttagtaaaaatctcaatgtttagatcctttgtccagtggtggtgtttatcagggaatgtattcagcttgctcagaaaaccaaaagggtattaaagccacaaaagcaaagaagaaaaaaaaaaacttcccatgtttggatcttgttctagttagaaaaattaagttgaaattcttggactttttcattcatgaggcaaatgctgtaataccttcccctttgacaggtttggattcttaacattactagtggtatttcaggaagtgacgttacagttactttccttatagcggctaagtgtattaagttgaatgtaacgatggtaatattaatttgtttgaactgaggcccactactgattctttgacaaattgaattcttatatttaaataattttatgggaatgttccatcataatttctaaatcatttatatatcaaggtagccttaatttgtatatgtttcagtacaatgagattttattgcctctgggatgctgtttagtttgtattttgttgaacgtttttatcctaggaagagaaacctatgacttgtgtacctagatcatctgttacattaaaaagctgctctttcagcattagagctataaatgaatgttaccttgtcgggaaacaatctaggttttagctgtatgagctatgtttattatggtgctaatgttcagtagccacatttgactaatgtctccattctctgtgatgctgtggctagcagcagagctcgccagttcatgcctggacatactgtcagggctgggccctccagctagctcctttggggttgagtccgtatctttttgatgtggaagtataaagcaagtatcttgatttctaaacccagcaattttagaattgacctttatgagtgaagacttttggagcttttaaagaccttggcagtcatgatctcaaaccaattaggagctccaagctcccttcccaggtaactgttgggagcaatggcatcactgtatgcccttgtaatggctggaagggacatgatcttgtaagtaggaaagctgtaactaaaaattgtattgtttgcttattagccatgtatctcttaaaattttgttatgtttacaacgatgtaccttattggcaacaagttattagtttgatgtttaacaatagtgcctttagtaaattattttacaactaaaaaaaattgttttttg

SEQ ID NO: 75898 - DNA, 1084 bp, Homo sapiens
agagcagcttccggcgtggctggtgtaggcgggtggagaaggatcggggccctcgccgctctgtctcattccctcgcgctctctcgggcaacatggcgggtgtggaggaggtagcggcctccgggagccacctgaatggcgacctggatccagacgacagggaagaaggagctgcctctacggctgaggaagcagccaagaaaaaaagacgaaagaagaagaagagcaaagggccttctgcagcaggggaacaggaacctgataaagaatcaggagcctcagtggatgaagtagcaagacagttggaaagatcagcattggaagataaagaaagagatgaagatgatgaagatggagatggcgatggagatggagcaactggaaagaagaagaaaaagaagaagaagaagagaggaccaaaagttcaaacagaccctccctcagttccaatatgtgacctgtatcctaatggtgtatttcccaaaggacaagaatgcgaatacccacccacacaagatgggcgaacagctgcttggagaactacaagtgaagaaaagaaagcattagatcaggcaagtgaagagatttggaatgattttcgagaagctgcagaagcacatcgacaagttagaaaatacgtaatgagctggatcaagcctgggatgacaatgatagaaatctgtgaaaagttggaagactgttcacgcaagttaataaaagagaatggattaaatgcaggcctggcatttcctactggatgttctctcaataattgtgctgcccattatactcccaatgccggtgacacaacagtattacagtatgatgacatctgtaaaatagactttggaacacatataagtggtaggattattgactgtgcttttactgtcacttttaatcccaaatatgatacgttattaaaagctgtaaaagatgctactaacactggaataaagtgtgctggaattgatgttcgtctgtgtgatgttggtgaggccatccaagaagttatggagtcctatgaagttgaaatagatgggaagacatatcaagtgaaacctatgacctatatgggaccgcc

SEQ ID NO: 75899 - DNA, 1775 bp, Homo sapiens
ctataagtcattcctaactaatttgagctttatagcattttcctagacaggaaggggaaaatgctataaagctcaaattagttaggaatgacttatacgttttgttttgaatacctaagagatactttttggatatttatattgccatattcttacttgaatgctttgaatgactacatccagttctgcacctataccctctggtgttgctttttaaccttcctggaatccattttctaaaaaataaagacattttcagatctgagagctacatctcaatgtctgtggttataattctggacaggataaatagctaaacttaatgtaggcaaatgcagagacatttatctgaaatgtagacctctacactgagacttttctggcatagtggctaaaacaagatctacacatgcataaaaagggacaatcaccttttcttcataaatatacagctttaggaatatttcaccattctttgtaggacatagtagtccttgtctttttttctcctgacattggaaagatgtgctaattgaaacttgacttagtaggaacattgtgccaactcaaaaccttgatttagtaaaaatctcaatgtttagatcctttgtccagtggtggtgtttatcagggaatgtattcagcttgctcagaaaaccaaaagggtattaaagccacaaaagcaaagaagaaaaaaaaaaacttcccatgtttggatcttgttctagttagaaaaattaagttgaaattcttggactttttcattcatgaggcaaatgctgtaataccttcccctttgacaggtttggattcttaacattactagtggtatttcaggaagtgacgttacagttactttccttatagcggctaagtgtattaagttgaatgtaacgatggtaatattaatttgtttgaactgaggcccactactgattctttgacaaattgaattcttatatttaaataattttatgggaatgttccatcataatttctaaatcatttatatatcaaggtagccttaatttgtatatgtttcagtacaatgagattttattgcctctgggatgctgtttagtttgtattttgttgaacgtttttatcctaggaagagaaacctatgacttgtgtacctagatcatctgttacattaaaaagctgctctttcagcattagagctataaatgaatgttaccttgtcgggaaacaatctaggttttagctgtatgagctatgtttattatggtgctaatgttcagtagccacatttgactaatgtctccattctctgtgatgctgtggctagcagcagagctcgccagttcatgcctggacatactgtcagggctgggccctccagctagctcctttggggttgagtccgtatctttttgatgtggaagtataaagcaagtatcttgatttctaaacccagcaattttagaattgacctttatgagtgaagacttttggagcttttaaagaccttggcagtcatgatctcaaaccaattaggagctccaagctcccttcccaggtaactgttgggagcaatggcatcactgtatgcccttgtaatggctggaagggacatgatcttgtaagtaggaaagctgtaactaaaaattgtattgtttgcttattagccatgtatctcttaaaattttgttatgtttacaacgatgtaccttattggcaacaagttattagtttgatgtttaacaatagtgcctttagtaaattattttacaactaaaaaaaattgttttttg

SEQ ID NO: 75900 - DNA, 950 bp, Homo sapiens
ggacgcgtgggtcgacccacgcgtcgcggacgcgtgggtccggacgcgtgtgtattaagttgaatgtaacgatggtaatattaatttgtttgaactgaggcccactactgattctttgacaaattgaattcttatatttaaataattttatgggaatgttccatcataatttctaaatcatttatatatcaaggtagccttaatttgtatatgtttcagtacaatgagattttattgcctctgggatgctgtttagtttgtattttgttgaacgtttttatcctaggaagagaaacctatgacttgtgtacctagatcatctgttacattaaaaagctgctctttcagcattagagctataaatgaatgttaccttgtcgggaaacaatctaggttttagctgtatgagctatgtttattatggtgctaatgttcagtagccacatttgactaatgtctccattctctgtgatgctgtggctagcagcagagctcgccagttcatgcctggacatactgtcagggctgggccctccagctagctcctttggggttgagtccgtatctttttgatgtggaagtataaagcaagtatcttgatttctaaacccagcaattttagaattgacctttatgagtgaagacttttggagcttttaaagaccttggcagtcatgatctcaaaccaattaggagctccaagctcccttcccaggtaactgttgggagcaatggcatcactgtatgcccttgtaatggctggaagggacatgatcttgtaagtaggaaagctgtaactaaaaattgtattgtttgcttattagccatgtatctcttaaaattttgttatgtttacaacgatgtaccttattggcaacaagttattagtttgatgtttaacaatagtgcctttagtaaattattttacaactaaaaaaaattgttttttg

SEQ ID NO: 75901 - DNA, 613 bp, Homo sapiens
agagcagcttccggcgtggctggtgtaggcgggtggagaaggatcggggccctcgccgctctgtctcattccctcgcgctctctcgggcaacatggcgggtgtggaggaggtagcggcctccgggagccacctgaatggcgacctggatccagacgacagggaagaaggagctgcctctacggctgaggaagcagccaagaaaaaaagacgaaagaagaagaagagcaaagggccttctgcagcaggggaacaggaacctgataaagaatcaggagcctcagtggatgaagtagcaagacagttggaaagatcagcattggaagataaagaaagagatgaagatgatgaagatggagatggcgatggagatggagcaactggaaagaagaagaaaaagaagaagaagaagagaggacgttagtgtcttaagttaatgttaattgatatattagaagtgtttattctgtcgggtgtggtggctcacacctgtgatcccagctactccggaggctgaggcaggagaattgctggaacccaagagacggagattgcagtaagctgagattgtgccactgcactgcagcctgggcaacagagtgagactctgtctca

SEQ ID NO: 75902 - DNA, 428 bp, Homo sapiens
tttttttagttgtaaaataatttactaaaggcactattgttaaacatcaaactaataacttgttgccaataagggacatgatcttgtaagtaggaaagctgtaactaaaaattgtattgtttgcttattagccatgtatctcttaaaagatcatgatctcaaaccaattaggagctccaagctcccttcccaggtaactgttgggagcaatggcatcactgtatgcccttgtaatggctggaagggacatgatcttgtaagtaggaaagctgtaactaaaaattgtattgtttgcttattagccatgtatctcttaaaattttgttatgtttacaacgatgtaccttattggcaacaagttattagtttgatgtttaacaatagtgcctttagtaaattattttacaactaaaaaaaattgttttttg

SEQ ID NO: 75903 - DNA, 437 bp, Homo sapiens
atggcgggtgtggaggaggtagcggcctccgggagccacctgaatggcgacctggatccagacgacagggaagaaggagctgcctctacggctgaggaagcagccaagaaaaaaagacgaaagaagaagaagagcaaagggccttctgcaggtaaagagagttttatgttttcccagtcccctccgggaacggctgaactgtttggctcaggcccgttgagggggccgggaccggggccccagagccccgactagactgattcttgggcctgacagggtggcaaagccgggctatagattcctagtctgagaagaggcgtcatctcctcctgtgggactagagggctggtgggggagaaaagagtgcctgaggttggcgtgtggtacctctggggtcgctgggcccgagcccctgtattaccagaactcagctccca

SEQ ID NO: 75904 - DNA, 3562 bp, Homo sapiens
  misc_feature (3)..(4): n is a, c, g, or t
  misc_feature (15)..(16): n is a, c, g, or t
  misc_feature (18)..(18): n is a, c, g, or t
  misc_feature (22)..(22): n is a, c, g, or t
  misc_feature (26)..(26): n is a, c, g, or t
  misc_feature (30)..(30): n is a, c, g, or t
cannctcgcgagaannangacncgcnagcntcggcggcccggaaccggccttggaacatctgacggaacctgaggccgcttgccctcccgccccatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggaagtctgtgtacatcttttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggagctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccggtcccttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatgagttgtcacttgttcactgtccccaaacctatggaagttgttgctatacatgttggaaatgtgtttttcccccatgaaaccattcttcagacatcagtcaatggaagaaatggctatgaacagaaactacatttctactatgatcagaagaacatgattttacaagtataacagttttgagtaattcaagcctctaaacagacaggaatttagaaaaagtcaatgtacttgtttgaatatttgttttaataccacagctatttagaagcatcatcacgacacatttgccttcagtcttggtaaaacattacttatttaactgattaaaaataccttctatgtattagtgtcaacttttaacttttgggcgtaagaccaaatgtagttttgtatacagagaagaaaacctcaagtaataggcattttaagtaaaagtctacctgtgtttttttctaaaaaggctgctcacaagttctatttcttgaagaataaattctacctccttgtgttgcactgaacaggttctcttcctggcatcataaggagttggtgtaatcattttaaattccactgaaaatttaacagtatccccttctcatcgaagggattgtgtatctgtgcttctaatattagttggctttcataaatcatgttgttgtgtgtatatgtatttaagatgtacatttaataatatcaaagagaagatgcctgttaatttataatgtatttgaaaattacatgttttttcatttgtaaaaatgagtcatttgtttaaacaatctttcatgtcttgtcatacaaatttataaaggtctgcactcctttatctgtaattgtaattccaaaatccaaaaagctctgaaaacaaggtttccataagcttggtgacaaaattcatttgcttgcaatctaatctgaactgaccttgaatctttttatcccatttagtgtgaatattcctttattttgctgcttgatgatgagagggagggctgctgccacagactgtggtgagggctggttaatgtagtatggtatatgcacaaaactacttttctaaaatctaaaatttcataattctgaaacaacttgccccaagggtttcagagaaaggactgtggacctctatcatctgctaagtaatttagaagatattatttgtcttaaaaaatgtgaaatgcttttatattctaatagtttttcactttgtgtattaaatggtttttaaatt

SEQ ID NO: 75905 - DNA, 4851 bp, Homo sapiens
  misc_feature (1)..(2): n is a, c, g, or t
  misc_feature (1086)..(1086): n is a, c, g, or t
  misc_feature (1721)..(1721): n is a, c, g, or t
nngactcccagttttctggctaatgaatcagataccacagatacacagtgatagcatttgtttaggttatattttttaaaactttgaggcagccctgtcaacataccatgaagctcagaaataaactgctacccaggtagcttctttgagtgtcaccttgagtgacaaactgtaacaagattgtgtctgtcattggggcctattatataatcacacttgatttgtggcctctattgtcttttctagcttagagttgacttgaatctcttgttcatctgaaatggttaaaaccagctttcttcattatcctggagaaggctaaagttctgagggctttcactgtcttaaggagctagttatatgagaaagctcttggcttggtccatggtatttaggaaggaatgctgtttggagaagaacctttttggagccttgcatttgattgttggtgaggaggagacaacagagatgtgtggggaataaagttgggctatgggggaagtatttggagtgatagataacaaaggacacaacgttttttaaacctcctttgatgctcatcatttcctttttggtaaaatgggggtaacaaaagtagtcttctcacatgactgctgtgaggattaaatgggaaaattataagcagagagtagcaaatattattattattgcatttaggcttaattattgtccaaagaatataccagcatgatgcataagcaactttcaactcctttagccattttctgaaatataacaattaatgatttttttttaaaatcgaggtcacattttaaactgtagaacccattgtgaccaacagccatcccatttgagggtatctggctgctgccagttggctttaagatgtcatactgccctcaaatggaactttcaggatgtctacaggtccctttactagttggtttcaatgagcttttttcaaagtttttctgggttgtaaacagacggataaacatgaaattccaagcaacctagttcaagggcctccttcctttaggtaatgaaagtttgatgaattgtcctactgtttctaaatatgtggttaatcatccaagaaaaatngttcccttggccagaggctgcatttgtgtctagggcttgggttagtatgggttaaagatagccaagactattgttctcaagcacaggcaactaaggtctcttactgataaatttatatatacattatacacctgcaaactttattttttatatataactagattttatttataggtaatctttatatcttttatcttaacccaatttttaatttaaatggagatgtttattaattaaaattagtttcagagtttcagggatttttgaggaattttttgtttggaggctgatatgttacagaagaaaggttatatccactgactgatgtcttttatagatcactcctacagtgacagcacagagatggtgaaaatcattgtgcacactgtgcagagtcaggaccgtgtgctcaaggagctgtttggtcatttgaggtaggaaaattgcttcatttcctactgaaaaaccaggatacgtttatcttgttcctctcaaagtacaaaagccctctttggtaaagtatacttacccaggaagaattctgaaggtaccttgggtagcttggccatagctatctgcatttatgtgtccttttgtatgcattactttggagataagtcattaaatctgatgcngattgtggttcatttcctcagctgggttttgggaatatggtgtacagtcttggggcatgtgaaagtgtctgacactgatttaatctctccagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtgtaagtaattattaatgaattatttaatgtgacattgagttgctattattccttgcaaaggggattttatcagcatgaggtgggccctcttgaagacatgtatattttgcattgggatgacatccatgttccttgcttggtgtccagactagcaattgagatgcaggacttattatcatctctcctttccaatttctctgttgttatactcctcttagcccttgactactgtggtattccaacctaacttggggatagatgtacctgcctagataatgaaattgaccatctattcaactgggttttttttttctttcttcaactaaaatggtataagatgagtggatatatttggttttagtcaatgaagaaagggtccaaggacaggttactaatggtgtgtaaaggtgggaatagttttgtactgaaatactctggttgtgcatataagtagtaacggaaatgtaagtcttaggaatatgataagaaattgtgtgaatcaacagagatgcttgcctgtaatcttttgatgtttttttcttttccttcagacacagagttctgcccggtcccttgtaggatccagtctagaaggtgcagtaacccctcagacatcagcatggctgcccccgacttcagcagaacatgatcattctctgtcatgtgtggtaactcctcaagatggagatgggtgggtttactttgtaacaatagatagctgtgttttcatagcagtggtataggaatgaggcagtagttgttaaggtagtcttctgtgccttcagaccagggttgagtcctgactatccctttgtaataatcttaggcaacttacttgacttttttgatgttcatatttcctcacctgtaaaacaggaatgtctcatagaactgctgtggaaatttgattagacaatgtatataaagtgcttgggaaataaatgttcagcaaatgttgcgtattattagctcaaatgttgcttattattagctaagtccaagttctaagtcctttcttttattggcttattactttcttttactcaaaccttactccttcattaacagtttatgagaaattatgctatcattttgcatttatcattttggggatccttgattacccttctaataaatttttgagatctattttataactttgtatttctaagattagacttttttcagtgttttaaatcagttttgcaagaactcagattccaagccctatattttattaattcctactcttttgctaaaagctgaatgactatccatttctgttattttctcagcttaagatgtgccgtatccaaagccagtggctctttgctagcttgtgtattgtcgcttttctcacaactcatggagacctctacagcaccagcatttcctggaagctctgcccataattagttttgcagaagtgcagccatgttacatcactgctcaggaggtcatgcagttgcacattctgtactctacttttatgagagaaaagcacatggcaggaaggcaagctgatatcagggagacttcagcacaaatgatagaagaaaatttgaactgccttggccatttaagcactattattcatgaggcaaatgaggaacagggcaatagtatgatgaatcttgattggagttggttaacagaatgagttgtcacttgttcactgtccccaaacctatggaagttgttgctatacatgttggaaatgtgtttttcccccatgaaaccattcttcagacatcagtcaatggaagaaatggctatgaacagaaactacatttctactatgatcagaagaacatgattttacaagtataacagttttgagtaattcaagcctctaaacagacaggaatttagaaaaagtcaatgtacttgtttgaatatttgttttaataccacagctatttagaagcatcatcacgacacatttgccttcagtcttggtaaaacattacttatttaactgattaaaaataccttctatgtattagtgtcaacttttaacttttgggcgtaagaccaaatgtagttttgtatacagagaagaaaacctcaagtaataggcattttaagtaaaagtctacctgtgtttttttctaaaaaggctgctcacaagttctatttcttgaagaataaattctacctccttgtgttgcactgaacaggttctcttcctggcatcataaggagttggtgtaatcattttaaattccactgaaaatttaacagtatccccttctcatcgaagggattgtgtatctgtgcttctaatattagttggctttcataaatcatgttgttgtgtgtatatgtatttaagatgtacatttaataatatcaaagagaagatgcctgttaatttataatgtatttgaaaattacatgttttttcatttgtaaaaatgagtcatttgtttaaacaatctttcatgtcttgtcatacaaatttataaaggtctgcactcctttatctgtaattgtaattccaaaatccaaaaagctctgaaaacaaggtttccataagcttggtgacaaaattcatttgcttgcaatctaatctgaactgaccttgaatctttttatcccatttagtgtgaatattcctttattttgctgcttgatgatgagagggagggctgctgccacagactgtggtgagggctggttaatgtagtatggtatatgcacaaaactacttttctaaaatctaaaatttcataattctgaaacaacttgccccaagggtttcagagaaaggactgtggacctctatcatctgctaagtaatttagaagatattatttgtcttaaaaaatgtgaaatgcttttatattctaatagtttttcactttgtgtattaaatggtttttaaatt

SEQ ID NO: 75906 - DNA, 3660 bp, Homo sapiens
  misc_feature (3)..(4): n is a, c, g, or t
  misc_feature (15)..(16): n is a, c, g, or t
  misc_feature (18)..(18): n is a, c, g, or t
  misc_feature (22)..(22): n is a, c, g, or t
  misc_feature (26)..(26): n is a, c, g, or t
  misc_feature (30)..(30): n is a, c, g, or t
cannctcgcgagaannangacncgcnagcntcggcggcccggaaccggccttggaacatctgacggaacctgaggccgcttgccctcccgccccatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggaagtctgtgtacatcttttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggagctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccggtcccttgtaggatccagtctagaaggtgcagtaacccctcagacatcagcatggctgcccccgacttcagcagaacatgatcattctctgtcatgtgtggtaactcctcaagatgggctggagtgcagtggcacagtcttggctcattgcaacctccgcctcccagattcaagcagttctcctgcttcagcttcccgagtagctgggatttcagggagacttcagcacaaatgatagaagaaaatttgaactgccttggccatttaagcactattattcatgaggcaaatgaggaacagggcaatagtatgatgaatcttgattggagttggttaacagaatgagttgtcacttgttcactgtccccaaacctatggaagttgttgctatacatgttggaaatgtgtttttcccccatgaaaccattcttcagacatcagtcaatggaagaaatggctatgaacagaaactacatttctactatgatcagaagaacatgattttacaagtataacagttttgagtaattcaagcctctaaacagacaggaatttagaaaaagtcaatgtacttgtttgaatatttgttttaataccacagctatttagaagcatcatcacgacacatttgccttcagtcttggtaaaacattacttatttaactgattaaaaataccttctatgtattagtgtcaacttttaacttttgggcgtaagaccaaatgtagttttgtatacagagaagaaaacctcaagtaataggcattttaagtaaaagtctacctgtgtttttttctaaaaaggctgctcacaagttctatttcttgaagaataaattctacctccttgtgttgcactgaacaggttctcttcctggcatcataaggagttggtgtaatcattttaaattccactgaaaatttaacagtatccccttctcatcgaagggattgtgtatctgtgcttctaatattagttggctttcataaatcatgttgttgtgtgtatatgtatttaagatgtacatttaataatatcaaagagaagatgcctgttaatttataatgtatttgaaaattacatgttttttcatttgtaaaaatgagtcatttgtttaaacaatctttcatgtcttgtcatacaaatttataaaggtctgcactcctttatctgtaattgtaattccaaaatccaaaaagctctgaaaacaaggtttccataagcttggtgacaaaattcatttgcttgcaatctaatctgaactgaccttgaatctttttatcccatttagtgtgaatattcctttattttgctgcttgatgatgagagggagggctgctgccacagactgtggtgagggctggttaatgtagtatggtatatgcacaaaactacttttctaaaatctaaaatttcataattctgaaacaacttgccccaagggtttcagagaaaggactgtggacctctatcatctgctaagtaatttagaagatattatttgtcttaaaaaatgtgaaatgcttttatattctaatagtttttcactttgtgtattaaatggtttttaaatt

SEQ ID NO: 75907 - DNA, 3471 bp, Homo sapiens
  misc_feature (3)..(4): n is a, c, g, or t
  misc_feature (15)..(16): n is a, c, g, or t
  misc_feature (18)..(18): n is a, c, g, or t
  misc_feature (22)..(22): n is a, c, g, or t
  misc_feature (26)..(26): n is a, c, g, or t
  misc_feature (30)..(30): n is a, c, g, or t
cannctcgcgagaannangacncgcnagcntcggcggcccggaaccggccttggaacatctgacggaacctgaggccgcttgccctcccgccccatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggaagtctgtgtacatcttttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggagctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccggtcccttgtaggatccagtctagaagggagacttcagcacaaatgatagaagaaaatttgaactgccttggccatttaagcactattattcatgaggcaaatgaggaacagggcaatagtatgatgaatcttgattggagttggttaacagaatgagttgtcacttgttcactgtccccaaacctatggaagttgttgctatacatgttggaaatgtgtttttcccccatgaaaccattcttcagacatcagtcaatggaagaaatggctatgaacagaaactacatttctactatgatcagaagaacatgattttacaagtataacagttttgagtaattcaagcctctaaacagacaggaatttagaaaaagtcaatgtacttgtttgaatatttgttttaataccacagctatttagaagcatcatcacgacacatttgccttcagtcttggtaaaacattacttatttaactgattaaaaataccttctatgtattagtgtcaacttttaacttttgggcgtaagaccaaatgtagttttgtatacagagaagaaaacctcaagtaataggcattttaagtaaaagtctacctgtgtttttttctaaaaaggctgctcacaagttctatttcttgaagaataaattctacctccttgtgttgcactgaacaggttctcttcctggcatcataaggagttggtgtaatcattttaaattccactgaaaatttaacagtatccccttctcatcgaagggattgtgtatctgtgcttctaatattagttggctttcataaatcatgttgttgtgtgtatatgtatttaagatgtacatttaataatatcaaagagaagatgcctgttaatttataatgtatttgaaaattacatgttttttcatttgtaaaaatgagtcatttgtttaaacaatctttcatgtcttgtcatacaaatttataaaggtctgcactcctttatctgtaattgtaattccaaaatccaaaaagctctgaaaacaaggtttccataagcttggtgacaaaattcatttgcttgcaatctaatctgaactgaccttgaatctttttatcccatttagtgtgaatattcctttattttgctgcttgatgatgagagggagggctgctgccacagactgtggtgagggctggttaatgtagtatggtatatgcacaaaactacttttctaaaatctaaaatttcataattctgaaacaacttgccccaagggtttcagagaaaggactgtggacctctatcatctgctaagtaatttagaagatattatttgtcttaaaaaatgtgaaatgcttttatattctaatagtttttcactttgtgtattaaatggtttttaaatt

SEQ ID NO: 75908 - DNA, 913 bp, Homo sapiens
gctgatgaaaaagataatcttctaaaggcctaaattttcggcataaggcccaacatggtattagtatacaggaatgaaaaattcacccagtgttcatttgaagtaaagttttatctatgggttttctgtggaagagactgctgacaagtaaaattgctcttcctgaagactaagcccagcctccttgtgttgctctcagcaagtgttcttcatggcatcacatggagtcagatgaatcccatctttaatcacacatttaatagagtccttttcctgtgtaaggggttggacttttgtgcctttgatatcagctgaccataatgaattgtgttgtgtgctatatgtatatgtatttaagatgtacatttaataatatcaaagagaagatgcctgttaatttataatgtatttgaaaattacatgttttttcatttgtaaaaatgagtcatttgtttaaacaatctttcatgtcttgtcatacaaatttataaaggtctgcactcctttatctgtaattgtaattccaaaatccaaaaagctctgaaaacaaggtttccataagcttggtgacaaaattcatttgcttgcaatctaatctgaactgaccttgaatctttttatcccatttagtgtgaatattcctttattttgctgcttgatgatgagagggagggctgctgccacagactgtggtgagggctggttaatgtagtatggtatatgcacaaaactacttttctaaaatctaaaatttcataattctgaaacaacttgccccaagggtttcagagaaaggactgtggacctctatcatctgctaagtaatttagaagatattatttgtcttaaaaaatgtgaaatgcttttatattctaatagtttttcactttgtgtattaaatggtttttaaatt

SEQ ID NO: 75909 - DNA, 4703 bp, Homo sapiens
  misc_feature (3)..(4): n is a, c, g, or t
  misc_feature (15)..(16): n is a, c, g, or t
  misc_feature (18)..(18): n is a, c, g, or t
  misc_feature (22)..(22): n is a, c, g, or t
  misc_feature (26)..(26): n is a, c, g, or t
  misc_feature (30)..(30): n is a, c, g, or t
cannctcgcgagaannangacncgcnagcntcggcggcccggaaccggccttggaacatctgacggaacctgaggccgcttgccctcccgccccatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggaagtctgtgtacatcttttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggagctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtgtaagtaattattaatgaattatttaatgtgacattgagttgctattattccttgcaaaggggattttatcagcatgaggtgggccctcttgaagacatgtatattttgcattgggatgacatccatgttccttgcttggtgtccagactagcaattgagatgcaggacttattatcatctctcctttccaatttctctgttgttatactcctcttagcccttgactactgtggtattccaacctaacttggggatagatgtacctgcctagataatgaaattgaccatctattcaactgggttttttttttctttcttcaactaaaatggtataagatgagtggatatatttggttttagtcaatgaagaaagggtccaaggacaggttactaatggtgtgtaaaggtgggaatagttttgtactgaaatactctggttgtgcatataagtagtaacggaaatgtaagtcttaggaatatgataagaaattgtgtgaatcaacagagatgcttgcctgtaatcttttgatgtttttttcttttccttcagacacagagttctgcccggtcccttgtaggatccagtctagaaggtgcagtaacccctcagacatcagcatggctgcccccgacttcagcagaacatgatcattctctgtcatgtgtggtaactcctcaagatggagatgggtgggtttactttgtaacaatagatagctgtgttttcatagcagtggtataggaatgaggcagtagttgttaaggtagtcttctgtgccttcagaccagggttgagtcctgactatccctttgtaataatcttaggcaacttacttgacttttttgatgttcatatttcctcacctgtaaaacaggaatgtctcatagaactgctgtggaaatttgattagacaatgtatataaagtgcttgggaaataaatgttcagcaaatgttgcgtattattagctcaaatgttgcttattattagctaagtccaagttctaagtcctttcttttattggcttattactttcttttactcaaaccttactccttcattaacagtttatgagaaattatgctatcattttgcatttatcattttggggatccttgattacccttctaataaatttttgagatctattttataactttgtatttctaagattagacttttttcagtgttttaaatcagttttgcaagaactcagattccaagccctatattttattaattcctactcttttgctaaaagctgaatgactatccatttctgttattttctcagcttaagatgtgccgtatccaaagccagtggctctttgctagcttgtgtattgtcgcttttctcacaactcatggagacctctacagcaccagcatttcctggaagctctgcccataattagttttgcagaagtgcagccatgttacatcactgctcaggaggtcatgcagttgcacattctgtactctacttttatgagagaaaagcacatggcaggaaggcaagctgatatcagggagacttcagcacaaatgatagaagaaaatttgaactgccttggccatttaagcactattattcatgaggcaaatgaggaacagggcaatagtatgatggtaagttttgtgtggatatgggtgcctgctttggctatgttgggtgcaaaaggtttaactttccatgctagccttatctggcatttgggatgcatatgggaaatagaagaactcaagaggaaagagcatttggggaatatcctcaaccttaaatccttatctgccgttactcagggatatactaggattatgtcatcaattatcttcaataatagcatttttggtcaaattaaatgagtggtaagcttcttcacaatgtgaccattgaaattgaatggtttgttctgtacctttttgcttcagcaatcaattttctccattaagatgggacttgtactttaattcagatatggtacctcccgaatagaaaataaattatgttaatatagttgtaataataagtgtgtgttaagatttggttactataaactactgatttgttaaaacttgaggaaattaccataaaatgtctactgaatcaatttttcctgcatttagtcttaatgtcaattctgtacatttcctctttcattaagaaaaatagcagtggccaggcatggtggctcacgcctgtaatcctagcactttgggaggccaaggcaggtggattgcttgagcccaggagtttgagactagcctggccaacatgggaaaccctgtctttataaaaaatataaaaattggccaggtgtggtggcacacacctgtggtcccagctacttgggaggctgaggcaggaagatcgcttgagttcaagagtttcaggctgcagtgagccgtaatcctgccattgcactccagcctgtgacagagtgagactttgtctcggggaaaaaaaaaaaaaaaaaggataatggtggccagccatatgacatgtacctgtagtccgagttactagggaggctgaggcagaaggattgcatgagcccaggagttcaaggctgcagtgcattatgattggacttgtgaatagccactgtactccagcttggcaacatagcaaga

SEQ ID NO: 75910 - DNA, 3307 bp, Homo sapiens
  misc_feature (3)..(4): n is a, c, g, or t
  misc_feature (15)..(16): n is a, c, g, or t
  misc_feature (18)..(18): n is a, c, g, or t
  misc_feature (22)..(22): n is a, c, g, or t
  misc_feature (26)..(26): n is a, c, g, or t
  misc_feature (30)..(30): n is a, c, g, or t
cannctcgcgagaannangacncgcnagcntcggcggcccggaaccggccttggaacatctgacggaacctgaggccgcttgccctcccgccccatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggaagtctgtgtacatcttttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggagctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccggtcccttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatggtaagttttgtgtggatatgggtgcctgctttggctatgttgggtgcaaaaggtttaactttccatgctagccttatctggcatttgggatgcatatgggaaatagaagaactcaagaggaaagagcatttggggaatatcctcaaccttaaatccttatctgccgttactcagggatatactaggattatgtcatcaattatcttcaataatagcatttttggtcaaattaaatgagtggtaagcttcttcacaatgtgaccattgaaattgaatggtttgttctgtacctttttgcttcagcaatcaattttctccattaagatgggacttgtactttaattcagatatggtacctcccgaatagaaaataaattatgttaatatagttgtaataataagtgtgtgttaagatttggttactataaactactgatttgttaaaacttgaggaaattaccataaaatgtctactgaatcaatttttcctgcatttagtcttaatgtcaattctgtacatttcctctttcattaagaaaaatagcagtggccaggcatggtggctcacgcctgtaatcctagcactttgggaggccaaggcaggtggattgcttgagcccaggagtttgagactagcctggccaacatgggaaaccctgtctttataaaaaatataaaaattggccaggtgtggtggcacacacctgtggtcccagctacttgggaggctgaggcaggaagatcgcttgagttcaagagtttcaggctgcagtgagccgtaatcctgccattgcactccagcctgtgacagagtgagactttgtctcggggaaaaaaaaaaaaaaaaaggataatggtggccagccatatgacatgtacctgtagtccgagttactagggaggctgaggcagaaggattgcatgagcccaggagttcaaggctgcagtgcattatgattggacttgtgaatagccactgtactccagcttggcaacatagcaaga

SEQ ID NO: 75911 - DNA, 253 bp, Homo sapiens
caaaactacttttctaaaatctaaaatttcataattctgaaacaacttgccccaagggtttcagagaaaggactgtggacctctatcatctgctaagtaatttagaagatattatttgtcttaaaaaatgtgaaatgcttttatattctaatagtttttcactttgtgtattaaatggtttttaaattactttcttgatctctattcattataaaaatcagattataataaaacagttgaatatggcttagga

SEQ ID NO: 75912 - DNA, 3607 bp, Homo sapiens
  misc_feature (3)..(4): n is a, c, g, or t
  misc_feature (15)..(16): n is a, c, g, or t
  misc_feature (18)..(18): n is a, c, g, or t
  misc_feature (22)..(22): n is a, c, g, or t
  misc_feature (26)..(26): n is a, c, g, or t
  misc_feature (30)..(30): n is a, c, g, or t
cannctcgcgagaannangacncgcnagcntcggcggcccggaaccggccttggaacatctgacggaacctgaggccgcttgccctcccgccccatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggaagtctgtgtacatcttttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggagctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccggtcccttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatgagttgtcacttgttcactgtccccaaacctatggaagttgttgctatacatgttggaaatgtgtttttcccccatgaaaccattcttcagacatcagtcaatggaagaaatggctatgaacagaaactacatttctactatgatcagaagaacatgattttacaagtataacagttttgagtaattcaagcctctaaacagacaggaatttagaaaaagtcaatgtacttgtttgaatatttgttttaataccacagctatttagaagcatcatcacgacacatttgccttcagtcttggtaaaacattacttatttaactgattaaaaataccttctatgtattagtgtcaacttttaacttttgggcgtaagaccaaatgtagttttgtatacagagaagaaaacctcaagtaataggcattttaagtaaaagtctacctgtgtttttttctaaaaaggctgctcacaagttctatttcttgaagaataaattctacctccttgtgttgcactgaacaggttctcttcctggcatcataaggagttggtgtaatcattttaaattccactgaaaatttaacagtatccccttctcatcgaagggattgtgtatctgtgcttctaatattagttggctttcataaatcatgttgttgtgtgtatatgtatttaagatgtacatttaataatatcaaagagaagatgcctgttaatttataatgtatttgaaaattacatgttttttcatttgtaaaaatgagtcatttgtttaaacaatctttcatgtcttgtcatacaaatttataaaggtctgcactcctttatctgtaattgtaattccaaaatccaaaaagctctgaaaacaaggtttccataagcttggtgacaaaattcatttgcttgcaatctaatctgaactgaccttgaatctttttatcccatttagtgtgaatattcctttattttgctgcttgatgatgagagggagggctgctgccacagactgtggtgagggctggttaatgtagtatggtatatgcacaaaactacttttctaaaatctaaaatttcataattctgaaacaacttgccccaagggtttcagagaaaggactgtggacctctatcatctgctaagtaatttagaagatattatttgtcttaaaaaatgtgaaatgcttttatattctaatagtttttcactttgtgtattaaatggtttttaaatttaaaaaaaaaaaaaaggggggggggcaaaagaatcccgaagggcc

SEQ ID NO: 75913 - DNA, 2926 bp, Homo sapiens
atgtgtaaagtcttgttcccagagatctctgagactaaactactgcacatgcacttgataattattagtcagctatgagtaccatggtatgcgaatgtattgctggatatccgtctttttagcatcatctgaattggaaaaccctgtgcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggagctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccggtcccttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatgagttgtcacttgttcactgtccccaaacctatggaagttgttgctatacatgttggaaatgtgtttttcccccatgaaaccattcttcagacatcagtcaatggaagaaatggctatgaacagaaactacatttctactatgatcagaagaacatgattttacaagtataacagttttgagtaattcaagcctctaaacagacaggaatttagaaaaagtcaatgtacttgtttgaatatttgttttaataccacagctatttagaagcatcatcacgacacatttgccttcagtcttggtaaaacattacttatttaactgattaaaaataccttctatgtattagtgtcaacttttaacttttgggcgtaagaccaaatgtagttttgtatacagagaagaaaacctcaagtaataggcattttaagtaaaagtctacctgtgtttttttctaaaaaggctgctcacaagttctatttcttgaagaataaattctacctccttgtgttgcactgaacaggttctcttcctggcatcataaggagttggtgtaatcattttaaattccactgaaaatttaacagtatccccttctcatcgaagggattgtgtatctgtgcttctaatattagttggctttcataaatcatgttgttgtgtgtatatgtatttaagatgtacatttaataatatcaaagagaagatgcctgttaatttataatgtatttgaaaattacatgttttttcatttgtaaaaatgagtcatttgtttaaacaatctttcatgtcttgtcatacaaatttataaaggtctgcactcctttatctgtaattgtaattccaaaatccaaaaagctctgaaaacaaggtttccataagcttggtgacaaaattcatttgcttgcaatctaatctgaactgaccttgaatctttttatcccatttagtgtgaatattcctttattttgctgcttgatgatgagagggagggctgctgccacagactgtggtgagggctggttaatgtagtatggtatatgcacaaaactacttttctaaaatctaaaatttcataattctgaaacaacttgccccaagggtttcagagaaaggactgtggacctctatcatctgctaagtaatttagaagatattatttgtcttaaaaaatgtgaaatgcttttatattctaatagtttttcactttgtgtattaaatggtttttaaatt

SEQ ID NO: 75914 - DNA, 4568 bp, Homo sapiens
  misc_feature (3)..(4): n is a, c, g, or t
  misc_feature (15)..(16): n is a, c, g, or t
  misc_feature (18)..(18): n is a, c, g, or t
  misc_feature (22)..(22): n is a, c, g, or t
  misc_feature (26)..(26): n is a, c, g, or t
  misc_feature (30)..(30): n is a, c, g, or t
cannctcgcgagaannangacncgcnagcntcggcggcccggaaccggccttggaacatctgacggaacctgaggccgcttgccctcccgccccatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggaagtctgtgtacatcttttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggagctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtgtaagtaattattaatgaattatttaatgtgacattgagttgctattattccttgcaaaggggattttatcagcatgaggtgggccctcttgaagacatgtatattttgcattgggatgacatccatgttccttgcttggtgtccagactagcaattgagatgcaggacttattatcatctctcctttccaatttctctgttgttatactcctcttagcccttgactactgtggtattccaacctaacttggggatagatgtacctgcctagataatgaaattgaccatctattcaactgggttttttttttctttcttcaactaaaatggtataagatgagtggatatatttggttttagtcaatgaagaaagggtccaaggacaggttactaatggtgtgtaaaggtgggaatagttttgtactgaaatactctggttgtgcatataagtagtaacggaaatgtaagtcttaggaatatgataagaaattgtgtgaatcaacagagatgcttgcctgtaatcttttgatgtttttttcttttccttcagacacagagttctgcccggtcccttgtaggatccagtctagaaggtgcagtaacccctcagacatcagcatggctgcccccgacttcagcagaacatgatcattctctgtcatgtgtggtaactcctcaagatggagatgggtgggtttactttgtaacaatagatagctgtgttttcatagcagtggtataggaatgaggcagtagttgttaaggtagtcttctgtgccttcagaccagggttgagtcctgactatccctttgtaataatcttaggcaacttacttgacttttttgatgttcatatttcctcacctgtaaaacaggaatgtctcatagaactgctgtggaaatttgattagacaatgtatataaagtgcttgggaaataaatgttcagcaaatgttgcgtattattagctcaaatgttgcttattattagctaagtccaagttctaagtcctttcttttattggcttattactttcttttactcaaaccttactccttcattaacagtttatgagaaattatgctatcattttgcatttatcattttggggatccttgattacccttctaataaatttttgagatctattttataactttgtatttctaagattagacttttttcagtgttttaaatcagttttgcaagaactcagattccaagccctatattttattaattcctactcttttgctaaaagctgaatgactatccatttctgttattttctcagcttaagatgtgccgtatccaaagccagtggctctttgctagcttgtgtattgtcgcttttctcacaactcatggagacctctacagcaccagcatttcctggaagctctgcccataattagttttgcagaagtgcagccatgttacatcactgctcaggaggtcatgcagttgcacattctgtactctacttttatgagagaaaagcacatggcaggaaggcaagctgatatcagggagacttcagcacaaatgatagaagaaaatttgaactgccttggccatttaagcactattattcatgaggcaaatgaggaacagggcaatagtatgatggtaagttttgtgtggatatgggtgcctgctttggctatgttgggtgcaaaaggtttaactttccatgctagccttatctggcatttgggatgcatatgggaaatagaagaactcaagaggaaagagcatttggggaatatcctcaaccttaaatccttatctgccgttactcagggatatactaggattatgtcatcaattatcttcaataatagcatttttggtcaaattaaatgagtggtaagcttcttcacaatgtgaccattgaaattgaatggtttgttctgtacctttttgcttcagcaatcaattttctccattaagatgggacttgtactttaattcagatatggtacctcccgaatagaaaataaattatgttaatatagttgtaataataagtgtgtgttaagatttggttactataaactactgatttgttaaaacttgaggaaattaccataaaatgtctactgaatcaatttttcctgcatttagtcttaatgtcaattctgtacatttcctctttcattaagaaaaatagcagtggccaggcatggtggacacacctgtggtcccagctacttgggaggctgaggcaggaagatcgcttgagttcaagagtttcaggctgcagtgagccgtaatcctgccattgcactccagcctgtgacagagtgagactttgtctcggggaaaaaaaaaaaaaaaaaggataatggtggccagccatatgacatgtacctgtagtccgagttactagggaggctgaggcagaaggattgcatgagcccaggagttcaaggctgcagtgcattatgattggacttgtgaatagccactgtactccagcttggcaacatagcaaga

SEQ ID NO: 75915 - DNA, 1285 bp, Homo sapiens
  misc_feature (3)..(4): n is a, c, g, or t
  misc_feature (15)..(16): n is a, c, g, or t
  misc_feature (18)..(18): n is a, c, g, or t
  misc_feature (22)..(22): n is a, c, g, or t
  misc_feature (26)..(26): n is a, c, g, or t
  misc_feature (30)..(30): n is a, c, g, or t
cannctcgcgagaannangacncgcnagcntcggcggcccggaaccggccttggaacatctgacggaacctgaggccgcttgccctcccgccccatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggaagtctgtgtacatcttttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagaatagacacaccctaaatacgacttcttgctagtaaatttgatatataaaaccatctggccgacagattttaataactaaggcttcggatagaagtgcaaacccaacatacaacctattattcataaacttacacacagccccccactactccacttctttgtaaacccacccgaaaagttatccatagtttagttcaaagcctcaatattactttccgccctattaaatcgcatccatcctctattaaaaaaaaccc

SEQ ID NO: 75916 - DNA, 360 bp, Homo sapiens
ctctgacttcagagcacctcttccctgatgcactgtgctctgagcacacacaacagctatccaggagccagttctctgcatctaccctcatctggccattttgaaaaatgcaaagaaagaagtcactctaaattcaggcttaacaagatggttgtggttgagtggcagtggcctgtttactacatactgcctgtattagtccattttcatgttgctgataaagacatacctgagactgggtaatttacaaaagaaagaggtgtaatggacttacagttccacatggctggggaggcctcacaatcatggcagaaggtgaaaggcacgtctcacatggtggcagacaagagaagagagctt

SEQ ID NO: 75917 - DNA, 468 bp, Homo sapiens
aaattgattccagacaacattggaaaagatacagaaaaggtttgccaatttatcctctccatgatgtcttcattagaaaagtaaaaatgctggagaaccctgggtttgaaaggcatggagcttcgtggtggaggtagtagttctggaaaacccactagggacgagacacatgctaaagttgaatgagctgatggataggaaccaccagtccaagaatctgtttaaagttcagacttaaaacagtaccaaataaaaagtcctatttgtgaaaaacaaacaagaaacaacaatgaaagagcaaaattacgctgatgtggtggtgtatgcctgtaatcctagctactcaggaggctgaggcatgagaatcacttgaacccgggagacagaggttgcagtgagccaagattgcaccattgcactccagcctgggcaacagagtgagactctctccaaaaggaagaaaaaaaa

SEQ ID NO: 75918 - DNA, 365 bp, Homo sapiens
ccttcagcactattgaggcagatggaattcccataatgtgtataaaaaacagttttatggaacattaatgcttgtatttcatattctacttataaccaaatattagaaatagttgaaaagttcctttccaagctgatatttagattcatgaaaggaacactggacccttggtgataatgaatataaattttcttaataactgataccctctatcatgttctatactgatacggtttggctgtgtccccacccaaatctcatcctgaattccagtggaaggtgactgaattatggggactggtcttttctgtgctgttctcatgatagtgaatgagtctcatgagatctgatgactaaaaaaaaaa

SEQ ID NO: 75919 - DNA, 546 bp, Homo sapiens
tgcttcacttctggtctctgttttacagtagtgctcaccaatatttcaataaattctactgaacttactctaatagaacattattcaacccccaaagacttatctcttcactatgacatctccatactttatttttaggagacagactttcaaaaccagagaaatcaggtgccttcctcaaggtcatgctccaacccaggccaactattaaatgcttgcatctgttagctggattagtctctatgtatactgaactgtgatgaaaatctatagctttgttttagaaaattattgttgatggactattaatattatattaacaatttctcagtaagtgtgttttttcctcattgaatctaggaatgctgggctttaagttgataactgtgtcatttcaatcaagtacaaggattttgaggcagattttgctagatatcttagtaatcccccacaatgttttatgtaactcttctcagaatatcaatacattaattattttagatgacatattaaataatctatgaatattaatgaaaacaatacagt

SEQ ID NO: 75920 - DNA, 316 bp, Homo sapiens
aactggcatctagtgggtagaggtcaggggtgctgccaaaatcctatagtacataaggtaacaaaaaattattgagcctcaaatatcactaatgctgctgttgagaaaccctggcatgcatgtacacacacaaacacacacacacattctaattgaaacctacttgtgtccagagtataggctttgttttgtaagttaattgctaccaagtatacattttctcattgagaatatagaagtttgcttgctcacacaagaaacaaaactgactccgtgacctcatgaggactgtcaggaatatcagagacatgaatat

SEQ ID NO: 75921 - DNA, 462 bp, Homo sapiens
acaatctctccaagcaggagtcaccaaggcacatacacctttctttaaggaaacatcatcttccatgtttcacttattttcttcctgtcttttaaatcaacagtttatgggttttttttttccctcccttgatcacctggctgagatagaatttgtccatgtaaagttactggatttttttttcaatccatccttttcatactgtattttgtatacatactgaaattaatgtagttacaccaccttttagagggagattaatctcttcttgttaatttgttcctttattgatcagtcaatcacttacgtaagtatggactttacagatacctgttttatactgtgaattataatccaaggctgctttattttgtagctctaattgttctcgctttgaccgttgggaactttcagttgcttcccgtgtccctttgacatactcttattgtggggttttatctt

SEQ ID NO: 75922 - DNA, 493 bp, Homo sapiens
ttgttaaaatgtttttagctttgtttgtagaattgctttaactggtttcatctctgggagctacactttgaaatataactttagcaacattttactatactttttcacaacccagagcagtactattttatgcttagtggttaaactaattccataaatcttttgcaactatcctctattctttttcttgtaatttttacctgggaaggtttttactgataatcatcctatcctgagtcatcccacaaaccaatctgtctcactaatcattgcttctaacctacagactaagcataacttctgctaaatgatctttgataagatgctatgactctataaagtctttgatattcatgtctaaatttaatcacttgtagattttcatagaatcaatctttcacttctacaattgggagtatttataagttgtttatcttaaacagttcctctatcacgcttttcacgttaaataaagcaatcccttcaaatcaat

SEQ ID NO: 75923 - DNA, 1026 bp, Homo sapiens
tgacactgaggctaccgctagaccacggtccgcctggcaacgggcatcttcccagacgatggcgttaccgctagaccaaggagccctctggtggccctgtctgggcataacagaagcctcgcactcttgtcttctggtcacactcctcactatgtcccctcagctcctatctctgtatggccttttttttcctaggttatgattatagagtgaggattattataatactggaataaagagtaattgctacaaactaatgattaatgatattcatatataatcatatctaagatctatatttggtataactattcttgtttatgttttattatactggaacagcttgtgtccttggtctcttgcctcggcacctgggtggcttgctgcccacatacaacaatgttcatatcctaaactccagaatctgtgaatatcttaggtaatgtgacaaaggaaaattaagatatagatagtgtcaaggttaacaagcagctgacttcatgataaattatctttatcatgagcagaagcctcatgtaattagaagggcgcttaaatatgaaagagggagaaaaaaagacactttatcacactgatgtgatattaggtcaactcaatgcaatatttttttcctaagaaaatttttggggattattttcccattagcataaagttcagttcagttgttcaaacacctgtgatttatttttacatgcatattactatggatggtgataattaaacaaaaaatgcagaaaataaagaaatgctttctgaagagtgagcccaggtactatattattatatgagtatagacaatgtggactgtacatgtgattacatgtgattgtaaatgtgtggatgttttatatatgtataagtaatttgttgtataatatagtgctcaggctgcatttttaaaaatttgtatgaggtgggtttgatcaagataaatgggtgaaataaaaatgataaggttggtaatagttttgactatgcaataaataacattgatgataaaagtct

SEQ ID NO: 75924 - DNA, 371 bp, Homo sapiens
gtggtggggtacagggaagggtggataaaatgagaaaatatgagtacagtgattgtcacttaggaatccttcaataaatagtcaatgtagttagcctatcaactagggaaggggatgaggagatgaggctggaggatgggcggaggtgagaactgtcttgtccactgtggcagccactggccacacatggccatttagcatttgaaatgtagctagtctgaattgagatgtcttgtaaataaattaccttttgtacttctaagatgtagtatgaacaaacaacataaaatatccccatttttaatgattcatttatgtcaaaatcttaatatgttggatatattgtgttaaataaatattattaaaatttt

SEQ ID NO: 75925 - DNA, 387 bp, Homo sapiens
tccctttttctgtcaccagacattcagccacttataaaaatcactctctccccaaacttgtgattatctcctttctctcggtagttaaaatgagcacggttcagattcaatgtggcattttgaaagccaggggacacacccagggtgattatggtactcaggtacaggagaacagaaagacagttctctgctatggaatattaattataaatattagctccctttttactagattcaaaggcagttcagtggttactttaaaccaaggccaggtgtggtggctcacacctgtaatcctagcactttcggaagccaaggtgggagggtcacttgagctcaggagtttcaaaccgtcctgggcaagagagtgagacccacctctactta

SEQ ID NO: 75926 - DNA, 393 bp, Homo sapiens
tggccttgggcaatgtgatcagcgccttaggggaccagagcaagaaggtggtgcacgttccctacagggactccaagctcactcggctcctccaggattcgctggggggcaacagccagaccatcatgatcgcctgtgtgagcccctcagaccgagatttcatggagaccctcaacacactcaaatatgccaatcgggcccgcaacatcaagaacaaggtggtagtgaaccaggacaagaccagccagcaaatcagtgcactgcgggctgagattgctcggctgcagatggagctgatggagtataaggcgggcaagcgagtgataggagaggatggcgctgagggctatagtgatctgttccgagagaatgccatgctacagaaggagaatg

SEQ ID NO: 75927 - DNA, 276 bp, Homo sapiens
taagaggcagtgaggggcattcataacccaacgtttttctgctccccctatctgtctcctgctgggattctccagtggcccaagtaacttgaagacagagagcaagggagctccttgatgcagttctggaggtcagcctcctgggaacagaggaggatggaaaagactagagggggagatctggaagggcaaataaatggagtacatctagcacagaggactttgaagagagtcaagcttctaaaagcattagagaggctttgggttagccagtaa

SEQ ID NO: 75928 - DNA, 610 bp, Homo sapiens
cccattcaaaccaccgaagatcacatttaaaacaaagatctatcacccaaacatcgacgaaaaggggcaggtctgtctgccagtaattagtgctgaaaactggaagccagacaaccaaaaccgaccaagtaatccagtccctcatagcactggtgaatgacccccagccctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttctagttctgctctctttgttttaaaaatcactgcttcaatctacttcaaaagaatggtgtttcttttcttgtccaattttatccaaaatcttcaagttacatttaacccataaggtttaaaaaa

SEQ ID NO: 75929 - DNA, 898 bp, Homo sapiens
gagccggttgccagcccgggtcagccggacaccaaagcctctgggtgccggagaagctgctgccagcggagtccaaagtcagctccatagaagatggagcccccgactcagtggcgtcctctgcctgactctgtgttcacttctataataatctccactccctgggagcctggggagctggaggccaagctggttcgataaggacctgccatttggacaggacggggacgctgacaacgatccagagtcactggctgcgtcctacatgcagggccctattcaaagcctccacagcactgctcagcccatcttcctcacagtactgctcagcccgtcttcctaacagcactaagcaggcaatgctgccaccatcccctttccagaccagaaccccaagactcaagagtggtggaataatcagctcagactcccagctgacatgtggtggcacgtgctctggggttcccggggtgctgtagggagccggcgcgcagctctctcgtccaggacacacgagcaggagtgacctgcgtccagaaggtccatcactagccctggccatgtgctgagcacccaggcgatgccacgtggaatccaggtgagagagtcagcaccacctccatctgatgtgttagtctgaaggcagcgttacgtgttgcatctattagacaccaaccccacacaggtaagccatggccagccctggtccaccctccctgctttattccaggggtcccacagttccatctgccttgggtcttgccccttcaatccaccatattatccgctgacagagtaacctttttccgtaactcatgagctggtcatttaaagaaaaaggtggtgaattatgatttgagtgaattttaagaaatacaaattattttcagagtctaaa

SEQ ID NO: 75930 - DNA, 389 bp, Homo sapiens
  misc_feature (4)..(4): n is a, c, g, or t
  misc_feature (15)..(15): n is a, c, g, or t
  misc_feature (36)..(36): n is a, c, g, or t
  misc_feature (41)..(41): n is a, c, g, or t
  misc_feature (65)..(65): n is a, c, g, or t
  misc_feature (376)..(376): n is a, c, g, or t
  misc_feature (385)..(385): n is a, c, g, or t
  misc_feature (388)..(388): n is a, c, g, or t
ggcnggcacctgtantcccagctacttaggagactnaggcnggagaatagcttgaacctgggagntggaggttgcagtgtgctgagatcgcgccactgccctccagtagagtgagattccgtctcaaaaaaaaaaaaaaagaagaaatggagatacaaacttactacctacctccttacaacctaccctcacagtattactgtgaataaaagtgtgtgtagcactgggaacactattcacagagcactcatgaatgtttgttctttgttattagttactagagaggcaaatgtctgccagggctgaataatatgtgtgaattggtgattgtcgcacatatctaaagaagtagttatttttttcaattaaaacttantttaaaaanaana

SEQ ID NO: 75931 - DNA, 585 bp, Homo sapiens
tgtgtgctttctaagacatcaagaggcccagaatgtccagacatcttacttttgcctgattgaccttatctagttggtgttctttaacatgttccccatcccctgtaaaccctaataactaaactgataagagtcatcctcaaaattgagcaggcatctgaatcatctggtatacttagtaaaattccaattgctggtccccaatttctgacccaagactctgcatttttagcaatttgttgctgatacttctggtctggagcccataccttgagaacccctggtctagaggcctgataagattcaggcttaattttttttacagacatacttcataagtagtattgatagtttctttgaatctggttttttataatctttctaatgatgaaggaggaatgttctcaatactgacagtaatctcagttcttcaaactataggataggtttctgtagccacaatagtattttcgtcacaagggcccaaataagaatacatcatgtgtatttttagtagttattcaaattacaaattcactgtctttaatttattctaacaaaagtaaacctaattttatgattata

SEQ ID NO: 75932 - DNA, 1032 bp, Homo sapiens
aatgtcaaaaggaattactttctctttaaaggatagctcccacgcatacgggttgagtgggtatttttcttttgtgctggaatccagaggctccctcttgttctcaaggaaaatgtcagataacccacctgaccctgcttatgcacgtcattcaggttgcaagacacagaaagcttgtgccttcagtcaaggggttccttcacatgatagtggtcataaccccctttgccctttattaagccattgtccctcaactccaaacctacctttctatgctctgctctgtgatgctgggactggactctgcaaatgccacttctcctttgcccactggctcccattagagtactctagagggtgcctacaaacctggggcatcaagaaggagcagctccttccagtgtgcttctggctcctgtcaggatcaccccagcaatgctcacattgtctgtatatgccaagcaccagctcgttttccggcattgtcagagccagcttcattatgcccctccccagcagagcactggctgacctcagaggcctgagtatttgattcatgcccctcacttctaagctcttgagacaccagaaccagccaaacaaaaatctctccttagagatctgggtcccatttctgtggcgtccctcctcccaactctaggtcctgatggcctcacccttccgtttgttaccccagacacgggggtagaagcagcattctgtgggtacagccttggttgccccgatgccttctttgcctcctcagtctcagtcccatgcctgtttaaccagcttcttatattaaagtctctatgttgaaccatctagttggtttcttcctgactagaccctgaaagttaccttgttcaggttgtgggtacacctggctatgaggttccccagctgggcatgatggccctacatggcaaaggacaactccactttcggcctactgagctgactagcatcagcctccagcttcacactgagagatactgacctctgccctagcctctcgtcggatgggattgt

SEQ ID NO: 75933 - DNA, 353 bp, Homo sapiens
aagcctatgggacctataggacaccaagaagcaaacaaatatttgtgttgtgggaattctagaaggagaagaaacaagataaggtataagaaccctatttaggctggtgcaatgactcacacctgtaaccccagcaatctgggaggtcaagatgggaggattacttgagctcaggagttcaaggccagcctgggcaacatagtgagacctcatctctacaaaaactcagtcaggtatggcggcatgaactggtagtctcaactgctcaggagaatggggtgggagaactgcttgagcccagaaggtcaaggcttcagtgagctacaactgtaccaccgcactccagcctgggc

SEQ ID NO: 75934 - DNA, 4452 bp, Homo sapiens
cccgggaggaaggggaggaggccgagtgtttcctggcgcattcccggccagcccgagtgactcactcggccaaggaaactcccagggcccgcccaggacccccaagccgccgcggacgcagcccaggatggcggcccaggtgactctggaggacgcgctgtccaacgtggacctcctggaggagctgcccctgcccgaccagcagccctgcatcgagcccccgccatcctcgctgctctaccagccaaatttcaacactaactttgaagacagaaatgcatttgttactggcatcgcaagatacattgaacaagccaccgtccactctagcatgaacgagatgctggaggagggccaagaatatgctgtcatgctgtacacctggaggagctgctcccgggccatcccacaggtgaaatgtaacgagcagcctaacagagtggaaatctacgagaaaaccgtggaggttctggagcctgaggtcacaaaactgatgaatttcatgtacttccagagaaatgccattgagcgtttctgcggggaagtgaggcgcctgtgccatgccgagaggaggaaggacttcgtgtcagaagcctacctgatcacactgggcaaattcatcaacatgttcgctgtgctggacgagctgaagaacatgaagtgcagtgtgaagaacgaccactcagcgtacaagagggccgctcagtttttacgtaaaatggcagatccacagtccatccaggaatcgcagaatctgtccatgttcctggccaatcataacaagatcacacagtctctgcagcagcagctcgaagtgatttctggctacgaagagctcctggcagatattgtgaatctgtgtgtggattactacgagaacaggatgtatttgacgcccagtgagaaacacatgcttctcaaagtcatgggatttggtctgtacctgatggatgggagtgtcagtaacatctataagttggatgccaagaaaagaataaacttatccaaaatcgacaagtacttcaagcaactccaggtggttccgctatttggggacatgcaaatagaactggcaagatatatcaagaccagcgcccactacgaggaaaataaatctcgatggacgtgcacatcctccggcagcagccctcagtacaacatctgcgagcagatgatccagatccgcgaggaccacatgcgcttcatttcggagctggcgcgctacagcaacagcgaggtggtcacgggctcgggccgccaggaggcccagaagacggacgcggagtaccgcaagctcttcgacctggcgctgcagggcctgcagctgttgtcgcagtggagcgcgcacgtgatggaagtgtattcctggaagcttgtgcaccccaccgacaagtactccaacaaggactgccccgacagcgctgaagagtacgagcgtgccacgcgctacaactacaccagcgaggagaagtttgccctagtggaggtgatcgccatgatcaaaggcctgcaggtgctgatgggcaggatggagagcgtgttcaaccacgccatccggcacaccgtctatgccgcactgcaggacttctcccaggtgacccttagggagccgctgcggcaggccatcaagaagaagaagaacgtcatccagagtgtcctgcaggccatcaggaagaccgtgtgtgactgggagacggggcatgagcccttcaatgacccagccttgcggggcgagaaggaccccaagagcggcttcgacataaaagtaccacgccgcgccgtgggaccctccagcactcagctttacatggtgagaaccatgctagagtccctcattgcagacaaaagtggttccaagaaaaccttgagaagtagccttgaggggcccaccatattggacatagaaaaatttcatcgagagtcattcttctacactcacttgataaatttcagtgaaacgctgcagcagtgctgtgacctttcgcagctgtggttccgagagttcttcctggagctgaccatgggcaggaggatccagttccccattgagatgtcgatgccctggatcctgacggaccacatcctggagaccaaggaggcatcgatgatggagtacgtgctctactccctggacctgtacaatgacagcgcccactacgcgctcaccaggttcaacaagcagttcctgtacgacgaaattgaggccgaggtgaatctatgttttgaccaatttgtttacaagctagcagaccagatatttgcctattataaggttatggcaggaagtttgcttcttgataaacggttacgatcagaatgcaagaatcagggagccacgatccacctcccgccgtctaaccgctacgagacgctgctgaagcagaggcatgtgcagctcctcggcagatcaatagacctcaatcgtctgatcacccagcgcgtctcagcagccatgtataagtccctagaactggcgattggacgatttgaaagtgaagatttgacctccatagttgagctggatggcctgttggaaatcaaccgcatgacccacaagctgctgagccggtacctgacgctggacggcttcgacgccatgttccgggaggccaaccacaacgtgtcagcgccctacgggaggatcaccctgcacgtcttctgggagctcaactatgacttcctgcccaactactgctacaacggctctaccaaccggtttgttcggacagtgttaccattttctcaggaatttcaaagagataagcagcctaatgcacagcctcagtatctgcatggatccaaggctttgaacttggcctactccagcatttacggcagctaccggaacttcgtgggacctccacactttcaagtcatctgccggcttctcggctaccagggtatcgccgtggtcatggaggagctgctgaaggtcgtcaagagcctgctgcaaggcacaatcctgcagtacgtgaagacgctgatggaggtgatgcccaagatctgccgcctgccccggcacgagtacggctctcctggtatcctggagttcttccaccaccagctgaaggacatcgtggagtacgcagagctgaagacggtgtgcttccagaacctgcgggaggtggggaacgccatcctcttctgcctgctcatcgagcagagcctgtctttagaagaagtgtgtgacctgctgcacgcggctcctttccagaacatcttgccgcgagtccatgtgaaagagggggagagacttgatgccaaaatgaaaagactagaatcaaagtacgccccgctgcatcttgtcccactgattgaaagactggggacccctcagcaaattgccatcgcaagagagggggacctgctgacaaaggagcgcctctgctgcggcctgtccatgtttgaggtcatcctgacacggatccggagctttctggatgaccccatctggcgcgggcctctgcccagcaatggggtcatgcatgtggacgagtgtgtggagtttcacagactgtggagtgccatgcagtttgtctactgcattcccgtggggacacacgagttcacagtcgagcagtgctttggtgatgggctacactgggctggctgtatgatcatcgtacttcttgggcagcagcggcgttttgctgtgctggatttctgctaccatctacttaaagtccagaaacatgatggcaaagatgagattattaaaaatgtgcctttgaagaagatggtggagagaattcgcaagttccagattctcaatgatgagatcatcaccatcctggataagtacctgaagtcaggcgacggggagggcacgccagtggagcatgtgcgctgcttccagccgcccatccaccagtccctcgccagcagctgagggcacgcgctgcactccgtaactcaacatggcatgcctttctctccgtaaactatttagtgagatttttagggactatttttcagtatctctgtacctgttaaagggggtgcttttcgatctaaaaacttaattttataaaattgacttatttttctagactaaaattgtatatgcttttggtaattaggaactcttgagaatattggctgctgattgttgccatcacgttcctacaaaattgtttttctatgggatgttctggcagctgtgtcataaaatgctgctgggttcattcattcattccataagaaacttaataccagcaaatgcattaaatcccttgccagttaccattaactgtaactatttagcttttgtttagggatctttctgatggtcttttatgagcaatcttagttctaagtcattgttcccatcccttttttgtgtgtttcagaaaatagtgaacttgattcccctgcttccactaaatccagttgtgacaaaatctaacgtgacatcagatcgaaaggttatagaaataaaactaatgagatcta

SEQ ID NO: 75935 - DNA, 794 bp, Homo sapiens
gggctaggtagcgaggctgggtgggctctaccaaccgtttgttcggacagtgttaccattttctcaggaatttcaaagagataagcagcctaatgcacagcctcagtatctgcatggatccaaggctttgaacttggcctactccagcatttacggcagctaccggaacttcgtgggacctccacactttcaagtcatctgccggcttctcggctaccagggtatcgccgtggtcatggaggagctgctgaaggtcgtcaagagcctgctgcaaggcacaatcctgcagtacgtgaagacgctgatggaggtgatgcccaagatctgccgcctgccccggcacgagtacggctctcctggtatcctggagttcttccaccaccagctgaaggacatcgtggagtacgcagagctgaagacggtgtgcttccagaacctgcgggaggtggggaacgccatcctcttctgcctgctcatcgagcagagcctgtctttagaagaagtgtgtgacctgctgcacgcggctcctttccagaacatcttgccgcgagtccatgtgaaagagggggagagacttgatgccaaaatgaaaagactagaatcaaagtacgccccgctgcatcttgtcccactgattgaaagactggggacccctcagcaaattgccatcgcaagagagggggacctgctgacaaaggagcgcctctgctgcggcctgtccatgtttgaggtctctgaccgatcggggttctggtggccctcgggcggcctgccgcggggcggtgtgcccgggg

SEQ ID NO: 75936 - DNA, 1880 bp, Homo sapiens
tccttatgccagaaaaattcgagttcttccctatctattctgaaatgtaccataaattattttaattaatagtcaccctaactgatctatctaacactgtcttatttctaatatcagactgtacatttgtacccattaatgtcgcttcacgccctgcatttttaagataacattttctctttggagctccagccatcaatgtcttttgttgaacattagtaaattatttctggtgccatataaagatttggatacctgtaagcaatgaaagattttcccttttgtgatttattttgatcacataaaaattatcaaattggaagagtacatggtcatttgaaaggcaaaatctttatttacttacttattattttattttttgtagagatgaggcctcactatattgctcaggctgatcttgaactcttgggctcaagtgatcctcctgcctcaacctcccaagtgctggggtcataggcatgagccactgtgcctggcccagaatcctttttaaaatgatgatgaaatgccagagtcttagatactcagcactcactatccaggccattttgccgggtagattttttaaacgagaggttacagggccagggtcttttgcccatctgtggagatggacggtgtgtgcgccctcatgtgtgactttcagaatgcagcaaaggtttgaaggctggcctggctttggccaccatcgtgtgagtcagaccagaagccaggcgttttgcatgcaatatggaacacctctgctctttcggccaccacagtattcctggaagcttgtgcaccccaccgacaagtactccaacaaggactgccccgacagcgctgaagagtacgagcgtgccacgcgctacaactacaccagcgaggagaagtttgccctagtggaggtgaggatgctcggccgctcgctcttcctcatgtcgctctagcttcacaccatcttctctgtcaaaagcaaaaacatgaacaaaactgcctgtttactcattgcttctgtgtgggcacccctttccatctggcagagtagtcagagtagaacgcattagagaaacagtggttgtcggtcctgggtctgcactgaagctccctgggtgcgaatctggactcctggacctgcgtctggatggagagcagtgtcgggtgcggggaagggaggtgaaagagatgtggcccctgctgagagagaagagctgtcttgctctcctgtgaggcaggcgctgcactcccctcgtgagcctttccatgggcagctcttcattccagcatcaactggtatcttttctttcatagctgtgcttttcctgtgctgtttgagaaatctttgcatactctcaggtcgtgaaggtattctgcattgctttctggatacttcactctgctttcacactgagatgcgaaattcacctgaaattcatttttgaaacaattccgtccaaccctcacgctgccacctttgtagctggtcacgtgacaatgcatgtgtggctgtgtttctgctctgctctaacccagtgtcagttgctgtcggtatcccagcaccactctgtagctttgtagtcatctaccgtgtatgagaaagcacgtctttctgtctcctagacttccttggctattcttccccactgtagtttcatattcattttagaatcagcttttcccatcccacagtgaggattttaatcaggatatgaacaatcctatggatcatgacaggagaattgacagaagtctcatacagttggccctcagtgttcttgggttccacctccatgaaccaaccttgggtcaaaaatgttcagaaagaaaaaataacactacaacagtgaaaagtaataaaaatgttaaaaaccactgttttg

SEQ ID NO: 75937 - DNA, 317 bp, Homo sapiens
attgaagcccgttgcaagagctgactctttggagcgcctgtgccatgccgagaggaggaaggacttcgtgtcagaagcctacctgatcacactgggcaaattcatcaacatgttcgctgtgctggacgagctgaagaacatgaagtgcagtgtgaagaacgaccactcagcgtacaagagggccgctcagtttttacgtaaaatggcagatccacagtccatccaggaatcgcagaatctgtccatgttcctggccaatcataacaagatcacacagtctctgccatgagcttttcgtagcctgaaatcacttcgag

SEQ ID NO: 75938 - DNA, 4432 bp, Homo sapiens
tcacggacgccaccaaatatgtctaggtcgtggctgggtgttattcaggccgtggactctcccatggtcctacctggactcccatgccggcggttactcagcccaggatggcggcccaggtgactctggaggacgcgctgtccaacgtggacctcctggaggagctgcccctgcccgaccagcagccctgcatcgagcccccgccatcctcgctgctctaccagccaaatttcaacactaactttgaagacagaaatgcatttgttactggcatcgcaagatacattgaacaagccaccgtccactctagcatgaacgagatgctggaggagggccaagaatatgctgtcatgctgtacacctggaggagctgctcccgggccatcccacaggtgaaatgtaacgagcagcctaacagagtggaaatctacgagaaaaccgtggaggttctggagcctgaggtcacaaaactgatgaatttcatgtacttccagagaaatgccattgagcgtttctgcggggaagtgaggcgcctgtgccatgccgagaggaggaaggacttcgtgtcagaagcctacctgatcacactgggcaaattcatcaacatgttcgctgtgctggacgagctgaagaacatgaagtgcagtgtgaagaacgaccactcagcgtacaagagggccgctcagtttttacgtaaaatggcagatccacagtccatccaggaatcgcagaatctgtccatgttcctggccaatcataacaagatcacacagtctctgcagcagcagctcgaagtgatttctggctacgaagagctcctggcagatattgtgaatctgtgtgtggattactacgagaacaggatgtatttgacgcccagtgagaaacacatgcttctcaaagtcatgggatttggtctgtacctgatggatgggagtgtcagtaacatctataagttggatgccaagaaaagaataaacttatccaaaatcgacaagtacttcaagcaactccaggtggttccgctatttggggacatgcaaatagaactggcaagatatatcaagaccagcgcccactacgaggaaaataaatctcgatggacgtgcacatcctccggcagcagccctcagtacaacatctgcgagcagatgatccagatccgcgaggaccacatgcgcttcatttcggagctggcgcgctacagcaacagcgaggtggtcacgggctcgggccgccaggaggcccagaagacggacgcggagtaccgcaagctcttcgacctggcgctgcagggcctgcagctgttgtcgcagtggagcgcgcacgtgatggaagtgtattcctggaagcttgtgcaccccaccgacaagtactccaacaaggactgccccgacagcgctgaagagtacgagcgtgccacgcgctacaactacaccagcgaggagaagtttgccctagtggaggtgatcgccatgatcaaaggcctgcaggtgctgatgggcaggatggagagcgtgttcaaccacgccatccggcacaccgtctatgccgcactgcaggacttctcccaggtgacccttagggagccgctgcggcaggccatcaagaagaagaagaacgtcatccagagtgtcctgcaggccatcaggaagaccgtgtgtgactgggagacggggcatgagcccttcaatgacccagccttgcggggcgagaaggaccccaagagcggcttcgacataaaagtaccacgccgcgccgtgggaccctccagcactcagctttacatggtgagaaccatgctagagtccctcattgcagacaaaagtggttccaagaaaaccttgagaagtagccttgaggggcccaccatattggacatagaaaaatttcatcgagagtcattcttctacactcacttgataaatttcagtgaaacgctgcagcagtgctgtgacctttcgcagctgtggttccgagagttcttcctggagctgaccatgggcaggaggatccagttccccattgagatgtcgatgccctggatcctgacggaccacatcctggagaccaaggaggcatcgatgatggagtacgtgctctactccctggacctgtacaatgacagcgcccactacgcgctcaccaggttcaacaagcagttcctgtacgacgaaattgaggccgaggtgaatctatgttttgaccaatttgtttacaagctagcagaccagatatttgcctattataaggttatggcaggaagtttgcttcttgataaacggttacgatcagaatgcaagaatcagggagccacgatccacctcccgccgtctaaccgctacgagacgctgctgaagcagaggcatgtgcagctcctcggcagatcaatagacctcaatcgtctgatcacccagcgcgtctcagcagccatgtataagtccctagaactggcgattggacgatttgaaagtgaagatttgacctccatagttgagctggatggcctgttggaaatcaaccgcatgacccacaagctgctgagccggtacctgacgctggacggcttcgacgccatgttccgggaggccaaccacaacgtgtcagcgccctacgggaggatcaccctgcacgtcttctgggagctcaactatgacttcctgcccaactactgctacaacggctctaccaaccggtttgttcggacagtgttaccattttctcaggaatttcaaagagataagcagcctaatgcacagcctcagtatctgcatggatccaaggctttgaacttggcctactccagcatttacggcagctaccggaacttcgtgggacctccacactttcaagtcatctgccggcttctcggctaccagggtatcgccgtggtcatggaggagctgctgaaggtcgtcaagagcctgctgcaaggcacaatcctgcagtacgtgaagacgctgatggaggtgatgcccaagatctgccgcctgccccggcacgagtacggctctcctggtatcctggagttcttccaccaccagctgaaggacatcgtggagtacgcagagctgaagacggtgtgcttccagaacctgcgggaggtggggaacgccatcctcttctgcctgctcatcgagcagagcctgtctttagaagaagtgtgtgacctgctgcacgcggctcctttccagaacatcttgccgcgagtccatgtgaaagagggggagagacttgatgccaaaatgaaaagactagaatcaaagtacgccccgctgcatcttgtcccactgattgaaagactggggacccctcagcaaattgccatcgcaagagagggggacctgctgacaaaggagcgcctctgctgcggcctgtccatgtttgaggtcatcctgacacggatccggagctttctggatgaccccatctggcgcgggcctctgcccagcaatggggtcatgcatgtggacgagtgtgtggagtttcacagactgtggagtgccatgcagtttgtctactgcattcccgtggggacacacgagttcacagtcgagcagtgctttggtgatgggctacactgggctggctgtatgatcatcgtacttcttgggcagcagcggcgttttgctgtgctggatttctgctaccatctacttaaagtccagaaacatgatggcaaagatgagattattaaaaatgtgcctttgaagaagatggtggagagaattcgcaagttccagattctcaatgatgagatcatcaccatcctggataagtacctgaagtcaggcgacggggagggcacgccagtggagcatgtgcgctgcttccagccgcccatccaccagtccctcgccagcagctgagggcacgcgctgcactccgtaactcaacatggcatgcctttctctccgtaaactatttagtgagatttttagggactatttttcagtatctctgtacctgttaaagggggtgcttttcgatctaaaaacttaattttataaaattgacttatttttctagactaaaattgtatatgcttttggtaattaggaactcttgagaatattggctgctgattgttgccatcacgttcctacaaaattgtttttctatgggatgttctggcagctgtgtcataaaatgctgctgggttcattcattcattccataagaaacttaataccagcaaatgcattaaatcccttgccagttaccattaactgtaactatttagcttttgtttagggatctttctgatggtcttttatgagcaatcttagttctaagtcattgttcccatcccttttttgtgtgtttcagaaaatagtgaacttgattcccctgcttccactaaatccagttgtgacaaaatctaacgtgacatcagatcgaaaggttatagaaataaaactaatgagatcta

SEQ ID NO: 75939 - DNA, 4525 bp, Homo sapiens
tcagttcctgagaaaatgggtggcgtctccagccgccattggggattggcctgcaattgtttccatgtatctgtggaaccggcccaacaccccgcgtggatgcctgagcctggagactgtactgaaccctgcgtagtctatgtttttccgtacttgcataccagtgacgaactttaattggtaaattaggcacgcccaggatggcggcccaggtgactctggaggacgcgctgtccaacgtggacctcctggaggagctgcccctgcccgaccagcagccctgcatcgagcccccgccatcctcgctgctctaccagccaaatttcaacactaactttgaagacagaaatgcatttgttactggcatcgcaagatacattgaacaagccaccgtccactctagcatgaacgagatgctggaggagggccaagaatatgctgtcatgctgtacacctggaggagctgctcccgggccatcccacaggtgaaatgtaacgagcagcctaacagagtggaaatctacgagaaaaccgtggaggttctggagcctgaggtcacaaaactgatgaatttcatgtacttccagagaaatgccattgagcgtttctgcggggaagtgaggcgcctgtgccatgccgagaggaggaaggacttcgtgtcagaagcctacctgatcacactgggcaaattcatcaacatgttcgctgtgctggacgagctgaagaacatgaagtgcagtgtgaagaacgaccactcagcgtacaagagggccgctcagtttttacgtaaaatggcagatccacagtccatccaggaatcgcagaatctgtccatgttcctggccaatcataacaagatcacacagtctctgcagcagcagctcgaagtgatttctggctacgaagagctcctggcagatattgtgaatctgtgtgtggattactacgagaacaggatgtatttgacgcccagtgagaaacacatgcttctcaaagtcatgggatttggtctgtacctgatggatgggagtgtcagtaacatctataagttggatgccaagaaaagaataaacttatccaaaatcgacaagtacttcaagcaactccaggtggttccgctatttggggacatgcaaatagaactggcaagatatatcaagaccagcgcccactacgaggaaaataaatctcgatggacgtgcacatcctccggcagcagccctcagtacaacatctgcgagcagatgatccagatccgcgaggaccacatgcgcttcatttcggagctggcgcgctacagcaacagcgaggtggtcacgggctcgggccgccaggaggcccagaagacggacgcggagtaccgcaagctcttcgacctggcgctgcagggcctgcagctgttgtcgcagtggagcgcgcacgtgatggaagtgtattcctggaagcttgtgcaccccaccgacaagtactccaacaaggactgccccgacagcgctgaagagtacgagcgtgccacgcgctacaactacaccagcgaggagaagtttgccctagtggaggtgatcgccatgatcaaaggcctgcaggtgctgatgggcaggatggagagcgtgttcaaccacgccatccggcacaccgtctatgccgcactgcaggacttctcccaggtgacccttagggagccgctgcggcaggccatcaagaagaagaagaacgtcatccagagtgtcctgcaggccatcaggaagaccgtgtgtgactgggagacggggcatgagcccttcaatgacccagccttgcggggcgagaaggaccccaagagcggcttcgacataaaagtaccacgccgcgccgtgggaccctccagcactcagctttacatggtgagaaccatgctagagtccctcattgcagacaaaagtggttccaagaaaaccttgagaagtagccttgaggggcccaccatattggacatagaaaaatttcatcgagagtcattcttctacactcacttgataaatttcagtgaaacgctgcagcagtgctgtgacctttcgcagctgtggttccgagagttcttcctggagctgaccatgggcaggaggatccagttccccattgagatgtcgatgccctggatcctgacggaccacatcctggagaccaaggaggcatcgatgatggagtacgtgctctactccctggacctgtacaatgacagcgcccactacgcgctcaccaggttcaacaagcagttcctgtacgacgaaattgaggccgaggtgaatctatgttttgaccaatttgtttacaagctagcagaccagatatttgcctattataaggttatggcaggaagtttgcttcttgataaacggttacgatcagaatgcaagaatcagggagccacgatccacctcccgccgtctaaccgctacgagacgctgctgaagcagaggcatgtgcagctcctcggcagatcaatagacctcaatcgtctgatcacccagcgcgtctcagcagccatgtataagtccctagaactggcgattggacgatttgaaagtgaagatttgacctccatagttgagctggatggcctgttggaaatcaaccgcatgacccacaagctgctgagccggtacctgacgctggacggcttcgacgccatgttccgggaggccaaccacaacgtgtcagcgccctacgggaggatcaccctgcacgtcttctgggagctcaactatgacttcctgcccaactactgctacaacggctctaccaaccggtttgttcggacagtgttaccattttctcaggaatttcaaagagataagcagcctaatgcacagcctcagtatctgcatggatccaaggctttgaacttggcctactccagcatttacggcagctaccggaacttcgtgggacctccacactttcaagtcatctgccggcttctcggctaccagggtatcgccgtggtcatggaggagctgctgaaggtcgtcaagagcctgctgcaaggcacaatcctgcagtacgtgaagacgctgatggaggtgatgcccaagatctgccgcctgccccggcacgagtacggctctcctggtatcctggagttcttccaccaccagctgaaggacatcgtggagtacgcagagctgaagacggtgtgcttccagaacctgcgggaggtggggaacgccatcctcttctgcctgctcatcgagcagagcctgtctttagaagaagtgtgtgacctgctgcacgcggctcctttccagaacatcttgccgcgagtccatgtgaaagagggggagagacttgatgccaaaatgaaaagactagaatcaaagtacgccccgctgcatcttgtcccactgattgaaagactggggacccctcagcaaattgccatcgcaagagagggggacctgctgacaaaggagcgcctctgctgcggcctgtccatgtttgaggtcatcctgacacggatccggagctttctggatgaccccatctggcgcgggcctctgcccagcaatggggtcatgcatgtggacgagtgtgtggagtttcacagactgtggagtgccatgcagtttgtctactgcattcccgtggggacacacgagttcacagtcgagcagtgctttggtgatgggctacactgggctggctgtatgatcatcgtacttcttgggcagcagcggcgttttgctgtgctggatttctgctaccatctacttaaagtccagaaacatgatggcaaagatgagattattaaaaatgtgcctttgaagaagatggtggagagaattcgcaagttccagattctcaatgatgagatcatcaccatcctggataagtacctgaagtcaggcgacggggagggcacgccagtggagcatgtgcgctgcttccagccgcccatccaccagtccctcgccagcagctgagggcacgcgctgcactccgtaactcaacatggcatgcctttctctccgtaaactatttagtgagatttttagggactatttttcagtatctctgtacctgttaaagggggtgcttttcgatctaaaaacttaattttataaaattgacttatttttctagactaaaattgtatatgcttttggtaattaggaactcttgagaatattggctgctgattgttgccatcacgttcctacaaaattgtttttctatgggatgttctggcagctgtgtcataaaatgctgctgggttcattcattcattccataagaaacttaataccagcaaatgcattaaatcccttgccagttaccattaactgtaactatttagcttttgtttagggatctttctgatggtcttttatgagcaatcttagttctaagtcattgttcccatcccttttttgtgtgtttcagaaaatagtgaacttgattcccctgcttccactaaatccagttgtgacaaaatctaacgtgacatcagatcgaaaggttatagaaataaaactaatgagatcta

SEQ ID NO: 75940 - DNA, 3816 bp, Homo sapiens
agttcgacggagactctcccctaccgcttgggttaggctaggggagaggatttgttttttccgcttttagcgactgacctggaagcccagccccgctttgtatcccagtttcactgaggataaaatgatgcatttcaagcaccagacaagcagcctaaagatagatctttgtgatctatttcaaattgtgccttcaaagtcatcagctgtaacagtgtaagtccttatgggtagtgaaattctcagttctgagctttgtcgcatcattcattttgtggcttttcaggtcatgggatttggtctgtacctgatggatgggagtgtcagtaacatctataagttggatgccaagaaaagaataaacttatccaaaatcgacaagtacttcaagcaactccaggtggttccgctatttggggacatgcaaatagaactggcaagatatatcaagaccagcgcccactacgaggaaaataaatctcgatggacgtgcacatcctccggcagcagccctcagtacaacatctgcgagcagatgatccagatccgcgaggaccacatgcgcttcatttcggagctggcgcgctacagcaacagcgaggtggtcacgggctcgggccgccaggaggcccagaagacggacgcggagtaccgcaagctcttcgacctggcgctgcagggcctgcagctgttgtcgcagtggagcgcgcacgtgatggaagtgtattcctggaagcttgtgcaccccaccgacaagtactccaacaaggactgccccgacagcgctgaagagtacgagcgtgccacgcgctacaactacaccagcgaggagaagtttgccctagtggaggtgatcgccatgatcaaaggcctgcaggtgctgatgggcaggatggagagcgtgttcaaccacgccatccggcacaccgtctatgccgcactgcaggacttctcccaggtgacccttagggagccgctgcggcaggccatcaagaagaagaagaacgtcatccagagtgtcctgcaggccatcaggaagaccgtgtgtgactgggagacggggcatgagcccttcaatgacccagccttgcggggcgagaaggaccccaagagcggcttcgacataaaagtaccacgccgcgccgtgggaccctccagcactcagctttacatggtgagaaccatgctagagtccctcattgcagacaaaagtggttccaagaaaaccttgagaagtagccttgaggggcccaccatattggacatagaaaaatttcatcgagagtcattcttctacactcacttgataaatttcagtgaaacgctgcagcagtgctgtgacctttcgcagctgtggttccgagagttcttcctggagctgaccatgggcaggaggatccagttccccattgagatgtcgatgccctggatcctgacggaccacatcctggagaccaaggaggcatcgatgatggagtacgtgctctactccctggacctgtacaatgacagcgcccactacgcgctcaccaggttcaacaagcagttcctgtacgacgaaattgaggccgaggtgaatctatgttttgaccaatttgtttacaagctagcagaccagatatttgcctattataaggttatggcaggaagtttgcttcttgataaacggttacgatcagaatgcaagaatcagggagccacgatccacctcccgccgtctaaccgctacgagacgctgctgaagcagaggcatgtgcagctcctcggcagatcaatagacctcaatcgtctgatcacccagcgcgtctcagcagccatgtataagtccctagaactggcgattggacgatttgaaagtgaagatttgacctccatagttgagctggatggcctgttggaaatcaaccgcatgacccacaagctgctgagccggtacctgacgctggacggcttcgacgccatgttccgggaggccaaccacaacgtgtcagcgccctacgggaggatcaccctgcacgtcttctgggagctcaactatgacttcctgcccaactactgctacaacggctctaccaaccggtttgttcggacagtgttaccattttctcaggaatttcaaagagataagcagcctaatgcacagcctcagtatctgcatggatccaaggctttgaacttggcctactccagcatttacggcagctaccggaacttcgtgggacctccacactttcaagtcatctgccggcttctcggctaccagggtatcgccgtggtcatggaggagctgctgaaggtcgtcaagagcctgctgcaaggcacaatcctgcagtacgtgaagacgctgatggaggtgatgcccaagatctgccgcctgccccggcacgagtacggctctcctggtatcctggagttcttccaccaccagctgaaggacatcgtggagtacgcagagctgaagacggtgtgcttccagaacctgcgggaggtggggaacgccatcctcttctgcctgctcatcgagcagagcctgtctttagaagaagtgtgtgacctgctgcacgcggctcctttccagaacatcttgccgcgagtccatgtgaaagagggggagagacttgatgccaaaatgaaaagactagaatcaaagtacgccccgctgcatcttgtcccactgattgaaagactggggacccctcagcaaattgccatcgcaagagagggggacctgctgacaaaggagcgcctctgctgcggcctgtccatgtttgaggtcatcctgacacggatccggagctttctggatgaccccatctggcgcgggcctctgcccagcaatggggtcatgcatgtggacgagtgtgtggagtttcacagactgtggagtgccatgcagtttgtctactgcattcccgtggggacacacgagttcacagtcgagcagtgctttggtgatgggctacactgggctggctgtatgatcatcgtacttcttgggcagcagcggcgttttgctgtgctggatttctgctaccatctacttaaagtccagaaacatgatggcaaagatgagattattaaaaatgtgcctttgaagaagatggtggagagaattcgcaagttccagattctcaatgatgagatcatcaccatcctggataagtacctgaagtcaggcgacggggagggcacgccagtggagcatgtgcgctgcttccagccgcccatccaccagtccctcgccagcagctgagggcacgcgctgcactccgtaactcaacatggcatgcctttctctccgtaaactatttagtgagatttttagggactatttttcagtatctctgtacctgttaaagggggtgcttttcgatctaaaaacttaattttataaaattgacttatttttctagactaaaattgtatatgcttttggtaattaggaactcttgagaatattggctgctgattgttgccatcacgttcctacaaaattgtttttctatgggatgttctggcagctgtgtcataaaatgctgctgggttcattcattcattccataagaaacttaataccagcaaatgcattaaatcccttgccagttaccattaactgtaactatttagcttttgtttagggatctttctgatggtcttttatgagcaatcttagttctaagtcattgttcccatcccttttttgtgtgtttcagaaaatagtgaacttgattcccctgcttccactaaatccagttgtgacaaaatctaacgtgacatcagatcgaaaggttatagaaataaaactaatgagatcta

SEQ ID NO: 75941 - DNA, 3874 bp, Homo sapiens
tccttatgccagaaaaattcgagttcttccctatctattctgaaatgtaccataaattattttaattaatagtcaccctaactgatctatctaacactgtcttatttctaatatcagactgtacatttgtacccattaatgtcgcttcacgccctgcatttttaagataacattttctctttggagctccagccatcaatgtcttttgttgaacattagtaaattatttctggtgccatataaagatttggatacctgtaagcaatgaaagattttcccttttgtgatttattttgatcacataaaaattatcaaattggaagagtacatggtcatttgaaaggcaaaatctttatttacttacttattattttattttttgtagagatgaggcctcactatattgctcaggctgatcttgaactcttgggctcaagtgatcctcctgcctcaacctcccaagtgctggggtcataggcatgagccactgtgcctggcccagaatcctttttaaaatgatgatgaaatgccagagtcttagatactcagcactcactatccaggccattttgccgggtagattttttaaacgagaggttacagggccagggtcttttgcccatctgtggagatggacggtgtgtgcgccctcatgtgtgactttcagaatgcagcaaaggtttgaaggctggcctggctttggccaccatcgtgtgagtcagaccagaagccaggcgttttgcatgcaatatggaacacctctgctctttcggccaccacagtattcctggaagcttgtgcaccccaccgacaagtactccaacaaggactgccccgacagcgctgaagagtacgagcgtgccacgcgctacaactacaccagcgaggagaagtttgccctagtggaggtgatcgccatgatcaaaggcctgcaggtgctgatgggcaggatggagagcgtgttcaaccacgccatccggcacaccgtctatgccgcactgcaggacttctcccaggtgacccttagggagccgctgcggcaggccatcaagaagaagaagaacgtcatccagagtgtcctgcaggccatcaggaagaccgtgtgtgactgggagacggggcatgagcccttcaatgacccagccttgcggggcgagaaggaccccaagagcggcttcgacataaaagtaccacgccgcgccgtgggaccctccagcactcagctttacatggtgagaaccatgctagagtccctcattgcagacaaaagtggttccaagaaaaccttgagaagtagccttgaggggcccaccatattggacatagaaaaatttcatcgagagtcattcttctacactcacttgataaatttcagtgaaacgctgcagcagtgctgtgacctttcgcagctgtggttccgagagttcttcctggagctgaccatgggcaggaggatccagttccccattgagatgtcgatgccctggatcctgacggaccacatcctggagaccaaggaggcatcgatgatggagtacgtgctctactccctggacctgtacaatgacagcgcccactacgcgctcaccaggttcaacaagcagttcctgtacgacgaaattgaggccgaggtgaatctatgttttgaccaatttgtttacaagctagcagaccagatatttgcctattataaggttatggcaggaagtttgcttcttgataaacggttacgatcagaatgcaagaatcagggagccacgatccacctcccgccgtctaaccgctacgagacgctgctgaagcagaggcatgtgcagctcctcggcagatcaatagacctcaatcgtctgatcacccagcgcgtctcagcagccatgtataagtccctagaactggcgattggacgatttgaaagtgaagatttgacctccatagttgagctggatggcctgttggaaatcaaccgcatgacccacaagctgctgagccggtacctgacgctggacggcttcgacgccatgttccgggaggccaaccacaacgtgtcagcgccctacgggaggatcaccctgcacgtcttctgggagctcaactatgacttcctgcccaactactgctacaacggctctaccaaccggtttgttcggacagtgttaccattttctcaggaatttcaaagagataagcagcctaatgcacagcctcagtatctgcatggatccaaggctttgaacttggcctactccagcatttacggcagctaccggaacttcgtgggacctccacactttcaagtcatctgccggcttctcggctaccagggtatcgccgtggtcatggaggagctgctgaaggtcgtcaagagcctgctgcaaggcacaatcctgcagtacgtgaagacgctgatggaggtgatgcccaagatctgccgcctgccccggcacgagtacggctctcctggtatcctggagttcttccaccaccagctgaaggacatcgtggagtacgcagagctgaagacggtgtgcttccagaacctgcgggaggtggggaacgccatcctcttctgcctgctcatcgagcagagcctgtctttagaagaagtgtgtgacctgctgcacgcggctcctttccagaacatcttgccgcgagtccatgtgaaagagggggagagacttgatgccaaaatgaaaagactagaatcaaagtacgccccgctgcatcttgtcccactgattgaaagactggggacccctcagcaaattgccatcgcaagagagggggacctgctgacaaaggagcgcctctgctgcggcctgtccatgtttgaggtcatcctgacacggatccggagctttctggatgaccccatctggcgcgggcctctgcccagcaatggggtcatgcatgtggacgagtgtgtggagtttcacagactgtggagtgccatgcagtttgtctactgcattcccgtggggacacacgagttcacagtcgagcagtgctttggtgatgggctacactgggctggctgtatgatcatcgtacttcttgggcagcagcggcgttttgctgtgctggatttctgctaccatctacttaaagtccagaaacatgatggcaaagatgagattattaaaaatgtgcctttgaagaagatggtggagagaattcgcaagttccagattctcaatgatgagatcatcaccatcctggataagtacctgaagtcaggcgacggggagggcacgccagtggagcatgtgcgctgcttccagccgcccatccaccagtccctcgccagcagctgagggcacgcgctgcactccgtaactcaacatggcatgcctttctctccgtaaactatttagtgagatttttagggactatttttcagtatctctgtacctgttaaagggggtgcttttcgatctaaaaacttaattttataaaattgacttatttttctagactaaaattgtatatgcttttggtaattaggaactcttgagaatattggctgctgattgttgccatcacgttcctacaaaattgtttttctatgggatgttctggcagctgtgtcataaaatgctgctgggttcattcattcattccataagaaacttaataccagcaaatgcattaaatcccttgccagttaccattaactgtaactatttagcttttgtttagggatctttctgatggtcttttatgagcaatcttagttctaagtcattgttcccatcccttttttgtgtgtttcagaaaatagtgaacttgattcccctgcttccactaaatccagttgtgacaaaatctaacgtgacatcagatcgaaaggttatagaaataaaactaatgagatcta

SEQ ID NO: 75942 - DNA, 4795 bp, Homo sapiens
  misc_feature (4464)..(4464): n is a, c, g, or t
  misc_feature (4470)..(4470): n is a, c, g, or t
  misc_feature (4501)..(4501): n is a, c, g, or t
  misc_feature (4511)..(4512): n is a, c, g, or t
cccgggaggaaggggaggaggccgagtgtttcctggcgcattcccggccagcccgagtgactcactcggccaaggaaactcccagggcccgcccaggacccccaagccgccgcggacgcagcccaggatggcggcccaggtgactctggaggacgcgctgtccaacgtggacctcctggaggagctgcccctgcccgaccagcagccctgcatcgagcccccgccatcctcgctgctctaccagccaaatttcaacactaactttgaagacagaaatgcatttgttactggcatcgcaagatacattgaacaagccaccgtccactctagcatgaacgagatgctggaggagggccaagaatatgctgtcatgctgtacacctggaggagctgctcccgggccatcccacaggtgaaatgtaacgagcagcctaacagagtggaaatctacgagaaaaccgtggaggttctggagcctgaggtcacaaaactgatgaatttcatgtacttccagagaaatgccattgagcgtttctgcggggaagtgaggcgcctgtgccatgccgagaggaggaaggacttcgtgtcagaagcctacctgatcacactgggcaaattcatcaacatgttcgctgtgctggacgagctgaagaacatgaagtgcagtgtgaagaacgaccactcagcgtacaagagggccgctcagtttttacgtaaaatggcagatccacagtccatccaggaatcgcagaatctgtccatgttcctggccaatcataacaagatcacacagtctctgcagcagcagctcgaagtgatttctggctacgaagagctcctggcagatattgtgaatctgtgtgtggattactacgagaacaggatgtatttgacgcccagtgagaaacacatgcttctcaaagtcatgggatttggtctgtacctgatggatgggagtgtcagtaacatctataagttggatgccaagaaaagaataaacttatccaaaatcgacaagtacttcaagcaactccaggtggttccgctatttggggacatgcaaatagaactggcaagatatatcaagaccagcgcccactacgaggaaaataaatctcgatggacgtgcacatcctccggcagcagccctcagtacaacatctgcgagcagatgatccagatccgcgaggaccacatgcgcttcatttcggagctggcgcgctacagcaacagcgaggtggtcacgggctcgggccgccaggaggcccagaagacggacgcggagtaccgcaagctcttcgacctggcgctgcagggcctgcagctgttgtcgcagtggagcgcgcacgtgatggaagtgtattcctggaagcttgtgcaccccaccgacaagtactccaacaaggactgccccgacagcgctgaagagtacgagcgtgccacgcgctacaactacaccagcgaggagaagtttgccctagtggaggtgatcgccatgatcaaaggcctgcaggtgctgatgggcaggatggagagcgtgttcaaccacgccatccggcacaccgtctatgccgcactgcaggacttctcccaggtgacccttagggagccgctgcggcaggccatcaagaagaagaagaacgtcatccagagtgtcctgcaggccatcaggaagaccgtgtgtgactgggagacggggcatgagcccttcaatgacccagccttgcggggcgagaaggaccccaagagcggcttcgacataaaagtaccacgccgcgccgtgggaccctccagcactcagctttacatggtgagaaccatgctagagtccctcattgcagacaaaagtggttccaagaaaaccttgagaagtagccttgaggggcccaccatattggacatagaaaaatttcatcgagagtcattcttctacactcacttgataaatttcagtgaaacgctgcagcagtgctgtgacctttcgcagctgtggttccgagagttcttcctggagctgaccatgggcaggaggatccagttccccattgagatgtcgatgccctggatcctgacggaccacatcctggagaccaaggaggcatcgatgatggagtacgtgctctactccctggacctgtacaatgacagcgcccactacgcgctcaccaggttcaacaagcagttcctgtacgacgaaattgaggccgaggtgaatctatgttttgaccaatttgtttacaagctagcagaccagatatttgcctattataaggttatggcaggaagtttgcttcttgataaacggttacgatcagaatgcaagaatcagggagccacgatccacctcccgccgtctaaccgctacgagacgctgctgaagcagaggcatgtgcagctcctcggcagatcaatagacctcaatcgtctgatcacccagcgcgtctcagcagccatgtataagtccctagaactggcgattggacgatttgaaagtgaagatttgacctccatagttgagctggatggcctgttggaaatcaaccgcatgacccacaagctgctgagccggtacctgacgctggacggcttcgacgccatgttccgggaggccaaccacaacgtgtcagcgccctacgggaggatcaccctgcacgtcttctgggagctcaactatgacttcctgcccaactactgctacaacggctctaccaaccggtttgttcggacagtgttaccattttctcaggaatttcaaagagataagcagcctaatgcacagcctcagtatctgcatggatccaaggctttgaacttggcctactccagcatttacggcagctaccggaacttcgtgggacctccacactttcaagtcatctgccggcttctcggctaccagggtatcgccgtggtcatggaggagctgctgaaggtcgtcaagagcctgctgcaaggcacaatcctgcagtacgtgaagacgctgatggaggtgatgcccaagatctgccgcctgccccggcacgagtacggctctcctggtatcctggagttcttccaccaccagctgaaggacatcgtggagtacgcagagctgaagacggtgtgcttccagaacctgcgggaggtggggaacgccatcctcttctgcctgctcatcgagcagagcctgtctttagaagaagtgtgtgacctgctgcacgcggctcctttccagaacatcttgccgcgagtccatgtgaaagagggggagagacttgatgccaaaatgaaaagactagaatcaaagtacgccccgctgcatcttgtcccactgattgaaagactggggacccctcagcaaattgccatcgcaagagagggggacctgctgacaaaggagcgcctctgctgcggcctgtccatgtttgaggtcatcctgacacggatccggagctttctggatgaccccatctggcgcgggcctctgcccagcaatggggtcatgcatgtggacgagtgtgtggagtttcacagactgtggagtgccatgcagtttgtctactgcattcccgtggggacacacgagttcacagtcgagcagtgctttggtgatgggctacactgggctggctgtatgatcatcgtacttcttgggcagcagcggcgttttgctgtgctggatttctgctaccatctacttaaagtccagaaacatgatggcaaagatgagattattaaaaatgtgcctttgaagaagatggtggagagaattcgcaagttccagattctcaatgatgagatcatcaccatcctggataagtacctgaagtcaggcgacggggagggcacgccagtggagcatgtgcgctgcttccagccgcccatccaccagtccctcgccagcagctgagggcacgcgctgcactccgtaactcaacatggcatgcctttctctccgtaaactatttagtgagatttttagggactatttttcagtatctctgtacctgttaaagggggtgcttttcgatctaaaaacttaattttataaaattgacttatttttctagactaaaattgtatatgcttttggtaattaggaactcttgagaatattggctgctgattgttgccatcacgttcctacaaaattgtttttctatgggatgttctggcagctgtgtcataaaatgctgctgggttcattcattcattccataagaaacttaataccagcaaatgcattaaatcccttgccagttaccattaactgtaactatttagcttttgtttagggatctttctgatggtcttttatgagcaatcttagttctaagtcattgttcccatcccttttttgtgtgtttcagaaaatagtgaacttgattcccctgcttccactaaatccagttgtgacaaaatctaacgtgacatcagatcgaaaggttatagaaataaaactaatgagatctaaaaaaaaaaaanaaaaanaaaaaaaaaaaaaaaaaaggggggggggttnaaaatttccnnggggggggccaatttttgggtgtacccggtttttttttaaaaggtggggcccaatagggaggcgaaataataaggaagagcatgggcggtgttataacaggtcggtgagtggaaaacttgtttcttggacatttgtgaaggaccttcttctttggtgcgacaatattggcacacatccctagaagatttaagctctggggaaattaaatttagtgttatatgtgtagagggaattttctgtgaaagttgctcggcttttaaagcgcataataagtatatgtga

SEQ ID NO: 75943 - DNA, 2451 bp, Homo sapiens
tccttacgtgagaggtggaaaatggagttgagtttctgaggtggggcgaggctgtcggagctgcgagtgagtggcagaggctgctggtcacactgctgctgtcctctgcaggtacgtgctctactccctggacctgtacaatgacagcgcccactacgcgctcaccaggttcaacaagcagttcctgtacgacgaaattgaggccgaggtgaatctatgttttgaccaatttgtttacaagctagcagaccagatatttgcctattataaggttatggcaggaagtttgcttcttgataaacggttacgatcagaatgcaagaatcagggagccacgatccacctcccgccgtctaaccgctacgagacgctgctgaagcagaggcatgtgcagctcctcggcagatcaatagacctcaatcgtctgatcacccagcgcgtctcagcagccatgtataagtccctagaactggcgattggacgatttgaaagtgaagatttgacctccatagttgagctggatggcctgttggaaatcaaccgcatgacccacaagctgctgagccggtacctgacgctggacggcttcgacgccatgttccgggaggccaaccacaacgtgtcagcgccctacgggaggatcaccctgcacgtcttctgggagctcaactatgacttcctgcccaactactgctacaacggctctaccaaccggtttgttcggacagtgttaccattttctcaggaatttcaaagagataagcagcctaatgcacagcctcagtatctgcatggatccaaggctttgaacttggcctactccagcatttacggcagctaccggaacttcgtgggacctccacactttcaagtcatctgccggcttctcggctaccagggtatcgccgtggtcatggaggagctgctgaaggtcgtcaagagcctgctgcaaggcacaatcctgcagtacgtgaagacgctgatggaggtgatgcccaagatctgccgcctgccccggcacgagtacggctctcctggtatcctggagttcttccaccaccagctgaaggacatcgtggagtacgcagagctgaagacggtgtgcttccagaacctgcgggaggtggggaacgccatcctcttctgcctgctcatcgagcagagcctgtctttagaagaagtgtgtgacctgctgcacgcggctcctttccagaacatcttgccgcgagtccatgtgaaagagggggagagacttgatgccaaaatgaaaagactagaatcaaagtacgccccgctgcatcttgtcccactgattgaaagactggggacccctcagcaaattgccatcgcaagagagggggacctgctgacaaaggagcgcctctgctgcggcctgtccatgtttgaggtcatcctgacacggatccggagctttctggatgaccccatctggcgcgggcctctgcccagcaatggggtcatgcatgtggacgagtgtgtggagtttcacagactgtggagtgccatgcagtttgtctactgcattcccgtggggacacacgagttcacagtcgagcagtgctttggtgatgggctacactgggctggctgtatgatcatcgtacttcttgggcagcagcggcgttttgctgtgctggatttctgctaccatctacttaaagtccagaaacatgatggcaaagatgagattattaaaaatgtgcctttgaagaagatggtggagagaattcgcaagttccagattctcaatgatgagatcatcaccatcctggataagtacctgaagtcaggcgacggggagggcacgccagtggagcatgtgcgctgcttccagccgcccatccaccagtccctcgccagcagctgagggcacgcgctgcactccgtaactcaacatggcatgcctttctctccgtaaactatttagtgagatttttagggactatttttcagtatctctgtacctgttaaagggggtgcttttcgatctaaaaacttaattttataaaattgacttatttttctagactaaaattgtatatgcttttggtaattaggaactcttgagaatattggctgctgattgttgccatcacgttcctacaaaattgtttttctatgggatgttctggcagctgtgtcataaaatgctgctgggttcattcattcattccataagaaacttaataccagcaaatgcattaaatcccttgccagttaccattaactgtaactatttagcttttgtttagggatctttctgatggtcttttatgagcaatcttagttctaagtcattgttcccatcccttttttgtgtgtttcagaaaatagtgaacttgattcccctgcttccactaaatccagttgtgacaaaatctaacgtgacatcagatcgaaaggttatagaaataaaactaatgagatcta

SEQ ID NO: 75944 - DNA, 2363 bp, Homo sapiens
gaaaagaagctgtgtaggaaaactctctgtgctctggctcctctttgaggctaccctggctgccctgaaacagacagtgggcttggcaaaaacacacctcagacaggaagggaggccgaggtgaatctatgttttgaccaatttgtttacaagctagcagaccagatatttgcctattataaggttatggcaggaagtttgcttcttgataaacggttacgatcagaatgcaagaatcagggagccacgatccacctcccgccgtctaaccgctacgagacgctgctgaagcagaggcatgtgcagctcctcggcagatcaatagacctcaatcgtctgatcacccagcgcgtctcagcagccatgtataagtccctagaactggcgattggacgatttgaaagtgaagatttgacctccatagttgagctggatggcctgttggaaatcaaccgcatgacccacaagctgctgagccggtacctgacgctggacggcttcgacgccatgttccgggaggccaaccacaacgtgtcagcgccctacgggaggatcaccctgcacgtcttctgggagctcaactatgacttcctgcccaactactgctacaacggctctaccaaccggtttgttcggacagtgttaccattttctcaggaatttcaaagagataagcagcctaatgcacagcctcagtatctgcatggatccaaggctttgaacttggcctactccagcatttacggcagctaccggaacttcgtgggacctccacactttcaagtcatctgccggcttctcggctaccagggtatcgccgtggtcatggaggagctgctgaaggtcgtcaagagcctgctgcaaggcacaatcctgcagtacgtgaagacgctgatggaggtgatgcccaagatctgccgcctgccccggcacgagtacggctctcctggtatcctggagttcttccaccaccagctgaaggacatcgtggagtacgcagagctgaagacggtgtgcttccagaacctgcgggaggtggggaacgccatcctcttctgcctgctcatcgagcagagcctgtctttagaagaagtgtgtgacctgctgcacgcggctcctttccagaacatcttgccgcgagtccatgtgaaagagggggagagacttgatgccaaaatgaaaagactagaatcaaagtacgccccgctgcatcttgtcccactgattgaaagactggggacccctcagcaaattgccatcgcaagagagggggacctgctgacaaaggagcgcctctgctgcggcctgtccatgtttgaggtcatcctgacacggatccggagctttctggatgaccccatctggcgcgggcctctgcccagcaatggggtcatgcatgtggacgagtgtgtggagtttcacagactgtggagtgccatgcagtttgtctactgcattcccgtggggacacacgagttcacagtcgagcagtgctttggtgatgggctacactgggctggctgtatgatcatcgtacttcttgggcagcagcggcgttttgctgtgctggatttctgctaccatctacttaaagtccagaaacatgatggcaaagatgagattattaaaaatgtgcctttgaagaagatggtggagagaattcgcaagttccagattctcaatgatgagatcatcaccatcctggataagtacctgaagtcaggcgacggggagggcacgccagtggagcatgtgcgctgcttccagccgcccatccaccagtccctcgccagcagctgagggcacgcgctgcactccgtaactcaacatggcatgcctttctctccgtaaactatttagtgagatttttagggactatttttcagtatctctgtacctgttaaagggggtgcttttcgatctaaaaacttaattttataaaattgacttatttttctagactaaaattgtatatgcttttggtaattaggaactcttgagaatattggctgctgattgttgccatcacgttcctacaaaattgtttttctatgggatgttctggcagctgtgtcataaaatgctgctgggttcattcattcattccataagaaacttaataccagcaaatgcattaaatcccttgccagttaccattaactgtaactatttagcttttgtttagggatctttctgatggtcttttatgagcaatcttagttctaagtcattgttcccatcccttttttgtgtgtttcagaaaatagtgaacttgattcccctgcttccactaaatccagttgtgacaaaatctaacgtgacatcagatcgaaaggttatagaaataaaactaatgagatcta

SEQ ID NO: 75945 - DNA, 4352 bp, Homo sapiens
cccgggaggaaggggaggaggccgagtgtttcctggcgcattcccggccagcccgagtgactcactcggccaaggaaactcccagggcccgcccaggacccccaagccgccgcggacgcagcccaggatggcggcccaggtgactctggaggacgcgctgtccaacgtggacctcctggaggagctgcccctgcccgaccagcagccctgcatcgagcccccgccatcctcgctgctctaccagccaaatttcaacactaactttgaagacagaaatgcatttgttactggcatcgcaagatacattgaacaagccaccgtccactctagcatgaacgagatgctggaggagggccaagaatatgctgtcatgctgtacacctggaggagctgctcccgggccatcccacaggtgaaatgtaacgagcagcctaacagagtggaaatctacgagaaaaccgtggaggttctggagcctgaggtcacaaaactgatgaatttcatgtacttccagagaaatgccattgagcgtttctgcggggaagtgaggcgcctgtgccatgccgagaggaggaaggacttcgtgtcagaagcctacctgatcacactgggcaaattcatcaacatgttcgctgtgctggacgagctgaagaacatgaagtgcagtgtgaagaacgaccactcagcgtacaagagggccgctcagtttttacgtaaaatggcagatccacagtccatccaggaatcgcagaatctgtccatgttcctggccaatcataacaagatcacacagtctctgcagcagcagctcgaagtgatttctggctacgaagagctcctggcagatattgtgaatctgtgtgtggattactacgagaacaggatgtatttgacgcccagtgagaaacacatgcttctcaaagtcatgggatttggtctgtacctgatggatgggagtgtcagtaacatctataagttggatgccaagaaaagaataaacttatccaaaatcgacaagtacttcaagcaactccaggtggttccgctatttggggacatgcaaatagaactggcaagatatatcaagaccagcgcccactacgaggaaaataaatctcgatggacgtgcacatcctccggcagcagccctcagtacaacatctgcgagcagatgatccagatccgcgaggaccacatgcgcttcatttcggagctggcgcgctacagcaacagcgaggtggtcacgggctcgggccgccaggaggcccagaagacggacgcggagtaccgcaagctcttcgacctggcgctgcagggcctgcagctgttgtcgcagtggagcgcgcacgtgatggaagtgtattcctggaagcttgtgcaccccaccgacaagtactccaacaaggactgccccgacagcgctgaagagtacgagcgtgccacgcgctacaactacaccagcgaggagaagtttgccctagtggaggtgatcgccatgatcaaaggcctgcaggtgctgatgggcaggatggagagcgtgttcaaccacgccatccggcacaccgtctatgccgcactgcaggacttctcccaggtgacccttagggagccgctgcggcaggccatcaagaagaagaagaacgtcatccagagtgtcctgcaggccatcaggaagaccgtgtgtgactgggagacggggcatgagcccttcaatgacccagccttgcggggcgagaaggaccccaagagcggcttcgacataaaagtaccacgccgcgccgtgggaccctccagcactcagctttacatggtgagaaccatgctagagtccctcattgcagacaaaagtggttccaagaaaaccttgagaagtagccttgaggggcccaccatattggacatagaaaaatttcatcgagagtcattcttctacactcacttgataaatttcagtgaaacgctgcagcagtgctgtgacctttcgcagctgtggttccgagagttcttcctggagctgaccatgggcaggaggatccagttccccattgagatgtcgatgccctggatcctgacggaccacatcctggagaccaaggaggcatcgatgatggagtacgtgctctactccctggacctgtacaatgacagcgcccactacgcgctcaccaggttcaacaagcagttcctgtacgacgaaattgaggccgaggtgaatctatgttttgaccaatttgtttacaagctagcagaccagatatttgcctattataaggttatggcaggaagtttgcttcttgataaacggttacgatcagaatgcaagaatcagggagccacgatccacctcccgccgtctaaccgctacgagacgctgctgaagcagaggcatgtgcagctcctcggcagatcaatagacctcaatcgtctgatcacccagcgcgtctcagcagccatgtataagtccctagaactggcgattggacgatttgaaagtgaagatttgacctccatagttgagctggatggcctgttggaaatcaaccgcatgacccacaagctgctgagccggtacctgacttcctgcccaactactgctacaacggctctaccaaccggtttgttcggacagtgttaccattttctcaggaatttcaaagagataagcagcctaatgcacagcctcagtatctgcatggatccaaggctttgaacttggcctactccagcatttacggcagctaccggaacttcgtgggacctccacactttcaagtcatctgccggcttctcggctaccagggtatcgccgtggtcatggaggagctgctgaaggtcgtcaagagcctgctgcaaggcacaatcctgcagtacgtgaagacgctgatggaggtgatgcccaagatctgccgcctgccccggcacgagtacggctctcctggtatcctggagttcttccaccaccagctgaaggacatcgtggagtacgcagagctgaagacggtgtgcttccagaacctgcgggaggtggggaacgccatcctcttctgcctgctcatcgagcagagcctgtctttagaagaagtgtgtgacctgctgcacgcggctcctttccagaacatcttgccgcgagtccatgtgaaagagggggagagacttgatgccaaaatgaaaagactagaatcaaagtacgccccgctgcatcttgtcccactgattgaaagactggggacccctcagcaaattgccatcgcaagagagggggacctgctgacaaaggagcgcctctgctgcggcctgtccatgtttgaggtcatcctgacacggatccggagctttctggatgaccccatctggcgcgggcctctgcccagcaatggggtcatgcatgtggacgagtgtgtggagtttcacagactgtggagtgccatgcagtttgtctactgcattcccgtggggacacacgagttcacagtcgagcagtgctttggtgatgggctacactgggctggctgtatgatcatcgtacttcttgggcagcagcggcgttttgctgtgctggatttctgctaccatctacttaaagtccagaaacatgatggcaaagatgagattattaaaaatgtgcctttgaagaagatggtggagagaattcgcaagttccagattctcaatgatgagatcatcaccatcctggataagtacctgaagtcaggcgacggggagggcacgccagtggagcatgtgcgctgcttccagccgcccatccaccagtccctcgccagcagctgagggcacgcgctgcactccgtaactcaacatggcatgcctttctctccgtaaactatttagtgagatttttagggactatttttcagtatctctgtacctgttaaagggggtgcttttcgatctaaaaacttaattttataaaattgacttatttttctagactaaaattgtatatgcttttggtaattaggaactcttgagaatattggctgctgattgttgccatcacgttcctacaaaattgtttttctatgggatgttctggcagctgtgtcataaaatgctgctgggttcattcattcattccataagaaacttaataccagcaaatgcattaaatcccttgccagttaccattaactgtaactatttagcttttgtttagggatctttctgatggtcttttatgagcaatcttagttctaagtcattgttcccatcccttttttgtgtgtttcagaaaatagtgaacttgattcccctgcttccactaaatccagttgtgacaaaatctaacgtgacatcagatcgaaaggttatagaaataaaactaatgagatcta

SEQ ID NO: 75946 - DNA, 4380 bp, Homo sapiens
cccgggaggaaggggaggaggccgagtgtttcctggcgcattcccggccagcccgagtgactcactcggccaaggaaactcccagggcccgcccaggacccccaagccgccgcggacgcagcccaggatggcggcccaggtgactctggaggacgcgctgtccaacgtggacctcctggaggagctgcccctgcccgaccagcagccctgcatcgagcccccgccatcctcgctgctctaccagccaaatttcaacactaactttgaagacagaaatgcatttgttactggcatcgcaagatacattgaacaagccaccgtccactctagcatgaacgagatgctggaggagggccaagaatatgctgtcatgctgtacacctggaggagctgctcccgggccatcccacaggtgaaatgtaacgagcagcctaacagagtggaaatctacgagaaaaccgtggaggttctggagcctgaggtcacaaaactgatgaatttcatgtacttccagagaaatgccattgagcgtttctgcggggaagtgaggcgcctgtgccatgccgagaggaggaaggacttcgtgtcagaagcctacctgatcacactgggcaaattcatcaacatgttcgctgtgctggacgagctgaagaacatgaagtgcagtgtgaagaacgaccactcagcgtacaagagggccgctcagtttttacgtaaaatggcagatccacagtccatccaggaatcgcagaatctgtccatgttcctggccaatcataacaagatcacacagtctctgcagcagcagctcgaagtgatttctggctacgaagagctcctggcagatattgtgaatctgtgtgtggattactacgagaacaggatgtatttgacgcccagtgagaaacacatgcttctcaaagtcatgggatttggtctgtacctgatggatgggagtgtcagtaacatctataagttggatgccaagaaaagaataaacttatccaaaatcgacaagtacttcaagcaactccaggtggttccgctatttggggacatgcaaatagaactggcaagatatatcaagaccagcgcccactacgaggaaaataaatctcgatggacgtgcacatcctccggcagcagccctcagtacaacatctgcgagcagatgatccagatccgcgaggaccacatgcgcttcatttcggagctggcgcgctacagcaacagcgaggtggtcacgggctcgggccgccaggaggcccagaagacggacgcggagtaccgcaagctcttcgacctggcgctgcagggcctgcagctgttgtcgcagtggagcgcgcacgtgatggaagtgtattcctggaagcttgtgcaccccaccgacaagtactccaacaaggactgccccgacagcgctgaagagtacgagcgtgccacgcgctacaactacaccagcgaggagaagtttgccctagtggaggtgatcgccatgatcaaaggcctgcaggtgctgatgggcaggatggagagcgtgttcaaccacgccatccggcacaccgtctatgccgcactgcaggacttctcccaggtgacccttagggagccgctgcggcaggccatcaagaagaagaagaacgtcatccagagtgtcctgcaggccatcaggaagaccgtgtgtgactgggagacggggcatgagcccttcaatgacccagccttgcggggcgagaaggaccccaagagcggcttcgacataaaagtaccacgccgcgccgtgggaccctccagcactcagctttacatggtgagaaccatgctagagtccctcattgcagacaaaagtggttccaagaaaaccttgagaagtagccttgaggggcccaccatattggacatagaaaaatttcatcgagagtcattcttctacactcacttgataaatttcagtgaaacgctgcagcagtgctgtgacctttcgcagctgtggttccgagagttcttcctggagctgaccatgggcaggaggatccagttccccattgagatgtcgatgccctggatcctgacggaccacatcctggagaccaaggaggcatcgatgatggagtacgtgctctactccctggacctgtacaatgacagcgcccactacgcgctcaccaggttcaacaagcagttcctgtacgacgaaattgaggccgaggtgaatctatgttttgaccaatttgtttacaagctagcagaccagatatttgcctattataaggttatggcaggaagtttgcttcttgataaacggttacgatcagaatgcaagaatcagggagccacgatccacctcccgccgtctaaccgctacgagacgctgctgaagcagaggcatgtgcagctcctcggcagatcaatagacctcaatcgtctgatcacccagcgcgtctcagcagccatgtataagtccctagaactggcgattggacgatttgaaagtgaagatttgacctccatagttgagctggatggcctgttggaaatcaaccgcatgacccacaagctgctgagccggtacctgacgctggacggcttcgacgccatgttccgggaggccaaccacaacgtgtcagcgccctacgggaggatcaccctgcacgtcttctgggagctcaactatgacttcctgcccaactactgctacaacggctctaccaaccggtttgttcggacagtgttaccattttctcaggaatttcaaagagataagcagcctaatgcacagcctcagtatctgcatggatccaaggctttgaacttggcctactccagcatttacggcagctaccggaacttcgtgggacctccacactttcaagtcatctgccggcttctcggctaccagggtatcgccgtggtcatggaggagctgctgaaggtcgtcaagagcctgctgcaaggcacaatcctgcagtacgtgaagacgctgatggaggtgatgcccaagatctgccgcctgccccggcacgagtacggctctcctggtatcctggagttcttccaccaccagctgaaggacatcgtggagtacgcagagctgaagacggtgtgcttccagaacctgcgggaggtggggaacgccatcctcttctgcctgctcatcgagcagagcctgtctttagaagaagtgtgtgacctgctgcacgcggctcctttccagaacatcttgccgcgagtccatgtgaaagagggggagagacttgatgccaaaatgaaaagactagaatcaaagtacgccccgctgcatcttgtcccactgattgaaagactggggacccctcagcaaattgccatcgcaagagagggggacctgctgacaaaggagcgcctctgctgcggcctgtccatgtttgaggtcatcctgacacggatccggagctttctggatgaccccatctggcgcgggcctctgcccagcaatggggtcatgcatgtggacgagtgtgtggagtttcacagactgtggagtgccatgcagtttgtctactgcattcccgtggggacacacgagttcacagtcgagcagtgctttggtgatgggctacactgggctggctgtatgatcatcgtacttcttgggcagcagcggcgttttgctgtgctggatttctgctaccatctacttaaagtccagaaacatgatggcaaagatgagattattaaaaatgtgcctttgaagaagatggtggagagaattcgcaagttccagattctcaatgatgagatcatcaccatcctggataagtacctgaagtcaggcgacggggagggcacgccagtggagcatgtgcgctgcttccagccgcccatccaccagtccctcgccagcagctgagggcacgcgctgcactccgtaactcaacatggcatgcctttctctccgtaaactatttagtgagatttttagggactatttttcagtatctctgtacctgttaaagggggtgcttttcgatctaaaaacttaattttataaaattgacttatttttctagactaaaattgtatatgcttttggtaattaggaactcttgagaatattggctgctgattgttgccatcacgttcctacaaaattgtttttctatgggatgttctggcagctgtgtcataaaatgctgctgggttcattcattcattccataagaaacttaataccagcaaatgcattaaatcccttgccagttaccattaactgtaactatttagcttttgtttagggatctttctgatggtcttttatgagcaatcttagttctaagtcattgttcccatcccttttttgtgtgtttcagaaaatagtgatctcataacgggtacgaatcg

SEQ ID NO: 75947 - DNA, 4398 bp, Homo sapiens
cccgggaggaaggggaggaggccgagtgtttcctggcgcattcccggccagcccgagtgactcactcggccaaggaaactcccagggcccgcccaggacccccaagccgccgcggacgcagcccaggatggcggcccaggtgactctggaggacgcgctgtccaacgtggacctcctggaggagctgcccctgcccgaccagcagccctgcatcgagcccccgccatcctcgctgctctaccagccaaatttcaacactaactttgaagacagaaatgcatttgttactggcatcgcaagatacattgaacaagccaccgtccactctagcatgaacgagatgctggaggagggccaagaatatgctgtcatgctgtacacctggaggagctgctcccgggccatcccacaggtgaaatgtaacgagcagcctaacagagtggaaatctacgagaaaaccgtggaggttctggagcctgaggtcacaaaactgatgaatttcatgtacttccagagaaatgccattgagcgtttctgcggggaagtgaggcgcctgtgccatgccgagaggaggaaggacttcgtgtcagaagcctacctgatcacactgggcaaattcatcaacatgttcgctgtgctggacgagctgaagaacatgaagtgcagtgtgaagaacgaccactcagcgtacaagagggccgctcagtttttacgtaaaatggcagatccacagtccatccaggaatcgcagaatctgtccatgttcctggccaatcataacaagatcacacagtctctgcagcagcagctcgaagtgatttctggctacgaagagctcctggcagatattgtgaatctgtgtgtggattactacgagaacaggatgtatttgacgcccagtgagaaacacatgcttctcaaagtcatgggatttggtctgtacctgatggatgggagtgtcagtaacatctataagttggatgccaagaaaagaataaacttatccaaaatcgacaagtacttcaagcaactccaggtggttccgctatttggggacatgcaaatagaactggcaagatatatcaagaccagcgcccactacgaggaaaataaatctcgatggacgtgcacatcctccggcagcagccctcagtacaacatctgcgagcagatgatccagatccgcgaggaccacatgcgcttcatttcggagctggcgcgctacagcaacagcgaggtggtcacgggctcgggccgccaggaggcccagaagacggacgcggagtaccgcaagctcttcgacctggcgctgcagggcctgcagctgttgtcgcagtggagcgcgcacgtgatggaagtgtattcctggaagcttgtgcaccccaccgacaagtactccaacaaggactgccccgacagcgctgaagagtacgagcgtgccacgcgctacaactacaccagcgaggagaagtttgccctagtggaggtgatcgccatgatcaaaggcctgcaggtgctgatgggcaggatggagagcgtgttcaaccacgccatccggcacaccgtctatgccgcactgcaggacttctcccaggtgacccttagggagccgctgcggcaggccatcaagaagaagaagaacgtcatccagagtgtcctgcaggccatcaggaagaccgtgtgtgactgggagacggggcatgagcccttcaatgacccagccttgcggggcgagaaggaccccaagagcggcttcgacataaaagtaccacgccgcgccgtgggaccctccagcactcagctttacatggtgagaaccatgctagagtccctcattgcagacaaaagtggttccaagaaaaccttgagaagtagccttgaggggcccaccatattggacatagaaaaatttcatcgagagtcattcttctacactcacttgataaatttcagtgaaacgctgcagcagtgctgtgacctttcgcagctgtggttccgagagttcttcctggagctgaccatgggcaggaggatccagttccccattgagatgtcgatgccctggatcctgacggaccacatcctggagaccaaggaggcatcgatgatggagtacgtgctctactccctggacctgtacaatgacagcgcccactacgcgctcaccaggttcaacaagcagttcctgtacgacgaaattgaggccgaggtgaatctatgttttgaccaatttgtttacaagctagcagaccagatatttgcctattataaggttatggcaggaagtttgcttcttgataaacggttacgatcagaatgcaagaatcagggagccacgatccacctcccgccgtctaaccgctacgagacgctgctgaagcagaggcatgtgcagctcctcggcagatcaatagacctcaatcgtctgatcacccagcgcgtctcagcagccatgtataagtccctagaactggcgattggacgatttgaaagtgaagatttgacctccatagttgagctggatggcctgttggaaatcaaccgcatgacccacaagctgctgagccggtacctgacgctggacggcttcgacgccatgttccgggaggccaaccacaacgtgtcagcgccctacgggaggatcaccctgcacgtcttctgggagctcaactatgacttcctgcccaactactgctacaacggctctaccaaccggtttgttcggacagtgttaccattttctcaggaatttcaaagagataagcagcctaatgcacagcctcagtatctgcatggatccaaggctttgaacttggcctactccagcatttacggcagctaccggaacttcgtgggacctccacactttcaagtcatctgccggcttctcggctaccagggtatcgccgtggtcatggaggagctgctgaaggtcgtcaagagcctgctgcaaggcacaatcctgcagtacgtgaagacgctgatggaggtgatgcccaagatctgccgcctgccccggcacgagtacggctctcctggtatcctggagttcttccaccaccagctgaaggacatcgtggagtacgcagagctgaagacggtgtgcttccagaacctgcgggaggtggggaacgccatcctcttctgcctgctcatcgagcagagcctgtctttagaagaagtgtgtgacctgctgcacgcggctcctttccagaacatcttgccgcgagtccatgtgaaagagggggagagacttgatgccaaaatgaaaagactagaatcaaagtacgccccgctgcatcttgtcccactgattgaaagactggggacccctcagcaaattgccatcgcaagagagggggacctgctgacaaaggagcgcctctgctgcggcctgtccatgtttgaggtcatcctgacacggatccggagctttctggatgaccccatctggcgcgggcctctgcccagcaatggggtcatgcatgtggacgagtgtgtggagtttcacagactgtggagtgccatgcagtttgtctactgcattcccgtggggacacacgagttcacagtcgagcagtgctttggtgatgggctacactgggctggctgtatgatcatcgtacttcttgggcagcagcggcgttttgctgtgctggatttctgctaccatctacttaaagtccagaaacatgatggcaaagatgagattattaaaaatgtgatcatcaccatcctggataagtacctgaagtcaggcgacggggagggcacgccagtggagcatgtgcgctgcttccagccgcccatccaccagtccctcgccagcagctgagggcacgcgctgcactccgtaactcaacatggcatgcctttctctccgtaaactatttagtgagatttttagggactatttttcagtatctctgtacctgttaaagggggtgcttttcgatctaaaaacttaattttataaaattgacttatttttctagactaaaattgtatatgcttttggtaattaggaactcttgagaatattggctgctgattgttgccatcacgttcctacaaaattgtttttctatgggatgttctggcagctgtgtcataaaatgctgctgggttcattcattcattccataagaaacttaataccagcaaatgcattaaatcccttgccagttaccattaactgtaactatttagcttttgtttagggatctttctgatggtcttttatgagcaatcttagttctaagtcattgttcccatcccttttttgtgtgtttcagaaaatagtgaacttgattcccctgcttccactaaatccagttgtgacaaaatctaacgtgacatcagatcgaaaggttatagaaataaaactaatgagatcta

SEQ ID NO: 75948 - DNA, 2243 bp, Homo sapiens
  misc_feature (15)..(15): n is a, c, g, or t
gatgaaaccgtgtgntggatgaatcccggttagatcacaagtgctaggaataagtggcatgccatgtaggggagctctacgggcgctctatgcgtgtatgagatggcgtggtgaaacagagggactgtgaagcctcatggtgtagagtaatacatgctaaagatcgagagactctggcctaggagcgctgtcatgacgtgcagtgctataagggtcccttagaatctggcgtaattgtgtgcgactgtgatgcgttgacagattggagcctcggatagttagaagatgtgtatagagcgcatgttgtggaataatactgatacgagattgaccgctactaagacatgacatagagaccggtacctgacgctggacggcttcgacgccatgttccgggaggccaaccacaacgtgtcagcgccctacgggaggatcaccctgcacgtcttctgggagctcaactatgacttcctgcccaactactgctacaacggctctaccaaccggtttgttcggacagtgttaccattttctcaggaatttcaaagagataagcagcctaatgcacagcctcagtatctgcatggatccaaggctttgaacttggcctactccagcatttacggcagctaccggaacttcgtgggacctccacactttcaagtcatctgccggcttctcggctaccagggtatcgccgtggtcatggaggagctgctgaaggtcgtcaagagcctgctgcaaggcacaatcctgcagtacgtgaagacgctgatggaggtgatgcccaagatctgccgcctgccccggcacgagtacggctctcctggtatcctggagttcttccaccaccagctgaaggacatcgtggagtacgcagagctgaagacggtgtgcttccagaacctgcgggaggtggggaacgccatcctcttctgcctgctcatcgagcagagcctgtctttagaagaagtgtgtgacctgctgcacgcggctcctttccagaacatcttgccgcgagtccatgtgaaagagggggagagacttgatgccaaaatgaaaagactagaatcaaagtacgccccgctgcatcttgtcccactgattgaaagactggggacccctcagcaaattgccatcgcaagagagggggacctgctgacaaaggagcgcctctgctgcggcctgtccatgtttgaggtcatcctgacacggatccggagctttctggatgaccccatctggcgcgggcctctgcccagcaatggggtcatgcatgtggacgagtgtgtggagtttcacagactgtggagtgccatgcagtttgtctactgcattcccgtggggacacacgagttcacagtcgagcagtgctttggtgatgggctacactgggctggctgtatgatcatcgtacttcttgggcagcagcggcgttttgctgtgctggatttctgctaccatctacttaaagtccagaaacatgatggcaaagatgagattattaaaaatgtgcctttgaagaagatggtggagagaattcgcaagttccagattctcaatgatgagatcatcaccatcctggataagtacctgaagtcaggcgacggggagggcacgccagtggagcatgtgcgctgcttccagccgcccatccaccagtccctcgccagcagctgagggcacgcgctgcactccgtaactcaacatggcatgcctttctctccgtaaactatttagtgagatttttagggactatttttcagtatctctgtacctgttaaagggggtgcttttcgatctaaaaacttaattttataaaattgacttatttttctagactaaaattgtatatgcttttggtaattaggaactcttgagaatattggctgctgattgttgccatcacgttcctacaaaattgtttttctatgggatgttctggcagctgtgtcataaaatgctgctgggttcattcattcattccataagaaacttaataccagcaaatgcattaaatcccttgccagttaccattaactgtaactatttagcttttgtttagggatctttctgatggtcttttatgagcaatcttagttctaagtcattgttcccatcccttttttgtgtgtttcagaaaatagtgaacttgattcccctgcttccactaaatccagttgtgacaaaatctaacgtgacatcagatcgaaaggttatagaaataaaactaatgagatcta

SEQ ID NO: 75949 - DNA, 1661 bp, Homo sapiens
gcctggtggcaaattagcagggaaggatggggcgagagcttttagacaggtaaatcctggaaaacagagcacacattcaacactgggtcttacctgtgtctatatttacattaattaaatgtaactaaaaataaaattcagttcctcaagtgccaagccacattccaagtacttactaggcatgcatggctggcggctgccggaatggacaggacagacggaagcatttccatcatcccagaaatctcttgacagagataaaataaacttacagagtttattttatgctaaaaggcaaagaagttcttggttttcagcaccagattgctctctggcgagatacccttcctagcttgaccctctctttctctgctctagtctttagaagaagtgtgtgacctgctgcacgcggctcctttccagaacatcttgccgcgagtccatgtgaaagagggggagagacttgatgccaaaatgaaaagactagaatcaaagtacgccccgctgcatcttgtcccactgattgaaagactggggacccctcagcaaattgccatcgcaagagagggggacctgctgacaaaggagcgcctctgctgcggcctgtccatgtttgaggtcatcctgacacggatccggagctttctggatgaccccatctggcgcgggcctctgcccagcaatggggtcatgcatgtggacgagtgtgtggagtttcacagactgtggagtgccatgcagtttgtctactgcattcccgtggggacacacgagttcacagtcgagcagtgctttggtgatgggctacactgggctggctgtatgatcatcgtacttcttgggcagcagcggcgttttgctgtgctggatttctgctaccatctacttaaagtccagaaacatgatggcaaagatgagattattaaaaatgtgcctttgaagaagatggtggagagaattcgcaagttccagattctcaatgatgagatcatcaccatcctggataagtacctgaagtcaggcgacggggagggcacgccagtggagcatgtgcgctgcttccagccgcccatccaccagtccctcgccagcagctgagggcacgcgctgcactccgtaactcaacatggcatgcctttctctccgtaaactatttagtgagatttttagggactatttttcagtatctctgtacctgttaaagggggtgcttttcgatctaaaaacttaattttataaaattgacttatttttctagactaaaattgtatatgcttttggtaattaggaactcttgagaatattggctgctgattgttgccatcacgttcctacaaaattgtttttctatgggatgttctggcagctgtgtcataaaatgctgctgggttcattcattcattccataagaaacttaataccagcaaatgcattaaatcccttgccagttaccattaactgtaactatttagcttttgtttagggatctttctgatggtcttttatgagcaatcttagttctaagtcattgttcccatcccttttttgtgtgtttcagaaaatagtgaacttgattcccctgcttccactaaatccagttgtgacaaaatctaacgtgacatcagatcgaaaggttatagaaataaaactaatgagatcta

SEQ ID NO: 75950 - DNA, 4216 bp, Homo sapiens
cccgggaggaaggggaggaggccgagtgtttcctggcgcattcccggccagcccgagtgactcactcggccaaggaaactcccagggcccgcccaggacccccaagccgccgcggacgcagcccaggatggcggcccaggtgactctggaggacgcgctgtccaacgtggacctcctggaggagctgcccctgcccgaccagcagccctgcatcgagcccccgccatcctcgctgctctaccagccaaatttcaacactaactttgaagacagaaatgcatttgttactggcatcgcaagatacattgaacaagccaccgtccactctagcatgaacgagatgctggaggagggccaagaatatgctgtcatgctgtacacctggaggagctgctcccgggccatcccacaggtgaaatgtaacgagcagcctaacagagtggaaatctacgagaaaaccgtggaggttctggagcctgaggtcacaaaactgatgaatttcatgtacttccagagaaatgccattgagcgtttctgcggggaagtgaggcgcctgtgccatgccgagaggaggaaggacttcgtgtcagaagcctacctgatcacactgggcaaattcatcaacatgttcgctgtgctggacgagctgaagaacatgaagtgcagtgtgaagaacgaccactcagcgtacaagagggccgctcagtttttacgtaaaatggcagatccacagtccatccaggaatcgcagaatctgtccatgttcctggccaatcataacaagatcacacagtctctgcagcagcagctcgaagtgatttctggctacgaagagctcctggcagatattgtgaatctgtgtgtggattactacgagaacaggatgtatttgacgcccagtgagaaacacatgcttctcaaagtcatgggatttggtctgtacctgatggatgggagtgtcagtaacatctataagttggatgccaagaaaagaataaacttatccaaaatcgacaagtacttcaagcaactccaggtggttccgctatttggggacatgcaaatagaactggcaagatatatcaagaccagcgcccactacgaggaaaataaatctcgatggacgtgcacatcctccggcagcagccctcagtacaacatctgcgagcagatgatccagatccgcgaggaccacatgcgcttcatttcggagctggcgcgctacagcaacagcgaggtggtcacgggctcgggccgccaggaggcccagaagacggacgcggagtaccgcaagctcttcgacctggcgctgcagggcctgcagctgttgtcgcagtggagcgcgcacgtgatggaagtgtattcctggaagcttgtgcaccccaccgacaagtactccaacaaggactgccccgacagcgctgaagagtacgagcgtgccacgcgctacaactacaccagcgaggagaagtttgccctagtggaggtgatcgccatgatcaaaggcctgcaggtgctgatgggcaggatggagagcgtgttcaaccacgccatccggcacaccgtctatgccgcactgcaggacttctcccaggtgacccttagggagccgctgcggcaggccatcaagaagaagaagaacgtcatccagagtgtcctgcaggccatcaggaagaccgtgtgtgactgggagacggggcatgagcccttcaatgacccagccttgcggggcgagaaggaccccaagagcggcttcgacataaaagtaccacgccgcgccgtgggaccctccagcactcagctttacatggtgagaaccatgctagagtccctcattgcagacaaaagtggttccaagaaaaccttgagaagtagccttgaggggcccaccatattggacatagaaaaatttcatcgagagtcattcttctacactcacttgataaatttcagtgaaacgctgcagcagtgctgtgacctttcgcagctgtggttccgagagttcttcctggagctgaccatgggcaggaggatccagttccccattgagatgtcgatgccctggatcctgacggaccacatcctggagaccaaggaggcatcgatgatggagtacgtgctctactccctggacctgtacaatgacagcgcccactacgcgctcaccaggttcaacaagcagttcctgtacgacgaaattgaggccgaggtgaatctatgttttgaccaatttgtttacaagctagcagaccagatatttgcctattataaggttatggcaggaagtttgcttcttgataaacggttacgatcagaatgcaagaatcagggagccacgatccacctcccgccgtctaaccgctacgagacgctgctgaagcagaggcatgtgcagctcctcggcagatcaatagacctcaatcgtctgatcacccagcgcgtctcagcagccatgtataagtccctagaactggcgattggacgatttgaaagtgaagatttgacctccatagttgagctggatggcctgttggaaatcaaccgcatgacccacaagctgctgagccggtacctgacgctggacggcttcgacgccatgttccgggaggccaaccacaacgtgtcagcgccctacgggaggatcaccctgcacgtcttctgggagctcaactatgacttcctgcccaactactgctacaacggctctaccaaccggtttgttcggacagtgttaccattttctcaggaatttcaaagagataagcagcctaatgcacagcctcagtatctgcatggatccaaggctttgaacttggcctactccagcatttacggcagctaccggaacttcgtgggacctccacactttcaagtcatctgccggcttctcggctaccagggtatcgccgtggtcatggaggagctgctgaaggtcgtcaagagcctgctgcaaggcacaatcctgcagtacgtgaagacgctgatggaggtgatgcccaagatctgccgcctgccccggcacgagtacggctctcctggtatcctggagttcttccaccaccagctgaaggacatcgtggagtacgcagagctgaagacggtgtgcttccagaacctgcgggaggtggggaacgccatcctcttctgcctgctcatcgagcagagcctgtctttagaagaagtgtgtgacctgctgcacgcggctcctttccagaacatcttgccgcgagtccatgtgaaagagggggagagacttgatgccaaaatgaaaagactagaatcaaagtacgccccgctgcatcttgtcccactgattgaaagactggggacccctcagcaaattgccatcgcaagagagggggacctgctgacaaaggagcgcctctgctgcggcctgtccatgtttgaggtcatcctgacacggatccggagctttctggatgaccccatctggcgcgggcctctgcccagcaatggggtcatgcatgtggacgagtgtgtggagtttcacagactgtggagtgccatgcagtttgtctactgcattcccgtggggacacacgagttcacagtcgagcagtgctttggtgatgggctacactgggctggctgtatgatcatcgtacttcttgggcagcagcggcgttttgctgtgctggatttctgctaccatctacttaaagtccagaaacatgatggcaaagatgagattattaaaaatgtggtatgtggatgaaaatctcgcaccatctatggaccttttgcaaaagcatactttctttgtgttataagttcttgtttctggcaatgtttttcatcctagtacgtaaggtgccaccaacagaaactttcttttcgttcccaaaatgaatctaaatataattggccagtaaagcagtctggcagagaaaatactcattgttccgttttccttctcaaggtacttagatttacttccagtcttacaggatctgcattgtcagaatattggcaactatagtcttcgggcccctggaagtctgtgctttcttggctgctttaaaggccttttgtctttgttgctttatggatccctcatagttgaattctggaaaatactcagccattatctttgaaatatttcagcctcctttccattctccctattcttgccattcaggacttcagttaaacatatgttagaccttctcattctattctccacatctctttgttg

SEQ ID NO: 75951 - DNA, 2409 bp, Homo sapiens
cccgggaggaaggggaggaggccgagtgtttcctggcgcattcccggccagcccgagtgactcactcggccaaggaaactcccagggcccgcccaggacccccaagccgccgcggacgcagcccaggatggcggcccaggtgactctggaggacgcgctgtccaacgtggacctcctggaggagctgcccctgcccgaccagcagccctgcatcgagcccccgccatcctcgctgctctaccagccaaatttcaacactaactttgaagacagaaatgcatttgttactggcatcgcaagatacattgaacaagccaccgtccactctagcatgaacgagatgctggaggagggccaagaatatgctgtcatgctgtacacctggaggagctgctcccgggccatcccacaggtgaaatgtaacgagcagcctaacagagtggaaatctacgagaaaaccgtggaggttctggagcctgaggtcacaaaactgatgaatttcatgtacttccagagaaatgccattgagcgtttctgcggggaagtgaggcgcctgtgccatgccgagaggaggaaggacttcgtgtcagaagcctacctgatcacactgggcaaattcatcaacatgttcgctgtgctggacgagctgaagaacatgaagtgcagtgtgaagaacgaccactcagcgtacaagagggccgctcagtttttacgtaaaatggcagatccacagtccatccaggaatcgcagaatctgtccatgttcctggccaatcataacaagatcacacagtctctgcagcagcagctcgaagtgatttctggctacgaagagctcctggcagatattgtgaatctgtgtgtggattactacgagaacaggatgtatttgacgcccagtgagaaacacatgcttctcaaagtcatgggatttggtctgtacctgatggatgggagtgtcagtaacatctataagttggatgccaagaaaagaataaacttatccaaaatcgacaagtacttcaagcaactccaggtggttccgctatttggggacatgcaaatagaactggcaagatatatcaagaccagcgcccactacgaggaaaataaatctcgatggacgtgcacatcctccggcagcagccctcagtacaacatctgcgagcagatgatccagatccgcgaggaccacatgcgcttcatttcggagctggcgcgctacagcaacagcgaggtggtcacgggctcgggccgccaggaggcccagaagacggacgcggagtaccgcaagctcttcgacctggcgctgcagggcctgcagctgttgtcgcagtggagcgcgcacgtgatggaagtgtattcctggaagcttgtgcaccccaccgacaagtactccaacaaggactgccccgacagcgctgaagagtacgagcgtgccacgcgctacaactacaccagcgaggagaagtttgccctagtggaggtgatcgccatgatcaaaggcctgcaggtgctgatgggcaggatggagagcgtgttcaaccacgccatccggcacaccgtctatgccgcactgcaggacttctcccaggtgacccttagggagccgctgcggcaggccatcaagaagaagaagaacgtcatccagagtgtcctgcaggccatcaggaagaccgtgtgtgactgggagacggggcatgagcccttcaatgacccagccttgcggggcgagaaggaccccaagagcggcttcgacataaaagtaccacgccgcgccgtgggaccctccagcactcagctttacatggtgagaaccatgctagagtccctcattgcagacaaaagtggttccaagaaaaccttgagaagtagccttgaggggcccaccatattggacatagaaaaatttcatcgagagtcattcttctacactcacttgataaatttcagtgaaacgctgcagcagtgctgtgacctttcgcagctgtggttccgagagttcttcctggagctgaccatgggcaggaggatccagttccccattgagatgtcgatgccctggatcctgacggaccacatcctggagaccaaggaggcatcgatgatggagtgcgtgtcctgcgggcctgtctccagcctttgtgtgtggtgaccgggggtcctcagaggaggtggcggagaggccgggactgtttttagtattgtatttgaaatcaagtttctgggcctgggcaaaatagcaagaccccagtctctacaaaaatgagaaaacttagcctggtgtggtggctgatgcgggaggattgctttaccacagaaatttgtggctgcattgagctatggattgcaccactgcattccagcctggccacgtagcaagaccctgtctccaaataaaaaaaaaaa

SEQ ID NO: 75952 - DNA, 5193 bp, Homo sapiens
cccgggaggaaggggaggaggccgagtgtttcctggcgcattcccggccagcccgagtgactcactcggccaaggaaactcccagggcccgcccaggacccccaagccgccgcggacgcagcccaggatggcggcccaggtgactctggaggacgcgctgtccaacgtggacctcctggaggagctgcccctgcccgaccagcagccctgcatcgagcccccgccatcctcgctgctctaccagccaaatttcaacactaactttgaagacagaaatgcatttgttactggcatcgcaagatacattgaacaagccaccgtccactctagcatgaacgagatgctggaggagggccaagaatatgctgtcatgctgtacacctggaggagctgctcccgggccatcccacaggtgaaatgtaacgagcagcctaacagagtggaaatctacgagaaaaccgtggaggttctggagcctgaggtcacaaaactgatgaatttcatgtacttccagagaaatgccattgagcgtttctgcggggaagtgaggcgcctgtgccatgccgagaggaggaaggacttcgtgtcagaagcctacctgatcacactgggcaaattcatcaacatgttcgctgtgctggacgagctgaagaacatgaagtgcagtgtgaagaacgaccactcagcgtacaagagggccgctcagtttttacgtaaaatggcagatccacagtccatccaggaatcgcagaatctgtccatgttcctggccaatcataacaagatcacacagtctctgcagcagcagctcgaagtgatttctggctacgaagagctcctggcagatattgtgaatctgtgtgtggattactacgagaacaggatgtatttgacgcccagtgagaaacacatgcttctcaaagtcatgggatttggtctgtacctgatggatgggagtgtcagtaacatctataagttggatgccaagaaaagaataaacttatccaaaatcgacaagtacttcaagcaactccaggtggttccgctatttggggacatgcaaatagaactggcaagatatatcaagaccagcgcccactacgaggaaaataaatctcgatggacgtgcacatcctccggcagcagccctcagtacaacatctgcgagcagatgatccagatccgcgaggaccacatgcgcttcatttcggagctggcgcgctacagcaacagcgaggtggtcacgggctcgggccgccaggaggcccagaagacggacgcggagtaccgcaagctcttcgacctggcgctgcagggcctgcagctgttgtcgcagtggagcgcgcacgtgatggaagtgtattcctggaagcttgtgcaccccaccgacaagtactccaacaaggactgccccgacagcgctgaagagtacgagcgtgccacgcgctacaactacaccagcgaggagaagtttgccctagtggaggtgatcgccatgatcaaaggcctgcaggtgctgatgggcaggatggagagcgtgttcaaccacgccatccggcacaccgtctatgccgcactgcaggacttctcccaggtgacccttagggagccgctgcggcaggccatcaagaagaagaagaacgtcatccagagtgtcctgcaggccatcaggaagaccgtgtgtgactgggagacggggcatgagcccttcaatgacccagccttgcggggcgagaaggaccccaagagcggcttcgacataaaagtaccacgccgcgccgtgggaccctccagcactcagctttacatggtgagaaccatgctagagtccctcattgcagacaaaagtggttccaagaaaaccttgagaagtagccttgaggggcccaccatattggacatagaaaaatttcatcgagagtcattcttctacactcacttgataaatttcagtgaaacgctgcagcagtgctgtgacctttcgcagctgtggttccgagagttcttcctggagctgaccatgggcaggaggatccagttccccattgagatgtcgatgccctggatcctgacggaccacatcctggagaccaaggaggcatcgatgatggagtacgtgctctactccctggacctgtacaatgacagcgcccactacgcgctcaccaggttcaacaagcagttcctgtacgacgaaattgaggccgaggtgaatctatgttttgaccaatttgtttacaagctagcagaccagatatttgcctattataaggttatggcaggaagtttgcttcttgataaacggttacgatcagaatgcaagaatcagggagccacgatccacctcccgccgtctaaccgctacgagacgctgctgaagcagaggcatgtgcagctcctcggcagatcaatagacctcaatcgtctgatcacccagcgcgtctcagcagccatgtataagtccctagaactggcgattggacgatttgaaagtgaagatttgacctccatagttgagctggatggcctgttggaaatcaaccgcatgacccacaagctgctgagccggtacctgacgctggacggcttcgacgccatgttccgggaggccaaccacaacgtgtcagcgccctacgggaggatcaccctgcacgtcttctgggagctcaactatgacttcctgcccaactactgctacaacggctctaccaaccggtttgttcggacagtgttaccattttctcaggaatttcaaagagataagcagcctaatgcacagcctcagtatctgcatggatccaaggctttgaacttggcctactccagcatttacggcagctaccggaacttcgtgggacctccacactttcaagtcatctgccggcttctcggctaccagggtatcgccgtggtcatggaggagctgctgaaggtcgtcaagagcctgctgcaaggcacaatcctgcagtacgtgaagacgctgatggaggtgatgcccaagatctgccgcctgccccggcacgagtacggctctcctggtatcctggagttcttccaccaccagctgaaggacatcgtggagtacgcagagctgaagacggtgtgcttccagaacctgcgggaggtggggaacgccatcctcttctgcctgctcatcgagcagagcctgtctttagaagaagtgtgtgacctgctgcacgcggctcctttccagaacatcttgccgcgagtccatgtgaaagagggggagagacttgatgccaaaatgaaaagactagaatcaaagtacgccccgctgcatcttgtcccactgattgaaagactggggacccctcagcaaattgccatcgcaagagagggggacctgctgacaaaggagcgcctctgctgcggcctgtccatgtttgaggtcatcctgacacggatccggagctttctggatgaccccatctggcgcgggcctctgcccagcaatggggtcatgcatgtggacgagtgtgtggagtttcacagactgtggagtgccatgcagtttgtctactgcattcccgtggggacacacgagttcacagtcgagcagtgctttggtgatgggctacactgggctggctgtatgatcatcgtacttcttgggcagcagcggcgttttgctgtgctggatttctgctaccatctacttaaagtccagaaacatgatggcaaagatgagattattaaaaatgtgcctttgaagaagatggtggagagaattcgcaagttccagattctcaatgatgagatcatcaccatcctggataagtacctgaagtcaggcgacggggagggcacgccagtggagcatgtgcgctgcttccagccgcccatccaccagtccctcgccagcagctgagggcacgcgctgcactccgtaactcaacatggcatgcctttctctccgtaaactatttagtgagatttttagggactatttttcagtatctctgtacctgttaaagggggtgcttttcgatctaaaaacttaattttataaaattgacttatttttctcagcactcaacacattgtcatcatgctcttcgcgtcacttcaggcacaactcttgcagcacatcatctgcgctgccctgcattgtatgcccatccaccgttcctcacacaacattggtattctcattgggcatgttccttggccagcttgttgtccatcacacacatgcgctagcctaggcgttccatatccattaccattcaccatcaaggcacacactctcaagtcacccagcgaccattgccatttcacacagtccccatatgccccaagtttcacccattataacaacgttggtcacactcaatcttcacgctatgatctagtcttcacggggcaatccttttccctttgcaatcggggtcctttgtgatcataggcaaggcaaagtagctttcaaggtttacttacacatgttcgactatgagttatctccaccaatacacccctatatgataatacaggtgtggtagttatattagcaaggcacaacagcaattacagcgttggcaacctttctctgcaacttatacaccagccattaggagtctatttatccccagctgacgaagaagttcgccgaaggattttgtgttggacacgaaacagagaaattcgtataaacagcagggttgggcaaccaattccgcagggaacattgtgaggcacacaaggggggtttcaacttaaagcaaaaactgtacacgcaagacgttcacacttggcagggaatttcgtttaaacagaaaagaactactagaagaggaagaagtatctagaagcagagaaatgatatcgtgagcgagaggggagaacactacaccaacccaacgccaaccagcgagaggagtacttgtacacggacacagacgaaaacaacaaagcgcacacgggagctacacaaacaacgcaagacaccaatagggggcgaccacacccactatgtggggaggacgcaacaaaatacaaagagatcggaaagagattcaaaccccacctgagaacgaaccaccacacaagaagcacaatcaaagacgaatgatgaggcaacacaaacaaacacgagaatgggagaacgcacaacacaaatctcagcacgcacgcaaggagggcaccccccccgaccagaataaataaagagcagag

SEQ ID NO: 75953 - DNA, 1244 bp, Homo sapiens
tagaggttacttgcgatgtcgcgtgcatgtgaagagggggagagacttgatgccaaaatgaaaagactagaatcaaagtacgccccgctgcatcttgtcccactgattgaaagactggggacccctcagcaaattgccatcgcaagagagggggacctgctgacaaaggagcgcctctgctgcggcctgtccatgtttgaggtcatcctgacacggatccggagctttctggatgaccccatctggcgcgggcctctgcccagcaatggggtcatgcatgtggacgagtgtgtggagtttcacagactgtggagtgccatgcagtttgtctactgcattcccgtggggacacacgagttcacagtcgagcagtgctttggtgatgggctacactgggctggctgtatgatcatcgtacttcttgggcagcagcggcgttttgctgtgctggatttctgctaccatctacttaaagtccagaaacatgatggcaaagatgagattattaaaaatgtgcctttgaagaagatggtggagagaattcgcaagttccagattctcaatgatgagatcatcaccatcctggataagtacctgaagtcaggcgacggggagggcacgccagtggagcatgtgcgctgcttccagccgcccatccaccagtccctcgccagcagctgagggcacgcgctgcactccgtaactcaacatggcatgcctttctctccgtaaactatttagtgagatttttagggactatttttcagtatctctgtacctgttaaagggggtgcttttcgatctaaaaacttaattttataaaattgacttatttttctagactaaaattgtatatgcttttggtaattaggaactcttgagaatattggctgctgattgttgccatcacgttcctacaaaattgtttttctatgggatgttctggcagctgtgtcataaaatgctgctgggttcattcattcattccataagaaacttaataccagcaaatgcattaaatcccttgccagttaccattaactgtaactatttagcttttgtttagggatctttctgatggtcttttatgagcaatcttagttctaagtcattgttcccatcccttttttgtgtgtttcagaaaatagtgaacttgattcccctgcttccactaaatccagttgtgacaaaatctaacgtgacatcagatcgaaaggttatagaaataaaactaatgagatcta

SEQ ID NO: 75954 - DNA, 2458 bp, Homo sapiens
cccgggaggaaggggaggaggccgagtgtttcctggcgcattcccggccagcccgagtgactcactcggccaaggaaactcccagggcccgcccaggacccccaagccgccgcggacgcagcccaggatggcggcccaggtgactctggaggacgcgctgtccaacgtggacctcctggaggagctgcccctgcccgaccagcagccctgcatcgagcccccgccatcctcgctgctctaccagccaaatttcaacactaactttgaagacagaaatgcatttgttactggcatcgcaagatacattgaacaagccaccgtccactctagcatgaacgagatgctggaggagggccaagaatatgctgtcatgctgtacacctggaggagctgctcccgggccatcccacaggtgaaatgtaacgagcagcctaacagagtggaaatctacgagaaaaccgtggaggttctggagcctgaggtcacaaaactgatgaatttcatgtacttccagagaaatgccattgagcgtttctgcggggaagtgaggcgcctgtgccatgccgagaggaggaaggacttcgtgtcagaagcctacctgatcacactgggcaaattcatcaacatgttcgctgtgctggacgagctgaagaacatgaagtgcagtgtgaagaacgaccactcagcgtacaagagggccgctcagtttttacgtaaaatggcagatccacagtccatccaggaatcgcagaatctgtccatgttcctggccaatcataacaagatcacacagtctctgcagcagcagctcgaagtgatttctggctacgaagagctcctggcagatattgtgaatctgtgtgtggattactacgagaacaggatgtatttgacgcccagtgagaaacacatgcttctcaaagtcatgggatttggtctgtacctgatggatgggagtgtcagtaacatctataagttggatgccaagaaaagaataaacttatccaaaatcgacaagtacttcaagcaactccaggtggttccgctatttggggacatgcaaatagaactggcaagatatatcaagaccagcgcccactacgaggaaaataaatctcgatggacgtgcacatcctccggcagcagccctcagtacaacatctgcgagcagatgatccagatccgcgaggaccacatgcgcttcatttcggagctggcgcgctacagcaacagcgaggtggtcacgggctcgggccgccaggaggcccagaagacggacgcggagtaccgcaagctcttcgacctggcgctgcagggcctgcagctgttgtcgcagtggagcgcgcacgtgatggaagtgtattcctggaagcttgtgcaccccaccgacaagtactccaacaaggactgccccgacagcgctgaagagtacgagcgtgccacgcgctacaactacaccagcgaggagaagtttgccctagtggaggtgaggatgctcggccgctcgctcttcctcatgtcgctctagcttcacaccatcttctctgtcaaaagcaaaaacatgaacaaaactgcctgtttactcattgcttctgtgtgggcacccctttccatctggcagagtagtcagagtagaacgcattagagaaacagtggttgtcggtcctgggtctgcactgaagctccctgggtgcgaatctggactcctggacctgcgtctggatggagagcagtgtcgggtgcggggaagggaggtgaaagagatgtggcccctgctgagagagaagagctgtcttgctctcctgtgaggcaggcgctgcactcccctcgtgagcctttccatgggcagctcttcattccagcatcaactggtatcttttctttcatagctgtgcttttcctgtgctgtttgagaaatctttgcatactctcaggtcgtgaaggtattctgcattgctttctggatacttcactctgctttcacactgagatgcgaaattcacctgaaattcatttttgaaacaattccgtccaaccctcacgctgccacctttgtagctggtcacgtgacaatgcatgtgtggctgtgtttctgctctgctctaacccagtgtcagttgctgtcggtatcccagcaccactctgtagctttgtagtcatctaccgtgtatgagaaagcacgtctttctgtctcctagacttccttggctattcttccccactgtagtttcatattcattttagaatcagcttttcccatcccacagtgaggattttaatcaggatatgaacaatcctatggatcatgacaggagaattgacagaagtctcatacagttggccctcagtgttcttgggttccacctccatgaaccaaccttgggtcaaaaatgttcagaaagaaaaaataacactacaacagtgaaaagtaataaaaatgttaaaaaccactgttttg

SEQ ID NO: 75955 - DNA, 505 bp, Homo sapiens
ggtaaacagcacagatgctgggagagggctggcatctgaccgtgaccatcacgcccatgtgacaaaggatgtcaccacagtgaacagttctgaccacagtggcttttcacctgcttcgttaaatttaactcacaccggctcagaggacaatttgattcattctgtatctcagcagaaaccagagcacctcagaagatcaaggcttccaaattctcctgggggaacagacgtcagccattcagcacaaaggaaacttccttctctgtatgtcagaggaagacataattgtgccatttccttcttgaagaagtttacaaacatttgcaagttgtcaaaaataattagtctaaaattgtttcataaaccgtggaatgaaacaggacgtgccttgttgagatcaaagggcttctgttaccttcttgtaaactcaaatgaaattcttttgaaagtaaaatcttggaattagcagtggtttttgtggcacatgtatggcagggggagggga

SEQ ID NO: 75956 - DNA, 501 bp, Homo sapiens
  misc_feature (16)..(16): n is a, c, g, or t
  misc_feature (76)..(76): n is a, c, g, or t
ttagctgctctccccnatttctcctttcctctccattcttcttcccttctcccatatatccccttcctaaccacancttcctcagcggccgcataacaaatgtttcaacgatggtgcagaaagggaccagcttgacgaagcttctgcttttgtgactgtctcctaatgcagaaaccagagcacctcagaagatcaaggcttccaaattctcctgggggaacagacgtcagccattcagcacaaaggaaacttccttctctgtatgtcagaggaagacataattgtgccatttccttcttgaagaagtttacaaacatttgcaagttgtcaaaaataattagtctaaaattgtttcataaaccgtggaatgaaacaggacgtgccttgttgagatcaaagggcttctgttaccttcttgtaaactcaaatgaaattcttttgaaagtaaaatcttggaattagcagtggtttttgtggcacatgtatggcagggggagggga

SEQ ID NO: 75957 - DNA, 685 bp, Homo sapiens
cgcccgttttcccgcgggaaagccgaggcccggtgctgtattctgccgcccattttacccgcggggaagctgaggcccagtgctgtttaatatcttactcatgttcacttgatgagaaagtgacagatctgagacaaacccagttctagaggttatgacaccagccatggaagagcagagaggccaatgaggtggggaggttggaaacaaaaggccttctccaccccagcttgaccaacccaaaagctggaaggcaaggaagacctagatcgacagaaaagaaatgagtcaacgatggtgcagaaagggaccagcttgacgaagcttctgcttttgtgactgtctcctaatgcagaaaccagagcacctcagaagatcaaggcttccaaattctcctgggggaacagacgtcagccattcagcacaaaggaaacttccttctctgtatgtcagaggaagacataattgtgccatttccttcttgaagaagtttacaaacatttgcaagttgtcaaaaataattagtctaaaattgtttcataaaccgtggaatgaaacaggacgtgccttgttgagatcaaagggcttctgttaccttcttgtaaactcaaatgaaattcttttgaaagtaaaatcttggaattagcagtggtttttgtggcacatgtatggcagggggagggga

SEQ ID NO: 75958 - DNA, 525 bp, Homo sapiens
cgcccgttttcccgcgggaaagccgaggcccggtgctgtattctgccgcccattttacccgcggggaagctgaggcccagtgctgtttaatatcttactcatgttcacttgatgagaaagtgacagatctgagacaaacccagaaagggaccagcttgacgaagcttctgcttttgtgactgtctcctaatgcagaaaccagagcacctcagaagatcaaggcttccaaattctcctgggggaacagacgtcagccattcagcacaaaggaaacttccttctctgtatgtcagaggaagacataattgtgccatttccttcttgaagaagtttacaaacatttgcaagttgtcaaaaataattagtctaaaattgtttcataaaccgtggaatgaaacaggacgtgccttgttgagatcaaagggcttctgttaccttcttgtaaactcaaatgaaattcttttgaaagtaaaatcttggaattagcagtggtttttgtggcacatgtatggcagggggagggga

SEQ ID NO: 75959 - DNA, 560 bp, Homo sapiens
cgcccgttttcccgcgggaaagccgaggcccggtgctgtattctgccgcccattttacccgcggggaagctgaggcccagtgctgtttaatatcttactcatgttcacttgatgagaaagtgacagatctgagacaaacccagatcgacagaaaagaaatgagtcaacgatggtgcagaaagggaccagcttgacgaagcttctgcttttgtgactgtctcctaatgcagaaaccagagcacctcagaagatcaaggcttccaaattctcctgggggaacagacgtcagccattcagcacaaaggaaacttccttctctgtatgtcagaggaagacataattgtgccatttccttcttgaagaagtttacaaacatttgcaagttgtcaaaaataattagtctaaaattgtttcataaaccgtggaatgaaacaggacgtgccttgttgagatcaaagggcttctgttaccttcttgtaaactcaaatgaaattcttttgaaagtaaaatcttggaattagcagtggtttttgtggcacatgtatggcagggggagggga

SEQ ID NO: 75960 - DNA, 880 bp, Homo sapiens
cgcccgttttcccgcgggaaagccgaggcccggtgctgtattctgccgcccattttacccgcggggaagctgaggcccagtgctgtttaatatcttactcatgttcacttgatgagaaagtgacagatctgagacaaacccagttctagaggttatgacaccagccatggaagagcagagaggccaatgaggtggggaggttggaaacaaaaggccttctccaccccagcttgaccaacccaaaagctggaaggcaaggaagacctagacagaatttaagagacaccagaggatggcacatttatactgagcttgcagtttcctaaacatgaagaagatgaacggctctcagttaagcagcacgggtcagataggagcttgaaattgaatatttgagctgacacgggagagacatacttttgagattccaaatacgatttctgtggagaaaacaaaaaaggactctgtttttaattcaaaagggagaagtgaaattctacctcacttttttaaaagaagagcctggaattggcctatccgtctttttccccgttggatcacagagcagaaaggaaggtgggcgtttgtgttctgggtgttgtccacgctggacgtgccagcatctcccactgagccagatgttccagggctaaggccagtttcatttgaaggcacagccttactatatcatattaatctgatgccaagtttttggatgttatgagcaaccacctcatttattttttgtggttgtttaaccacaatgagtaagtcatgccgtgagggcccagagactgtgtcactgttgtgatgatagagtgcagggcccttcaaagggaggtctgtgggccagcagcacccaaggtaaccctggggagct

SEQ ID NO: 75961 - DNA, 891 bp, Homo sapiens
cgcccgttttcccgcgggaaagccgaggcccggtgctgtattctgccgcccattttacccgcggggaagctgaggcccagtgctgtttaatatcttactcatgttcacttgatgagaaagtgacagatctgagacaaacccagttctagaggttatgacaccagccatggaagagcagagaggccaatgaggtggggaggttggaaacaaaaggccttctccaccccagcttgaccaacccaaaagctggaaggcaaggaagacctagacagaatttaagagacaccagaggatggcacatttatactgagcttgcagtttcctaaacatgaagaagatgaacggctctcagttaagcagcacgggtcagataggagcttgaaattgaatatttgagctgacacgggagagacatacttttgagattccaaatacgatttctgtggagaaaacaaaaaaggactctgtttttaattcaaaagggagaagtgaaattctacctcacttttttaaaagaagagcctggaattggcctatccgtctttttccccgttggatcacagagcagaaaggaagctaagacctctagtacagtgttcaatggaactggtgagaaaagacgtccttgctgtgttcctgatatgaagaggaaagcagtccttctccattaaatgctgacaacatgagcctcccgtggtcggaacgggcttgtgaaggcggtgctggggtgcaccagggcagcagctacagggtcaagcctgagacacctgaagccctggacttggaatctgaagctgtcatcagccagtacacctatgaacctgtggaagacctgaagtacctgtttaaaagacagccaaaagataagtaaatacttcccaaatttccttg

SEQ ID NO: 75962 - DNA, 457 bp, Homo sapiens
tctccccatcgtgacttacagcatatgtgttaatctccctgtgaattctgagctcccaaatgctgaaggagatatgctaaaccctttccccgtggcgttcttccagacagaatttaagagacaccagaggatggcacatttatactgagcttgcagtttcctaaacatgaagaagatgaacggctctcagttaagcagcacgggtcagataggagcttgaaattgaatatttgagctgacacgggagagacatactgtgagtggccccacgaagttagctggatctctaagcttcctaagacaccatgattagaaatagattgaggtcagggtatgcggtcctatttgaattaatgaaaagccaaattgctcctcagagtgctggtttttgtgctgcaggtcagaccactgggttttgtggaccctttgcagaggtcgggggagcagctgggctctg

SEQ ID NO: 75963 - DNA, 429 bp, Homo sapiens
ttgtctggtttgttcatccctgttttcttaagagcctggtctgtaaatactccatagtacaattgaatgtgtggacaatgctaaagtaatgtttgtctttttctttctctagccacccaaacagccatgttgacttgtttttatttcatagggcctgggtataaaaaaaggaccttaatctttgcgatggatagttctttggttttctccatgattggcgtgggaatttattcccctgggtgattttttggggaggcctctgtgatgagaaaagtggctgtttgtgaacgagacccaataaacctccccatcccagagtttgcaaagcattttcacttacgtccccatctacactgatctgcgactgtggggattatttttttttttttctacagatggatagtgaatggcagaaagagaccccaggag

SEQ ID NO: 75964 - DNA, 452 bp, Homo sapiens
gttttgcacacaatttctgctagcaagattacaaccttaatggaaacacacaacgtattttaaaagttactaataataattccttagcattatctaatagccagtccatattcaaatttcaccagttgctaaaaatgccttttaacatttgaattgttccaatgaagatttaaccaacgttcatgtgttctattaggtcttgctgtcttgagcgtgtcttctctccttttttcctcttgccattgattgctttacatagcagttgcaaagcaagggtcatgatgaactaagtttctctgatttcatattaggttttctttctaccataccagtgaggaaaggaagatatttcttccaaggtctgaaagatttaattgtaactagttacatttttgtttattatagtcaagcatgtatcaaaatgaatttctattaaattcattcatttggaa

SEQ ID NO: 75965 - DNA, 449 bp, Homo sapiens
aaatcctctgtgttctgcctgtcatcccttcatctcctctaatcctggcaacattttttctgtctccatagttttacctttgatcttttatatcatatagttgaaattatacagtgtgtagccttttcaaattgacttctttcacttagtaatgtggatttcagtttcctccatgtcttttcatggcttgataatgcatttctttttagagccaaattatgttccatcgtctggatgtttatttattcacctactgaaggactgttggatgcttccttttggcaattatgaggaaagctgttataaatatctgtgcaggctttttgtgtggacataactgaaatatttttaaagttatatttattgaggtataatttacattcagtaatagtcacactttttagtgtagagttctgagttttgacagttgtatctaatcatgcaatcaa

SEQ ID NO: 75966 - DNA, 346 bp, Homo sapiens
tcaaatttaggttggcagctgttgttagtgtcaggacttaaataactttgctttgttaaaaaataaattcacaacatatgaatttcagcatgttgtgaatttattgtttgtgcttattagggaaagatacttcagttgaaaaaataagaaattctccagggtataaaaaaaccatccttgttagtagacaagtgatcatagtcttatcaagacatccatcctcagccggttgttgtgacttatgcctgtaaccccagcactttggaaggctgaggcagaaggattgcttgagtccaggagttcaagaccagcctgggcaacatgttgaaaccccatctctacaaaa

SEQ ID NO: 75967 - DNA, 552 bp, Homo sapiens
gggatatctgtgtgcaaacactagtttaactaaaggatatacttttattttacaaagacttgtctaaaatacctgttcctgacatgcaaacaaaaatagataatttgttcttttattcctaaatctatttaatttggtgtaattcagagtgatctttgaggatagaaagataatgcccaactgaagttaatattcttactgcctggaataagaataaagaattttagcagttcttaaaatatggagcagagcattagaatacctgcttttatgaaaaattttatacatttaaatttatataatgaaaatctttaggaaccaggccctagttaaacaggggaatcaaatatttatattactaaagttattaacaaaactttggagaccttattgcttatgggcaaaagcacagagtttgaaatattgattagagagtaagttctttaggagtcctagattttattttttcttgcttactgcctagagcaatgcctagcacctagcaaacactcaacaaatatttattaaatgactggatggatgggtggatgg

SEQ ID NO: 75968 - DNA, 316 bp, Homo sapiens
taacctgcttttatctcttccgcgtttgacacataaactcttttgaaaagcatgaaaccttttcaaaaagagcctttcttatggccgggcatggtggctcacacctgtaatcccagcactctgggaggccaaggtgcgcagattacttgaggtcagaagtttgagaccagcctggccaacctgctgaaaccccatctctactaaaaatacaaaaattagccaggcgtggtggcacatgtctgtaatcccagccaaaaccccgccattgattgcactccagcctgggtgacagcagagtgatactgtgtctccaaaa

SEQ ID NO: 75969 - DNA, 3039 bp, Homo sapiens
  misc_feature (2325)..(2325): n is a, c, g, or t
  misc_feature (2332)..(2332): n is a, c, g, or t
  misc_feature (2339)..(2339): n is a, c, g, or t
  misc_feature (2352)..(2352): n is a, c, g, or t
  misc_feature (2371)..(2371): n is a, c, g, or t
  misc_feature (2378)..(2378): n is a, c, g, or t
  misc_feature (2396)..(2396): n is a, c, g, or t
  misc_feature (2398)..(2398): n is a, c, g, or t
  misc_feature (2428)..(2428): n is a, c, g, or t
  misc_feature (2457)..(2457): n is a, c, g, or t
  misc_feature (2460)..(2460): n is a, c, g, or t
cttaacctactcattatgcagatgaggacaccagaatccagagatactggcttgcttaaaattgccaggagttggcgtgtgagccaggctggatctgcgtccctgcctccagggccagtgtcctctcactgcattgagctcctagcctcaggctctgggatggtggactaactcctcccgccccatcctcggctcgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaagcttcaataacacatttacagcttcagaaagcaagcagtgttttgcttcataggacctgatagccatgcatcttgagagtgaggaaaagttacttgccaacacactggttccactggtagtgctggaggtagccctgggggcagctgcacctgtagcccccaatgatgttctggcagccatgctggcagcggtggttaccctcacactcttgcttgtcntcacagngggagcngttctgatcaagngagaatccccgcaggcatncacaggngaagcttccagggggtgntntggcaaatgcccttgagacccgcacaggtngatgtcagagggcattcattgttatcaangcnggacgtatggtgtggggtaaatccgggaggacatttgcatgggaagccgccgatggtgttaacacataggaactggcagttgtgttgcttggttgcacactcatcaagatagtgaccccagatgtaaaataagttccacatttgagaagaacaaagctatgagcgacttcatgtaagatgtttagaatgtgtaagtaggtctcttcaaattattttaatcacctacaacttttaaactaaactttaagctgtttaagtcaccttcattttaatgtaaaagcattgcccttctattggtattaattcggggctctgtagtcctttctctcaattttcttttaaatacattttttactccatgaagaagcttcatctcaacctccgtcatgttttagaaaccttttatcttttccttcctcatgctactcttctaagtcttcatattttctcttaaaatcttaagctattaaaattacgttaaaaacttaacgctaagcaatatcttagtaacctattgactatattttttaagtagttgtattaatctctatctttgaaagagaaaaaaacttatctgcg

SEQ ID NO: 75970 - DNA, 740 bp, Homo sapiens
gtgcctgcctttgctagatgagatgattgttcatcttggctttgtcagacccagccttgcagatgtgacagaacctgctctcgctggctgacagcccttgcatggccctttctctgcaggcccttggcgctgcaggaactcttggccacacctattttataggggagggacgtccctgagccccgtatgcttgtaagatgggatgagcaggcggcctgtgacccgtctgctttcttgaccttgacctcgatgtgggccttctccaacagtctcagaaccaaggactgggaatctcagtcccatgcagggccttggttcctctagtgatgggaagtgactaccctttgtctccctgggctggctgtggtaacttggctctgtctcttgtagccttctgcagtggcgaagcactttgttgccctgtctactaacacagtaagtgcccccgtggtcccctgtactgccttcctgggagtgcccagcatgtccaggtcatggcctctcagagacgcggttcgtaggtctggtggatcttggcttggctgatggtatggaaggtttggttgcctgtgggctgcaagccttccttgccttttccgcatttacccattcaacctctgcagctttgaggagggaggcttggagtcagtgggatcacgataaccccttcttccgtctcccaggcctgactgatacacagaacccttcatacacatgaccttcctaggcctttgtgccca

SEQ ID NO: 75971 - DNA, 229 bp, Homo sapiens
ccgggagcccttaaccctgtaaggtagagaggccctcagagaggcttggagggcaagagcaacccaggcaggatgagggctccacttccacctgagggcgggctgagcttgcagggccacatgacactcccttgggtgcctgcctgcaacacccactgtggggtaacccgagtcccccttgccacgctcacagagttgaggttgtgagttattctcagtgatgaccttt

SEQ ID NO: 75972 - DNA, 2125 bp, Homo sapiens
gggccgggccgggcgcctgcgccataaaggccgccgcgcgcccacgcgcctcgcttgctgcgcgctgccggcgctccttcctcctcggctcgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcc

SEQ ID NO: 75973 - DNA, 1556 bp, Homo sapiens
  misc_feature (1442)..(1442): n is a, c, g, or t
  misc_feature (1455)..(1455): n is a, c, g, or t
  misc_feature (1519)..(1519): n is a, c, g, or t
gggccgggccgggcgcctgcgccataaaggccgccgcgcgcccacgcgcctcgcttgctgcgcgctgccggcgctccttcctcctcggctcgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcacccatacggaaggtctgctcacaagatcctcctggcaattcttggccagaaagagcctgatgaggggaaatcgacggnggggccgaagagntccaggtggggacaatcacagacttggaggtgtgcctagttgggaatcccacacttgtgttccngccctttgtggctgtccttttgacaattgggacggac

SEQ ID NO: 75974 - DNA, 2409 bp, Homo sapiens
actgaccaccccaccagtcctctgccccagtccctctgccttcactcccatggccacctgtgctccagggcctgcctgacccctgtccagcggccctgaagtaaggtctgtgatgtctaaatgccgatacctcagtttccccatctttagaacggggctcttgtttggaactgtgcccgccacagcctgcacgcctagaacactgcctgtaacgtggaaggtgttcgatctatagagttttgtcgaatgaatgaatgaagccgactagtgcacagggagtgcagcggcgcgatggtagctctctgcagcctccaacacctgggctccagtgatccccgggctctgcccaccctccccactgccacttccgggcagaggccagcaaagcggcggcgcaagagcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcc

SEQ ID NO: 75975 - DNA, 1097 bp, Homo sapiens
  misc_feature (981)..(981): n is a, c, g, or t
  misc_feature (989)..(989): n is a, c, g, or t
  misc_feature (1000)..(1000): n is a, c, g, or t
  misc_feature (1002)..(1002): n is a, c, g, or t
  misc_feature (1010)..(1010): n is a, c, g, or t
  misc_feature (1017)..(1017): n is a, c, g, or t
  misc_feature (1026)..(1026): n is a, c, g, or t
  misc_feature (1028)..(1030): n is a, c, g, or t
  misc_feature (1034)..(1034): n is a, c, g, or t
  misc_feature (1036)..(1036): n is a, c, g, or t
  misc_feature (1045)..(1045): n is a, c, g, or t
  misc_feature (1061)..(1061): n is a, c, g, or t
gggccgggccgggcgcctgcgccataaaggccgccgcgcgcccacgcgcctcgcttgctgcgcgctgccggcgctccttcctcctcggctcgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattggcctnacgtgggntttggcacctncngcgtggcncggggcnccggttggncnnnttcngngagctgganaaaccccgtgttgctntgggttggcacacacgttgggttagcaccaatgtcc

SEQ ID NO: 75976 - DNA, 2084 bp, Homo sapiens
tccactcaccactcaacacccaccccacccggcactaccggctaggtacgaggccggggtgtaatcggcgagggtacccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcc

SEQ ID NO: 75977 - DNA, 1039 bp, Homo sapiens
  misc_feature (874)..(874): n is a, c, g, or t
  misc_feature (893)..(893): n is a, c, g, or t
  misc_feature (902)..(902): n is a, c, g, or t
  misc_feature (907)..(907): n is a, c, g, or t
  misc_feature (916)..(916): n is a, c, g, or t
gggccgggccgggcgcctgcgccataaaggccgccgcgcgcccacgcgcctcgcttgctgcgcgctgccggcgctccttcctcctcggctcgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcaggggaagcacttgtgcctgttataacacaccaaagtnagagttgggaatgacctcnaaaatgtcnagtcnggatggggnggaccaaccggggcgcacgactccttgcgcctggttgaactccagcacggtcgggccatggggccttcccacctgaaaacctggggccggtcgcaccggggtacacccgcaaaacctgacagg

SEQ ID NO: 75978 - DNA, 1358 bp, Homo sapiens
  misc_feature (1244)..(1244): n is a, c, g, or t
  misc_feature (1257)..(1257): n is a, c, g, or t
  misc_feature (1321)..(1321): n is a, c, g, or t
aaaggctaggtaggaggcctgggtgttggacgctttcaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcacccatacggaaggtctgctcacaagatcctcctggcaattcttggccagaaagagcctgatgaggggaaatcgacggnggggccgaagagntccaggtggggacaatcacagacttggaggtgtgcctagttgggaatcccacacttgtgttccngccctttgtggctgtccttttgacaattgggacggac

SEQ ID NO: 75979 - DNA, 1119 bp, Homo sapiens
  misc_feature (1005)..(1005): n is a, c, g, or t
  misc_feature (1018)..(1018): n is a, c, g, or t
  misc_feature (1082)..(1082): n is a, c, g, or t
tccgggtgtgaatcggccgaggctagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcacccatacggaaggtctgctcacaagatcctcctggcaattcttggccagaaagagcctgatgaggggaaatcgacggnggggccgaagagntccaggtggggacaatcacagacttggaggtgtgcctagttgggaatcccacacttgtgttccngccctttgtggctgtccttttgacaattgggacggac

SEQ ID NO: 75980 - DNA, 855 bp, Homo sapiens
  misc_feature (759)..(759): n is a, c, g, or t
  misc_feature (799)..(799): n is a, c, g, or t
  misc_feature (838)..(838): n is a, c, g, or t
  misc_feature (850)..(850): n is a, c, g, or t
  misc_feature (855)..(855): n is a, c, g, or t
gggccgggccgggcgcctgcgccataaaggccgccgcgcgcccacgcgcctcgcttgctgcgcgctgccggcgctccttcctcctcggctcgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacntttactaccccagaaaaacatcaccgaattgcaaaaaacngggaaaaggaattgttttctccaagccgggcaaagggantcttcctgccantgggn

SEQ ID NO: 75981 - DNA, 1111 bp, Homo sapiens
  misc_feature (997)..(997): n is a, c, g, or t
  misc_feature (1010)..(1010): n is a, c, g, or t
  misc_feature (1074)..(1074): n is a, c, g, or t
tatttacagtacctggcctggcgtttgttgtacatactgtgacgtggttgtagactaataatgaatgtctctctgccagtcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcacccatacggaaggtctgctcacaagatcctcctggcaattcttggccagaaagagcctgatgaggggaaatcgacggnggggccgaagagntccaggtggggacaatcacagacttggaggtgtgcctagttgggaatcccacacttgtgttccngccctttgtggctgtccttttgacaattgggacggac

SEQ ID NO: 75982 - DNA, 772 bp, Homo sapiens
gggccgggccgggcgcctgcgccataaaggccgccgcgcgcccacgcgcctcgcttgctgcgcgctgccggcgctccttcctcctcggctcgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgttcacatcccatgtagaaaaataaagatgccacggaggaggttgtaggctcagcctctgattttttttttcc

SEQ ID NO: 75983 - DNA, 829 bp, Homo sapiens
gggccgggccgggcgcctgcgccataaaggccgccgcgcgcccacgcgcctcgcttgctgcgcgctgccggcgctccttcctcctcggctcgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaaccatgggcatatcctggtggattactccaagaacctggtgacggaggacgtgatgcggatgctggtggacttggccaagtccaggggcgtgtaggccgccgggagcggatttcactggtgggtgatctatcgtgtagagtcacttatga

SEQ ID NO: 75984 - DNA, 743 bp, Homo sapiens
gggccgggccgggcgcctgcgccataaaggccgccgcgcgcccacgcgcctcgcttgctgcgcgctgccggcgctccttcctcctcggctcgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcc

SEQ ID NO: 75985 - DNA, 532 bp, Homo sapiens
gtcactggcgtgctggtcatggactgatctggtgtccagcttggggtgggcagatcctgggccctgccctcgactcacaggctgctccagccctgccccatccctggctctggggaaggtgaggctcagctcacggagcacagctccctgcctcccggagctcctgttcccatcccgctagcaaatgcttctttgcatttctctccctttgtttttttttttgtagaccaaagtgaaggagtttggaattgaccctcaaaacatgttcgagttctgggatgtaagtacaagcacttctgcactgggtgaattaagtgtcctttgccaagtcatggctgttgagaggcccatgaggtcaggtcagtgtttattgagtacctgctgcatacctagcttggggaaaggtagagaggccctcagagaggcttggagggcaagagcaacccaggcaggatgagggctccacttccacctgagggcgggctgagcttgcagggccacatgacactcccttgggtgcctgcctgcaaca

SEQ ID NO: 75986 - DNA, 947 bp, Homo sapiens
  misc_feature (782)..(782): n is a, c, g, or t
  misc_feature (801)..(801): n is a, c, g, or t
  misc_feature (810)..(810): n is a, c, g, or t
  misc_feature (815)..(815): n is a, c, g, or t
  misc_feature (824)..(824): n is a, c, g, or t
agcggccgggtgagtcggacgagggcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcaggggaagcacttgtgcctgttataacacaccaaagtnagagttgggaatgacctcnaaaatgtcnagtcnggatggggnggaccaaccggggcgcacgactccttgcgcctggttgaactccagcacggtcgggccatggggccttcccacctgaaaacctggggccggtcgcaccggggtacacccgcaaaacctgacagg

SEQ ID NO: 75987 - DNA, 2121 bp, Homo sapiens
tctgatctctagaggatccttaagcgcacgatggccgtcacgcgcctcgcttgctgcgcgctgccggcgctccttcctcctcggctcgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcc

SEQ ID NO: 75988 - DNA, 2066 bp, Homo sapiens
  misc_feature (17)..(17): n is a, c, g, or t
taggctaggtacaggcngggtgtcctcggctcgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcc

SEQ ID NO: 75989 - DNA, 2045 bp, Homo sapiens
taggctagtagaggctgggtgttaatcgacgaggtggcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcc

SEQ ID NO: 75990 - DNA, 1178 bp, Homo sapiens
gggccgggccgggcgcctgcgccataaaggccgccgcgcgcccacgcgcctcgcttgctgcgcgctgccggcgctccttcctcctcggctcgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctactaacacagtaagtgcccccgtggtcccctgtactgccttcctgggagtgcccagcatgtccaggtcatggcctctcagagacgcggttcgtaggtctggtggatcttggcttggctgatggtatggaaggtttggttgcctgtgggctgcaagccttccttgccttttccgcatttacccattcaacctctgcagctttgaggagggaggcttggagtcagtgggatcacgataaccccttcttccgtctcccaggcctgactgatacacagaacccttcatacacatgaccttcctaggcctttgtgccca

SEQ ID NO: 75991 - DNA, 1396 bp, Homo sapiens
  misc_feature (1282)..(1282): n is a, c, g, or t
  misc_feature (1295)..(1295): n is a, c, g, or t
  misc_feature (1359)..(1359): n is a, c, g, or t
cctgtgcaccccttccagtcaccgctccggacacgctggcagaaagacttcatcttgtccagaaccttgttgacctctggcatcacttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcacccatacggaaggtctgctcacaagatcctcctggcaattcttggccagaaagagcctgatgaggggaaatcgacggnggggccgaagagntccaggtggggacaatcacagacttggaggtgtgcctagttgggaatcccacacttgtgttccngccctttgtggctgtccttttgacaattgggacggac

SEQ ID NO: 75992 - DNA, 1198 bp, Homo sapiens
  misc_feature (23)..(23): n is a, c, g, or t
  misc_feature (26)..(26): n is a, c, g, or t
  misc_feature (31)..(31): n is a, c, g, or t
  misc_feature (1084)..(1084): n is a, c, g, or t
  misc_feature (1097)..(1097): n is a, c, g, or t
  misc_feature (1161)..(1161): n is a, c, g, or t
attagggcatggggggaacatcnggnagatncatgatattatcaaggtctaagctttcattagggatgctggcttcccaggtgcttagaacattaataaaggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcacccatacggaaggtctgctcacaagatcctcctggcaattcttggccagaaagagcctgatgaggggaaatcgacggnggggccgaagagntccaggtggggacaatcacagacttggaggtgtgcctagttgggaatcccacacttgtgttccngccctttgtggctgtccttttgacaattgggacggac

SEQ ID NO: 75993 - DNA, 824 bp, Homo sapiens
  misc_feature (800)..(800): n is a, c, g, or t
  misc_feature (820)..(820): n is a, c, g, or t
  misc_feature (824)..(824): n is a, c, g, or t
gggccgggccgggcgcctgcgccataaaggccgccgcgcgcccacgcgcctcgcttgctgcgcgctgccggcgctccttcctcctcggctcgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaagcttactaccaggagacatcacaatgccaaacgcaaagatggttntcagcggcaagatcttttgngggn

SEQ ID NO: 75994 - DNA, 996 bp, Homo sapiens
  misc_feature (882)..(882): n is a, c, g, or t
  misc_feature (895)..(895): n is a, c, g, or t
  misc_feature (959)..(959): n is a, c, g, or t
gggctggctgcgcgcggccggcgctcgttcctcctcggttccgaccgtgggacccctcatggtgactgaagcccttaagccatactcttcaggaggtccccgcgtctggtatgtctccaacattgatggaactcacattgccaaaaccctggcccagctgaaccccgagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcacccatacggaaggtctgctcacaagatcctcctggcaattcttggccagaaagagcctgatgaggggaaatcgacggnggggccgaagagntccaggtggggacaatcacagacttggaggtgtgcctagttgggaatcccacacttgtgttccngccctttgtggctgtccttttgacaattgggacggac

SEQ ID NO: 75995 - DNA, 1965 bp, Homo sapiens
ggacgcgtgggtcgacccacgcgatcgattatcatttatttattattattattttttagtagagatgggcttttgccatgttggccatgctggtcttgaactcctgacctcaggtgatgcacccccccttggcctcccaaagtgctgggattacagtcttgagccgccatgcccagccatgcttgctcctttctgatcccagagccatgccctgataatagaggggttttgtttgtttttatttatgttctatttactcacatgaatgtacataaaatatgaagaattccatctgaattctgagataccttccagcctgggccgaagagagcctcaggttgactgcagcccctcaggggagaagctgcggcctttgacctgcaggcttagggttggggggtgtgtttaccgtcccccctcctctggttttaaagagctggaatctcaggaggttatgtggcgtcactgtcactgacctgcaaatactgctccatgggacagctgggcattgccttggcctctactgctgaaccctggctcaaggcctgcacccacccctaagctcgggcgcccactgctgttctctttggttgcagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcc

SEQ ID NO: 75996 - DNA, 1264 bp, Homo sapiens
tctgatctctagaggatccttaagcgcacgatggccgtcacgcgcctcgcttgctgcgcgctgccggcgctccttcctcctcggctcgcgtctcactcagtgtaccttctagtcccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttgggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcc

SEQ ID NO: 75997 - DNA, 2743 bp, Homo sapiens
  misc_feature (38)..(39): n is a, c, g, or t
  misc_feature (58)..(58): n is a, c, g, or t
tcaaaaaatcacagtgctgcctaggaggggaaatgccnnagccagtcacccaacacangtaggctcagcctccagcagctttgaagggggcagaaagggaggatgaaaggcgggaaggctgggagaagctggggtcagggagatctgttagctcagcatgacccaggaagaggcaggagaggaaggggtgaattcctttccttctttcactccgttgagcaaagtgagtctcctctacacagtaattatgggtcaacaggcaagagcaagttcttctgcttgaggcagaaaaaataatgcctcagtgaactgcagcttagttcacaaaactttgtgtgaataaatcagatattcccattttgtaaaaagatataaacactcaggaaatacctactcaaatatttgttctaagttctctcgaaatgtttgaggtttccagaatgtctgttacatttcttatatgacatttagaagcctcactgattatccttgacttatatatatttaaaatgtggtttagtttgggcatcttcccagaagccctaattttgagagagcactgttacaatagatttgtcttcctggttatttttcctatggattctattttaaagttacaattttaaaattattatctatgaatttcttcaaaaattcctacaaaaaactatgaaaatgtgttttttagtaagagaggcacccaaatgcctctatctgttaaaccttggactcctcacccctaggataacaccatgaactgcagacaaatgtatctgaggcatttgtaagaagtggctcattccacagctataattctcagctaaagtcctggaagaagttggaaatggagcatttatcaagagcaaaaggaagacttggctggaacaaaccgtgccctatttccctggaatggagacttcttcagaggtagctgggcagaggctgagctagcatgacacaccaagttgcccactgagtccacactgggttctagacagagaggatgtggcgtgggatgacctcagggtgttggagaaaggccatgaagaaatccacttaaataaaatagggacccaaactttatgctggacaatgaaaatgtccagtgttacattgtggggactttatcccaaaaactgaaacaaaaactctgaaaataagttatctgatattaaacataattttggacgtagttctaaccaagctaccgttcttagaaaataagcaggaattaagtgttgattatttctcatctgggtgatttttctggcaaaaatccacattagtacaattaaatagcctctcttttatacagagagcttatcagcaagaccataaagaaagtcggttttgcagagacaggcaggggctttatttcctgaagggccgctgataacccttgataagcatatcattctctctgaaggcacatcctgtttgccatcttcctgatcattttctcctcttcagtagggaatgagttcgtctctactaaatcatcattgtcagtgatgtaccccccgccaagaggggcggaggttcccaacctcccagcccatgactttatgaaattccacatctgtcacaagattgcacatcttactttgcaaggcatttgcactggattatcgggtaggatcctgactcagagagagactgaactacagggaactggatgcctctgcggaggttgatgagaggtagggaagacggatgttggggataagggagagggggactcgttgttaaagatggccagttcatagggagtatccttgtttaggacaactttgaccgaacatactcaaccttctgacttttcagaatcagatagctggggttctctgcatatcatctggatttttgaacccaaccctttggcctcagtttcctggatattttggataaaagcacacccccattttgcctgagttatcttgcaaacagccccgatttttggcttcatttattgtctgggttttgataccagatgaacatttttggagcatccactgtgtgcaaaactccaaggagccactggggcttctgcagagcccctgccgcatgcttttctccaagatgccatctggagaaccccatcctgcacagtttcaagcagcacttctgggacgcttggttgtcctgcctctctggtgaccccagctcttttcacatcactttgcttgccatgcacaactgcaattatttgtgtgccagtctccctccacttcaccctcacgggcagccccagggcatgggctcaccaccctccttgggtctctacttgtgcttttctccatcactgggtaacgctgagcgaatatgtctccctgactcagcttctcccagccttcccacttctcatcctctccttctgcccacctcaaagctgctggaggctgagcctatgtgtgttgggtgactggctaaggcatttcccctcctaggcagcactgtgattttttttaaaaaatcatccttattgaagtggaggtgtggacccctttcccgactcagaggactgtggtgaggacaaggaagatggcatcaaaccacttgcattttatttggtatttctcaaagccccttaacatcaactatctcaacattattccccccagtcaccatgtgtggtaggcatgaaagatactgtccctaaagtgggttgataaagtagtagttagagtgactatgctcagagaaggtgtgatttgcccaaaattatacaacttgtgagtggtga

SEQ ID NO: 75998 - DNA, 879 bp, Homo sapiens
cagctgtatcccatagagttgccacccaggcctcagccaggacctttcaggccagacaggagcacctgaccaaaggcttcacagccgccctcaccgcccggccttctacggtgtccagagacagttagccaggcctgggctgggcacactccaccttccctagtcaccagctggtttcccagaggagaaggctgagacccgagaagggagccagcctgtcccatgcctgcctggggagccctgttcctgctctgggccacagcagaggccaccaaggactgccccagcccatgtacctgccgcgccctggaaaccatggggctgtgggtggactgcaggggccacggactcacggccctgcctgccctgccggcccgcacccgccaccttctgctggccaacaacagccttcagtccgtgcccccgggagcctttgaccacctgccccagctgcagaccctcgatgtgacgcagaacccctggcactgtgactgcagcctcacctatctgcgcctctggctggaggaccgcacgcccgaggccctgctgcaggtccgctgtgccagccccagcctcgctgcccatggcccgctgggccggctgacaggctaccagctgggcagctgtggctggcagctgcaggcgtcctgggtgcgcccgggggtcttgtgggacgtggcgctggtcgccgtggccgcgctgggcctggctcttctggctggcctgctgtgtgccaccacagaggccctggattgagccaggcccccagaacccctggctccaggccagggggccagtccctgaggcaggtccccagactccaccaagcctggtcagcccaaaccaccagaagcccagaataaactggcagctcagctg

SEQ ID NO: 75999 - DNA, 438 bp, Homo sapiens
gtaattccatataattttaaaagtgttttttttctaatttctgtgaaaaatgttactggtattttgatagagattacactgaatcagtagactagtccgggtagtatagatgtttaaataatattaataaattcaatccattaacatgaatttttttttacttgtttggtgctctctttatgtaatcagttagttaaagtttttattgtagagctcattcacttatttggctaagtacatttctaggtattggattttatttgtagccatagtaaatagtatttttaatttttttccagatggtttatgtttgacatatagaaattcgaccgattttatgggttttcctttgtatctagcaactttagtcaattcatgtgttctaacttttttggtggagactttaggttttctcaaatataagattattttatctgc

SEQ ID NO: 76000 - DNA, 3426 bp, Homo sapiens
gcagccgagcagcctggcaacggcggtggcgcccggagcccgagagtttccaggatggcttctgcatcaacttctaaatataattcacactccttggagaatgagtctattaagaggacgtctcgagatggagtcaatcgagatctcactgaggctgttcctcgacttccaggagaaacactaatcactgacaaagaagttatttacatatgtcctttcaatggccccattaagggaagagtttacatcacaaattatcgtctttatttaagaagtttggaaacggattcttctctaatacttgatgttcctctgggtgtgatctcgagaattgaaaaaatgggaggcgcgacaagtagaggagaaaattcctatggtctagatattacttgtaaagacatgagaaacctgaggttcgctttgaaacaggaaggccacagcagaagagatatgtttgagatcctcacgagatacgcgtttcccctggctcacagtctgccattatttgcatttttaaatgaagaaaagtttaacgtggatggatggacagtttacaatccagtggaagaatacaggaggcagggcttgcccaatcaccattggagaataacttttattaataagtgctatgagctctgtgacacttaccctgctcttttggtggttccgtatcgtgcctcagatgatgacctccggagagttgcaacttttaggtcccgaaatcgaattccagtgctgtcatggattcatccagaaaataagacggtcattgtgcgttgcagtcagcctcttgtcggtatgagtgggaaacgaaataaagatgatgagaaatatctcgatgttatcagggagactaataaacaaatttctaaactcaccatttatgatgcaagacccagcgtaaatgcagtggccaacaaggcaacaggaggaggatatgaaagtgatgatgcatatcataacgccgaacttttcttcttagacattcataatattcatgttatgcgggaatctttaaaaaaagtgaaggacattgtttatcctaatgtagaagaatctcattggttgtccagtttggagtctactcattggttagaacatatcaagctcgttttgacaggagccattcaagtagcagacaaagtttcttcagggaagagttcagtgcttgtgcattgcagtgacggatgggacaggactgctcagctgacatccttggccatgctgatgttggatagcttctataggagcattgaagggttcgaaatactggtacaaaaagaatggataagttttggacataaatttgcatctcgaataggtcatggtgataaaaaccacaccgatgctgaccgttctcctatttttctccagtttattgattgtgtgtggcaaatgtcaaaacagttccctacagcttttgaattcaatgaacaatttttgattataattttggatcatctgtatagttgccgatttggtactttcttattcaactgtgaatctgctcgagaaagacagaaggttacagaaaggactgtttctttatggtcactgataaacagtaataaagaaaaattcaaaaaccccttctatactaaagaaatcaatcgagttttatatccagttgccagtatgcgtcacttggaactctgggtgaattactacattagatggaaccccaggatcaagcaacaacagccgaatccagtggagcagcgttacatggagctcttagccttacgcgacgaatacataaagcggcttgaggaactgcagctcgccaactctgccaagctttctgatcccccaacttcaccttccagtccttcgcaaatgatgccccatgtgcaaactcacttctgaggggggaccctggcaccgcattagagctcgaaataaaggcgatagctgactttcatttggggcatttgtaaaaagtagattaaaatatttgcctccatgtagaacttgaactaacataatcttaaactcttgaatatgtgccttctagaatacatattacaagaaaactacagggtccacacggcaatcagaagaaaggagctgagatgaggttttggaaaaccctgacacctttaaaaagcagtttttgaaagacaaaatttagatttaatttacgtcttgagaaatactatatatacaatatatattttgtgggcttaattgaaacaacattattttaaaatcaaaggggatatatgtttgtggaatggattttcctgaagctgcttaacagttgctttggattctctaagatgaatccaaatgtgaaagatgcatgttactgccaaaaccaaattgagctcagcttcctaggcattacccaaaagcaaggtgtttaagtaattgccagcttttataccatcatgagtggtgacttaaggagaaatagctgtatagatgagtttttcattatttggaaatttaggggtagaaaatgttttcccctaattttccagagaagcctatttttatatttttaaaaaactgacagggcccagttaaatatgatttgcattttttaaatttgccagttttattttctaaattctttcatgagcttgcctaaaattcggaatggttttcgggttgtggcaaaccccaaagagagcactgtccaaggatgtcgggagcatcctgctgcttaggggaatgttttcgcaaatgttgctctagtcagtccagctcatctgccaaaatgtagggctaccgtcttggatgcatgagctattgctagagcatcatccttagaaatcagtgccccagatgtacatgtgttgagcgtattcttgaaagtattgtgtttatgcatttcaatttcaatggtgttggcttcccctccccaccccacgcgtgcataaaaactggttctacaaatttttacttgaagtaccaggccgtttgctttttcaggttgttttgttttatagtattaagtgaaattttaaatgcacagttctatttgctatctgaactaattcatttattaagtatatttgtaaaagctaaggctcgagttaaaacaatgaagtgttttacaatgatttgtaaaggactatttataactaatatggttttgttttcaatgaattaagaaagattaaatatatctttgtaaattattttatgtcatagtttaattggtctaccaagtaagacatctcaaatacagtagtataatgtatgaattttgtaagtataagaaattttattagacattctcttactttttgtaaatgctgtaaatatttcataaattaacaaagtgtcactccataaaaagaaagctaatactaatagcctaaaagattttgtgaaatttcatgaaaactttttaatggcaataatgactaaagacctgctgtaataaatgtattaactgaaacctaacactgttttcag

SEQ ID NO: 76001 - DNA, 849 bp, Homo sapiens
gcagccgagcagcctggcaacggcggtggcgcccggagcccgagagtttccaggatggcttctgcatcaacttctaaatataattcacactccttggagaatgagtctattaagaggacgtctcgagatggagtcaatcgagatctcactgaggctgttcctcgacttccaggagaaacactaatcactggattcttctctaatacttgatgttcctctgggtgtgatctcgagaattgaaaaaatgggaggcgcgacaagtagaggagaaaattcctatggtctagatattacttgtaaagacatgagaaacctgaggttcgctttgaaacaggaaggccacagcagaagagatatgtttgagatcctcacgagatacgcgtttcccctggctcacagtctgccattatttgcatttttaaatgaagaaaagtttaacgtggatggatggacagtttacaatccagtggaagaatacaggaggcagggcttgcccaatcaccattggagaataacttttattaataagtgctatgagctctgtgacacttaccctgctcttttggtggttccgtatcgtgcctcagatgatgacctccggagagttgcaacttttaggtcccgaaatcgaattccagtgctgtcatggattcatccagaaaataagacggtcattgtgcgttgcagtcagcctcttgtcggtatgagtgggaaacgaaataaagatgatgagaaatatctcgatgttatcagggagactaataaacaaatttctaaactcaccatttatgatgcaagacccagcgtaaatgcagtggccaacaaggtgagtggacttaatgatgtgct

SEQ ID NO: 76002 - DNA, 3372 bp, Homo sapiens
gcagccgagcagcctggcaacggcggtggcgcccggagcccgagagtttccaggatggcttctgcatcaacttctaaatataattcacactccttggagaatgagtctattaagaggacgtctcgagatggagtcaatcgagatctcactgaggctgttcctcgacttccaggagaaacactaatcactgacaaagaagttatttacatatgtcctttcaatggccccattaagggaagagtttacatcacaaattatcgtctttatttaagaagtttggaaacggattcttctctaatacttgatgttcctctgggtgtgatctcgagaattgaaaaaatgggaggcgcgacaagtagaggagaaaattcctatggtctagatattacttgtaaagacatgagaaacctgaggttcgctttgaaacaggaaggccacagcagaagagatatgtttgagatcctcacgagatacgcgtttcccctggctcacagtctgccattatttgcatttttaaatgaagaaaagtttaacgtggatggatggacagtttacaatccagtggaagaatacaggaggcagggcttgcccaatcaccattggagaataacttttattaataagtgctatgagctctgtgacacttaccctgctcttttggtggttccgtatcgtgcctcagatgatgacctccggagagttgcaacttttaggtcccgaaatcgaattccagtgctgtcatggattcatccagaaaataagacggtcattgtgcgttgcagtcagcctcttgtcggtatgagtgggaaacgaaataaagatgatgagaaatatctcgatgttatcagggagactaataaacaaatttctaaactcaccatttatgatgcaagacccagcgtaaatgcagtggccaacaaggcaacaggaggaggatatgaaagtgatgatgcatatcataacgccgaacttttcttcttagacattcataatattcatgttatgcgggaatctttaaaaaaagtgaaggacattgtttatcctaatgtagaagaatctcattggttgtccagtttggagtctactcattggttagaacatatcaagctcgttttgacaggagccattcaagtagcagacaaagtttcttcagggaagagttcagtgcttgtgcattgcagtgacggatgggacaggactgctcagctgacatccttggccatgctgatgttggatagcttctataggagcattgaagggttcgaaatactggtacaaaaagaatggataagttttggacataaatttgcatctcgaataggtcatggtgataaaaaccacaccgatgctgaccgttctcctatttttctccagtttattgattgtgtgtggcaaatgtcaaaacagttccctacagcttttgaattcaatgaacaatttttgattataattttggatcatctgtatagttgccgatttggtactttcttattcaactgtgaatctgctcgagaaagacagaaggttacagaaaggactgtttctttatggtcactgataaacagtaataaagaaaaattcaaaaaccccttctatactaaagaaatcaatcgagttttatatccagttgccagtatgcgtcacttggaactctgggtgaattactacattagatggaaccccaggatcaagcaacaacagccgaatccagtggagcagcgttacatggagctcttagccttacgcgacgaatacataaagcggcttgaggaactgcagctcgccaactctgccaagctttctgatcccccaacttcaccttccagtccttcgcaaatgatgccccatgtgcaaactcacttctgaggggggaccctggcaccgcattagagctcgaaataaaggcgatagctgactttcatttggggcatttgtaaaaagtagattaaaatatttgcctccatgtagaacttgaactaacataatcttaaactcttgaatatgtgccttctagaatacatattacaagaaaactacagggtccacacggcaatcagaagaaaggagctgagatgaggttttggaaaaccctgacacctttaaaaagcagtttttgaaagacaaaatttagatttaatttacgtcttgagaaatactatatatacaatatatattttgtgggcttaattgaaacaacattattttattgctttggattctctaagatgaatccaaatgtgaaagatgcatgttactgccaaaaccaaattgagctcagcttcctaggcattacccaaaagcaaggtgtttaagtaattgccagcttttataccatcatgagtggtgacttaaggagaaatagctgtatagatgagtttttcattatttggaaatttaggggtagaaaatgttttcccctaattttccagagaagcctatttttatatttttaaaaaactgacagggcccagttaaatatgatttgcattttttaaatttgccagttttattttctaaattctttcatgagcttgcctaaaattcggaatggttttcgggttgtggcaaaccccaaagagagcactgtccaaggatgtcgggagcatcctgctgcttaggggaatgttttcgcaaatgttgctctagtcagtccagctcatctgccaaaatgtagggctaccgtcttggatgcatgagctattgctagagcatcatccttagaaatcagtgccccagatgtacatgtgttgagcgtattcttgaaagtattgtgtttatgcatttcaatttcaatggtgttggcttcccctccccaccccacgcgtgcataaaaactggttctacaaatttttacttgaagtaccaggccgtttgctttttcaggttgttttgttttatagtattaagtgaaattttaaatgcacagttctatttgctatctgaactaattcatttattaagtatatttgtaaaagctaaggctcgagttaaaacaatgaagtgttttacaatgatttgtaaaggactatttataactaatatggttttgttttcaatgaattaagaaagattaaatatatctttgtaaattattttatgtcatagtttaattggtctaccaagtaagacatctcaaatacagtagtataatgtatgaattttgtaagtataagaaattttattagacattctcttactttttgtaaatgctgtaaatatttcataaattaacaaagtgtcactccataaaaagaaagctaatactaatagcctaaaagattttgtgaaatttcatgaaaactttttaatggcaataatgactaaagacctgctgtaataaatgtattaactgaaacctaacactgttttcag

SEQ ID NO: 76003 - DNA, 3235 bp, Homo sapiens
gcagccgagcagcctggcaacggcggtggcgcccggagcccgagagtttccaggatggcttctgcatcaacttctaaatataattcacactccttggagaatgagtctattaagaggacgtctcgagatggagtcaatcgagatctcactgaggctgttcctcgacttccaggagaaacactaatcactgacaaagaagttatttacatatgtcctttcaatggccccattaagggaagagtttacatcacaaattatcgtctttatttaagaagtttggaaacggattcttctctaatacttgatgttcctctgggtgtgatctcgagaattgaaaaaatgggaggcgcgacaagtagaggagaaaattcctatggtctagatattacttgtaaagacatgagaaacctgaggttcgctttgaaacaggaaggccacagcagaagagatatgtttgagatcctcacgagatacgcgtttcccctggctcacagtctgccattatttgcatttttaaatgaagaaaagtttaacgtggatggatggacagtttacaatccagtggaagaatacaggaggcagggcttgcccaatcaccattggagaataacttttattaataagtgctatgagctctgtgacacttaccctgctcttttggtggttccgtatcgtgcctcagatgatgacctccggagagttgcaacttttaggtcccgaaatcgaattccagtgctgtcatggattcatccagaaaataagacggtcattgtgcgttgcagtcagcctcttgtcggtatgagtgggaaacgaaataaagatgatgagaaatatctcgatgttatcagggagactaataaacaaatttctaaactcaccatttatgatgcaagacccagcgtaaatgcagtggccaacaaggcaacaggaggaggatatgaaagtgatgatgcatatcataacgccgaacttttcttcttagacattcataatattcatgttatgcgggaatctttaaaaaaagtgaaggacattgtttatcctaatgtagaagaatctcattggttgtccagtttggagtctactcattggttagaacatatcaagctcgttttgacaggagccattcaagtagcagacaaagtttcttcagggaagagttcagtgcttgtgcattgcagtgacggatgggacaggactgctcagctgacatccttggccatgctgatgttggatagcttctataggagcattgaagggttcgaaatactggtacaaaaagaatggataagttttggacataaatttgcatctcgaataggtcatggtgataaaaaccacaccgatgctgaccgttctcctatttttctccagtttattgattgtgtgtggcaaatgtcaaaacagttccctacagcttttgaattcaatgaacaatttttgattataattttggatcatctgtatagttgccgatttggtactttcttattcaactgtgaatctgctcgagaaagacagaaggttacagaaaggactgtttctttatggtcactgataaacagtaataaagaaaaattcaaaaaccccttctatactaaagaaatcaatcgagttttatatccagttgccagtatgcgtcacttggaactctgggtgaattactacattagatggaaccccaggatcaagcaacaacagccgaatccagtggagcagcgttacatggagctcttagccttacgcgacgaatacataaagcggcttgaggaactgcagctcgccaactctgccaagctttctgatcccccaacttcaccttccagtccttcgcaaatgatgccccatgtgcaaactcacttctgaggggggaccctggcaccgcattagagctcgaaataaaggcgatagctgactttcatttggggcatttgtaaaaagtagattaaaatatttgcctccatgtagaacttgaactaacataatcttaaactcttgaatatgtgccttctagaatacatattacaagaaaactacagggtccacacggcaatcagaagaaaggagctgagatgaggttttggaaaaccctgacacctttaaaaagcagtttttgaaagacaaaatttagatttaatttacgtcttgagaaatactatatatacaatatatattttgtgggcttaattgaaacaacattattttaaaatcaaaggggatatatgtttgtggaatggattttcctgaagctgcttaacagttgctttggattctctaagatgaatccaaatgtgaaagatgcatgttactgccaaaaccaaattgagctcagcttcctaggcattacccaaaagcaaggtgtttaagtaattgccagcttttataccatcatgagtggtgacttaaggagaaatagctgtatagatgagtttttcattatttggaaatttaggggtagaaaatgttttcccctaattttccagagaagcctatttttatatttttaaaaaactgacagggcccagttaaatatgatttgcattttttaaatttgccagttttattttctaaattctttcatgagcttgcctaaaattcggaatggttttcgggttgtggcaaaccccaaagagagcactgtccaaggatgtcgggagcatcctgctgcttaggggaatgttttcgcaaatgttgctctagtcagtccagctcatctgccaaaatgtagggctaccgtcttggatgcatgagctattgctagagcatcatccttagaaatcagtgccccagatgtacatgtgttgagcgtattcttgaaagtattgtgtttatgcatttcaatttcaatggtgttggcttcccctccccaccccacgcgtgcataaaaactggttctacaaatttttacttgaagtaccaggccgtttgctttttcaggttgttttgttttatagtattaagtgaaattttaaatgcacagttctatttgctatctgaactaattcatttattaagtatatttgtaaaagctaaggctcgagttaaaacaatgaagtgttttacaatgatttgtaaaggactatttataactaatatggttttgttttcaatgaattaagaaagattaaatatatctttgtaaattattttatgtcttacttggtagaccaattaaactatgacataaaataatttacaaagatatatttaatctttcttaattcattgtcgacgc

SEQ ID NO: 76004 - DNA, 3019 bp, Homo sapiens
gcagccgagcagcctggcaacggcggtggcgcccggagcccgagagtttccaggatggcttctgcatcaacttctaaatataattcacactccttggagaatgagtctattaagaggacgtctcgagatggagtcaatcgagatctcactgaggctgttcctcgacttccaggagaaacactaatcactgacaaagaagttatttacatatgtcctttcaatggccccattaagggaagagtttacatcacaaattatcgtctttatttaagaagtttggaaacggattcttctctaatacttgatgttcctctgggtgtgatctcgagaattgaaaaaatgggaggcgcgacaagtagaggagaaaattcctatggtctagatattacttgtaaagacatgagaaacctgaggttcgctttgaaacaggaaggccacagcagaagagatatgtttgagatcctcacgagatacgcgtttcccctggctcacagtctgccattatttgcatttttaaatgaagaaaagtttaacgtggatggatggacagtttacaatccagtggaagaatacaggaggcagggcttgcccaatcaccattggagaataacttttattaataagtgctatgagctctgtgacacttaccctgctcttttggtggttccgtatcgtgcctcagatgatgacctccggagagttgcaacttttaggtcccgaaatcgaattccagtgctgtcatggattcatccagaaaataagacggtcattgtgcgttgcagtcagcctcttgtcggtatgagtgggaaacgaaataaagatgatgagaaatatctcgatgttatcagggagactaataaacaaatttctaaactcaccatttatgatgcaagacccagcgtaaatgcagtggccaacaaggcaacaggaggaggatatgaaagtgatgatgcatatcataacgccgaacttttcttcttagacattcataatattcatgttatgcgggaatctttaaaaaaagtgaaggacattgtttatcctaatgtagaagaatctcattggttgtccagtttggagtctactcattggttagaacatatcaagctcgttttgacaggagccattcaagtagcagacaaagtttcttcagggaagagttcagtgcttgtgcattgcagtgacggatgggacaggactgctcagctgacatccttggccatgctgatgttggatagcttctataggagcattgaagggttcgaaatactggtacaaaaagaatggataagttttggacataaatttgcatctcgaataggtcatggtgataaaaaccacaccgatgctgaccgttctcctatttttctccagtttattgattgtgtgtggcaaatgtcaaaacagttcaccttccagtccttcgcaaatgatgccccatgtgcaaactcacttctgaggggggaccctggcaccgcattagagctcgaaataaaggcgatagctgactttcatttggggcatttgtaaaaagtagattaaaatatttgcctccatgtagaacttgaactaacataatcttaaactcttgaatatgtgccttctagaatacatattacaagaaaactacagggtccacacggcaatcagaagaaaggagctgagatgaggttttggaaaaccctgacacctttaaaaagcagtttttgaaagacaaaatttagatttaatttacgtcttgagaaatactatatatacaatatatattttgtgggcttaattgaaacaacattattttaaaatcaaaggggatatatgtttgtggaatggattttcctgaagctgcttaacagttgctttggattctctaagatgaatccaaatgtgaaagatgcatgttactgccaaaaccaaattgagctcagcttcctaggcattacccaaaagcaaggtgtttaagtaattgccagcttttataccatcatgagtggtgacttaaggagaaatagctgtatagatgagtttttcattatttggaaatttaggggtagaaaatgttttcccctaattttccagagaagcctatttttatatttttaaaaaactgacagggcccagttaaatatgatttgcattttttaaatttgccagttttattttctaaattctttcatgagcttgcctaaaattcggaatggttttcgggttgtggcaaaccccaaagagagcactgtccaaggatgtcgggagcatcctgctgcttaggggaatgttttcgcaaatgttgctctagtcagtccagctcatctgccaaaatgtagggctaccgtcttggatgcatgagctattgctagagcatcatccttagaaatcagtgccccagatgtacatgtgttgagcgtattcttgaaagtattgtgtttatgcatttcaatttcaatggtgttggcttcccctccccaccccacgcgtgcataaaaactggttctacaaatttttacttgaagtaccaggccgtttgctttttcaggttgttttgttttatagtattaagtgaaattttaaatgcacagttctatttgctatctgaactaattcatttattaagtatatttgtaaaagctaaggctcgagttaaaacaatgaagtgttttacaatgatttgtaaaggactatttataactaatatggttttgttttcaatgaattaagaaagattaaatatatctttgtaaattattttatgtcatagtttaattggtctaccaagtaagacatctcaaatacagtagtataatgtatgaattttgtaagtataagaaattttattagacattctcttactttttgtaaatgctgtaaatatttcataaattaacaaagtgtcactccataaaaagaaagctaatactaatagcctaaaagattttgtgaaatttcatgaaaactttttaatggcaataatgactaaagacctgctgtaataaatgtattaactgaaacctaacactgttttcag

SEQ ID NO: 76005 - DNA, 3372 bp, Homo sapiens
gcagccgagcagcctggcaacggcggtggcgcccggagcccgagagtttccaggatggcttctgcatcaacttctaaatataattcacactccttggagaatgagtctattaagaggacgtctcgagatggagtcaatcgagatctcactgaggctgttcctcgacttccaggagaaacactaatcactgacaaagaagttatttacatatgtcctttcaatggccccattaagggaagagtttacatcacaaattatcgtctttatttaagaagtttggaaacggattcttctctaatacttgatgttcctctgggtgtgatctcgagaattgaaaaaatgggaggcgcgacaagtagaggagaaaattcctatggtctagatattacttgtaaagacatgagaaacctgaggttcgctttgaaacaggaaggccacagcagaagagatatgtttgagatcctcacgagatacgcgtttcccctggctcacagtctgccattatttgcatttttaaatgaagaaaagtttaacgtggatggatggacagtttacaatccagtggaagaatacaggaggcagggcttgcccaatcaccattggagaataacttttattaataagtgctatgagctctgtgacacttaccctgctcttttggtggttccgtatcgtgcctcagatgatgacctccggagagttgcaacttttaggtcccgaaatcgaattccagtgctgtcatggattcatccagaaaataagacggtcattgtgcgttgcagtcagcctcttgtcggtatgagtgggaaacgaaataaagatgatgagaaatatctcgatgttatcagggagactaataaacaaatttctaaactcaccatttatgatgcaagacccagcgtaaatgcagtggccaacaaggcaacaggaggaggatatgaaagtgatgatgcatatcataacgccgaacttttcttcttagacattcataatattcatgttatgcgggaatctttaaaaaaagtgaaggacattgtttatcctaatgtagaagaatctcattggttgtccagtttggagtctactcattggttagaacatatcaagctcgttttgacaggagccattcaagtagcagacaaagtttcttcagggaagagttcagtgcttgtgcattgcagtgacggatgggacaggactgctcagctgacatccttggccatgctgatgttggatagcttctataggagcattgaagggttcgaaatactggtacaaaaagaatggataagttttggacataaatttgcatctcgaataggtcatggtgataaaaaccacaccgatgctgaccgttctcctatttttctccagtttattgattgtgtgtggcaaatgtcaaaacagttccctacagcttttgaattcaatgaacaatttttgattataattttggatcatctgtatagttgccgatttggtactttcttattcaactgtgaatctgctcgagaaagacagaaggttacagaaaggactgtttctttatggtcactgataaacagtaataaagaaaaattcaaaaaccccttctatactaaagaaatcaatcgagttttatatccagttgccagtatgcgtcacttggaactctgggtgaattactacattagatggaaccccaggatcaagcaacaacagccgaatccagtggagcagcgttacatggagctcttagccttacgcgacgaatacataaagcggcttgaggaactgcagctcgccaactctgccaagctttctgatcccccaacttcaccttccagtccttcgcaaatgatgccccatgtgcaaactcacttctgaggggggaccctggcaccgcattagagctcgaaataaaggcgatagctgactttcatttggggcatttgtaaaaagtagattaaaatatttgcctccatgtagaacttgaactaacataatcttaaactcttgaatatgtgccttctagaatacatattacaagaaaactacagggtccacacggcaatcagaagaaaggagctgagatgaggttttggaaaaccctgacacctttaaaaagcagtttttgaaagacaaaatttagatttaatttacgtcttgagaaatactatatatacaatatatattttgtgggcttaattgaaacaacattattttaaaatcaaaggggatatatgtttgtggaatggattttcctgaagctgcttaacagttgctttggattctctaagatgaatccaaatgtgaaagatgcatgttactgcctaattgccagcttttataccatcatgagtggtgacttaaggagaaatagctgtatagatgagtttttcattatttggaaatttaggggtagaaaatgttttcccctaattttccagagaagcctatttttatatttttaaaaaactgacagggcccagttaaatatgatttgcattttttaaatttgccagttttattttctaaattctttcatgagcttgcctaaaattcggaatggttttcgggttgtggcaaaccccaaagagagcactgtccaaggatgtcgggagcatcctgctgcttaggggaatgttttcgcaaatgttgctctagtcagtccagctcatctgccaaaatgtagggctaccgtcttggatgcatgagctattgctagagcatcatccttagaaatcagtgccccagatgtacatgtgttgagcgtattcttgaaagtattgtgtttatgcatttcaatttcaatggtgttggcttcccctccccaccccacgcgtgcataaaaactggttctacaaatttttacttgaagtaccaggccgtttgctttttcaggttgttttgttttatagtattaagtgaaattttaaatgcacagttctatttgctatctgaactaattcatttattaagtatatttgtaaaagctaaggctcgagttaaaacaatgaagtgttttacaatgatttgtaaaggactatttataactaatatggttttgttttcaatgaattaagaaagattaaatatatctttgtaaattattttatgtcatagtttaattggtctaccaagtaagacatctcaaatacagtagtataatgtatgaattttgtaagtataagaaattttattagacattctcttactttttgtaaatgctgtaaatatttcataaattaacaaagtgtcactccataaaaagaaagctaatactaatagcctaaaagattttgtgaaatttcatgaaaactttttaatggcaataatgactaaagacctgctgtaataaatgtattaactgaaacctaacactgttttcag

SEQ ID NO: 76006 - DNA, 708 bp, Homo sapiens
gcagatgttggatgactttccagaccagttttggaaaaagctcttgaggatcagaagctcctgggatttctgttatcacctgatttcatggagagagacagtccagggccgggaattatgtggcatctatgtgttccccagttgtgggatccatctggccgatggttatggtggtcagtgactttcagaggcctggaattcatgacagatgcttttgctaatgtgcttggtgccccactgaggctgctgagcagtgcttaccatgcgcccgatgtctcttctgtgtgcctctgagagcaaaagtggcctcagagtctgaaggagggcaaagtggccacagctgcagacacaaagtccagactagctcttgaccacatccaagtgcatcctgcattaagctcaggcacatcaaacctgcccaatcaaggtctgccaaaggaaggagtctgcaaatgacatttctcataatcaaacacactcttaatttgtttttatattattcactccattttttgattattataacttttaaaattatgtctagtagttttatcaattgctgagaagagtgttgaagtccaacttacaattgtggatttgttgatttcttctttcagctttattggttttggtttatgcattttaaggctctgctcttggtgtgtacacatgtaaaaccattttgtcttcatagtaaattaattttta

SEQ ID NO: 76007 - DNA, 806 bp, Homo sapiens
gcagatgttggatgactttccagaccagttttggaaaaagctcttgaggatcagaagctcctgggatttctgttatcacctgatttcatggagagagacagtccagggccgggaattatgtggcatctatgtgttccccagttgtgggatccatctggccgatggttatggtggtcagtgactttcagaggcctggaattcatgacagatgcttttgctaatgtgcttggtgccccactgaggctgctgagcagtgcttaccatgcgcccgatgtctcttctgtgtgcctctgagagcaaaagtggcctcagagtctgaaggagggcaaagtggccacagctgcagacacaaagtccagactagctcttgaccacatccaagtgcatcctgcattaagctcaggcacatcaaacctgcccaatcaaggtctgccaaaggaaggagtctgcaaatgacatttctcataatcaaacacactcttaatttgtttttatattattcactccattttttgattattataacttttaaaattatgtctagtagttttatcaattgctgagaagagtgttgaagtccaacttacaattgtggatttgttgatttcttctttcagctttattggttttggtttatgcattttaaggctctgctcttggtgtgtacacatgtaaaaccattttgtcttcatagtaaattaatttttaaaaatcattatgtaatgtccctctttgctccagtaattctttgctctgaggtctactgtattagtattaatatagcgacttctacttttaagttaata

SEQ ID NO: 76008 - DNA, 286 bp, Homo sapiens
ccatccctcctcaatcacgccaaagaagacctgtttagcatacaaaatcaagctgtgaggagtaaaactttggcaatgtcatttcatcacagcacagagccactgtgagtccagcacctcttatgaaaagaaaacagacggccaggcaccgtggctgacacctgtcatccgagcactttgggaggctgaggcaggtggatcacttgaggccaggagttcgaaaccagcctgcccaacaggtgaaaccccgtctctactaaaaatacaaaaaaaaagaaaaatcagg

SEQ ID NO: 76009 - DNA, 906 bp, Homo sapiens
cagctacttgggaggctgaggcatgagaatcgcttgaacccaggtggcggaggttgcagtaagtcgagatcacgccattgcgcttcagcctaggggacaagagcgagacttcgtctcaaaaaaaaagaaaagaagctcataataatataattccatttacctcactccagctctttgtggtgttgttgtcatatattatttctacgtgtcacaaatataatactttgttactgttattcttgctttaatttttaactattttcaaaaataatcttatatttactcacattactatttctggttctccttatttctttcctcagattcatttttttttttaaatctaagataatttccctttggctttaaaaaaaaaaacctttctttaccatttcacttagtgtgcatctcttggtgatgcattttctcagcttttatatgaaaacatctttatttcaccttcattttttgaaggatattgtcactagatttagaattctaggtttataaaataatgatgcggtcatgtttttatgatttatgttttaaaaaataatcctcatgtcgtagagacaaatactgaagtatttgttcaaaatgaaattatctgggctgggcgtggtggttcgtgcctgtaatcccagcactttgggagaaggcaggcagaacacttaaggtcaggagttcaagaccagcctggccaacgtgatgaaacccccgtctctactaaaaacacaaaaatcagttgggtgtggtggcgcacgcctgtaatgccagctactcgggaggctgatgcacaagaactgactgaacctggaaggtggaggctgcagtgagcccagattgtatcattgcactccagcctgagtgacagagcgcgaccctgtctcaaaaaacaaaaacaaa

SEQ ID NO: 76010 - DNA, 920 bp, Homo sapiens
actgtaggtctgcaccctgctctctgttagaaagggagaatcacaaatgttagaatagtgttaaaaactccatggaaacttttctgggcttaaaggaactgaatggcattttcatacctttctaatgctgtgatttaatatttcctggtgccttgtcagtgccacctgaaatcatgatcttatgatgtgcttcctctttggaaaaaactctaaaatagtaacactaaaatcaagaacattttgtttataggactcctttttttaagatgtgaaagccagccagtcaattcctgttcttaagtatattcttagctagggaggttgcttaagattttgtttataagactttcactaaaatcagaattgggtcatcgcgcccagtgctttagttttggaaatctgagtttgaaataaaggataaatgacataaattaatggagtaaaattaatgttgtgataatattaaataaagctaatgccttttgcacctggagggctatgcagatggcaggcatacctaattatgcaccctgcttgcctttaagtatactgatagaaatctctcaactgagtataaaatatgttcattcactggctccagaaaagtttgagtaaggcaacacaatccacaaaaagcctaacatgcttattttttagtggaaagaaatacaattctataagttaaaatgaaataattgaatacttatttttaaaacaagttattactactgttggatttgttctttctgtgaatatcaaaatatatgcctgtcattcccattagaaaaagatgattctcaaactagcaaggaagtacttaaatgtaagtttatatttttacagactgcacacaaagagaataatttactagtggaattctaaataaattgatttgctttctttacgtataaatcggattg

SEQ ID NO: 76011 - DNA, 339 bp, Homo sapiens
ctctacagtggtatgattatataagggtggaaatataaaagagtaagcctttagaaacagtttgtgtctaaattagctctcaggcatattgtcttcaaaggaatgttttaaaccagccaaagactaacatcaacatgcttacattttgagtccaaaattaaaatccaaaatagccaagcatggtggctcacgcctataatcccaactactccagaggctgaggtgtgatagaatttcttgaacctaggcgttccaggctgcagtgagctatgattgtgctgctgcactccagcctgggtgacagagcgaggttgcttctaaaacaaaaatttgaaatag

SEQ ID NO: 76012 - DNA, 395 bp, Homo sapiens
gtgccattaatttcaaatattaaaaattctgatcacagtcttagggtgtgatggttagaaacttgacattgaaggatataattctacttcaaaccaaaatatgtaggttggttgtgtacagaacactgctagacaccatacactagttccagaatagtggaatgatgtatattttgagaataacaagtgattcatatgaatctacccccttcacccacctttttggtagttatttttagcatctcaagagggtttttagatttacttactgtcataattcagatagaaatttatagtttaatcattaaagttcctggattttctacaaccacattttagaaatttgagtactaagcaaatactaaatgattaataatatttagattgcaacttaa

SEQ ID NO: 76013 - DNA, 998 bp, Homo sapiens
  misc_feature (866)..(866): n is a, c, g, or t
  misc_feature (893)..(893): n is a, c, g, or t
  misc_feature (896)..(896): n is a, c, g, or t
  misc_feature (900)..(900): n is a, c, g, or t
  misc_feature (911)..(911): n is a, c, g, or t
  misc_feature (920)..(920): n is a, c, g, or t
  misc_feature (928)..(928): n is a, c, g, or t
  misc_feature (947)..(947): n is a, c, g, or t
  misc_feature (950)..(950): n is a, c, g, or t
taggctagggcgagtccgggggtgaatcggccgagggagtggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatgcgaaccgtggggtccggatcnggcccggttttgtggaaccgggggggncgncgtngccggtgtggnccggggggnggggcacngggcgggatggggtttccncgncccggggggcggggccgggctcaccaacaacacagcgtggggggggtc

SEQ ID NO: 76014 - DNA, 552 bp, Homo sapiens
  misc_feature (55)..(56): n is a, c, g, or t
agtggttcccccctggatccagattttggaagcccaagggtgtccagggtctatnnggcctggcccaatagtgctgagagatattctttcttctgccttggagttcggccctccccagacttcacttatgctagtctaagacccagatttacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaa

SEQ ID NO: 76015 - DNA, 3892 bp, Homo sapiens
aactaggatacgtggctgagcgcgcgcgatggggcgggaggtttggggtcaaggagcaaactctgcacaagatggcggcggtagcggcagtggcggcgcgtaggaggcggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaa

SEQ ID NO: 76016 - DNA, 3847 bp, Homo sapiens
aggctgtaccggcctgggatgttgggatgcggcggtagcggcagtggcggcgcgtatgaaggcggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaa

SEQ ID NO: 76017 - DNA, 3812 bp, Homo sapiens
cggtagtggacgctgcgtacggacagctggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaa

SEQ ID NO: 76018 - DNA, 3865 bp, Homo sapiens
cggtagtggacgctgcgtacggacagctggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctccccctcgtccctgccccctctggattggagcagacagctctcctaccttccaggcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaa

SEQ ID NO: 76019 - DNA, 3791 bp, Homo sapiens
aggctgtaccggcctgggatgttgggatgcggcggtagcggcagtggcggcgcgtatgaaggcggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaa

SEQ ID NO: 76020 - DNA, 4122 bp, Homo sapiens
aggctgtaccggcctgggatgttgggatgcggcggtagcggcagtggcggcgcgtatgaaggcggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaaaaaaaaaaaaaaacacaaatagacaacaaaaaaggggggcgctctaaaaacccctcggggcaattacctacccgtttcttgcaaggggccctttggagctcgtataacgcaggccggccgccgtttaccccgtgtgcgtcaacggacctgcctcttggaaggacctactcggtgggccaattggccacccaccaattaaagccgggattacctcccgtcttggtgtccccaccatgcttcccgaaatgtacgattcgttcacttttcccgcggca

SEQ ID NO: 76021 - DNA, 2275 bp, Homo sapiens
ttcacttcttagtgtcatagttggggcacagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaa

SEQ ID NO: 76022 - DNA, 2122 bp, Homo sapiens
aacggatcaggctaggtacgagaccgtgttttaatcggcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaa

SEQ ID NO: 76023 - DNA, 1915 bp, Homo sapiens
gaggatcccccgcttggcgctttcgagttgcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaa

SEQ ID NO: 76024 - DNA, 3742 bp, Homo sapiens
aggctgtaccggcctgggatgttgggatgcggcggtagcggcagtggcggcgcgtatgaaggcggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcctccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaa

SEQ ID NO: 76025 - DNA, 1865 bp, Homo sapiens
cattccttctgtggggcggatgtggtctcacgagctgcttgtgcgctggtaccagatgggtgcttaccagtcacatgcttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaa

SEQ ID NO: 76026 - DNA, 3761 bp, Homo sapiens
  misc_feature (3629)..(3629): n is a, c, g, or t
  misc_feature (3656)..(3656): n is a, c, g, or t
  misc_feature (3659)..(3659): n is a, c, g, or t
  misc_feature (3663)..(3663): n is a, c, g, or t
  misc_feature (3674)..(3674): n is a, c, g, or t
  misc_feature (3683)..(3683): n is a, c, g, or t
  misc_feature (3691)..(3691): n is a, c, g, or t
  misc_feature (3710)..(3710): n is a, c, g, or t
  misc_feature (3713)..(3713): n is a, c, g, or t
aggctgtaccggcctgggatgttgggatgcggcggtagcggcagtggcggcgcgtatgaaggcggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatgcgaaccgtggggtccggatcnggcccggttttgtggaaccgggggggncgncgtngccggtgtggnccggggggnggggcacngggcgggatggggtttccncgncccggggggcggggccgggctcaccaacaacacagcgtggggggggtc

SEQ ID NO: 76027 - DNA, 1717 bp, Homo sapiens
ctgactacgggctcattcgtatacagtgccctactctgtggactagtgattgcctgatggatgacgtcccctggtgtgcgtgcagtcaccctcatagcatgtgactaccttgaatcactaggatgatcgagcacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaa

SEQ ID NO: 76028 - DNA, 3774 bp, Homo sapiens
aggctgtaccggcctgggatgttgggatgcggcggtagcggcagtggcggcgcgtatgaaggcggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggacctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaa

SEQ ID NO: 76029 - DNA, 3612 bp, Homo sapiens
aggctgtaccggcctgggatgttgggatgcggcggtagcggcagtggcggcgcgtatgaaggcggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactcttttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaa

SEQ ID NO: 76030 - DNA, 3416 bp, Homo sapiens
aggctgtaccggcctgggatgttgggatgcggcggtagcggcagtggcggcgcgtatgaaggcggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctgatccattcatcctgtccggggtaaggggtggtcccagtgtatcggtggggcataaaaaggggagtaaagcgtggaggaagaaatgaaaggtgggaggtcgac

SEQ ID NO: 76031 - DNA, 3293 bp, Homo sapiens
aggctgtaccggcctgggatgttgggatgcggcggtagcggcagtggcggcgcgtatgaaggcggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggagtagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaa

SEQ ID NO: 76032 - DNA, 3266 bp, Homo sapiens
aggctgtaccggcctgggatgttgggatgcggcggtagcggcagtggcggcgcgtatgaaggcggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgtgtgcctgggaagggatccttagagtacctgcagaat

SEQ ID NO: 76033 - DNA, 1247 bp, Homo sapiens
agtaagaacagaaggggtcgtcgattatctctggcacaccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaa

SEQ ID NO: 76034 - DNA, 3386 bp, Homo sapiens
aggctgtaccggcctgggatgttgggatgcggcggtagcggcagtggcggcgcgtatgaaggcggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagatttacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaa

SEQ ID NO: 76035 - DNA, 2832 bp, Homo sapiens
aggctgtaccggcctgggatgttgggatgcggcggtagcggcagtggcggcgcgtatgaaggcggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaa

SEQ ID NO: 76036 - DNA, 3260 bp, Homo sapiens
aggctgtaccggcctgggatgttgggatgcggcggtagcggcagtggcggcgcgtatgaaggcggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatccccttccctcccaccagattgctctcccacctttcatttcttcctccaggctttactcccctttttatgccccaccgatacactgggaccgtggggggttgggggaggactaatggggagtcggggaatatttgtgggtattttttttacttcctcttggttcccagctgtgacacgttttgatcaaaggagaaacaataaagggataaaccataaa

SEQ ID NO: 76037 - DNA, 3078 bp, Homo sapiens
aggctgtaccggcctgggatgttgggatgcggcggtagcggcagtggcggcgcgtatgaaggcggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgagtatcaatggagtgggagaggtgaggagatgtcgacg

SEQ ID NO: 76038 - DNA, 3404 bp, Homo sapiens
aggctgtaccggcctgggatgttgggatgcggcggtagcggcagtggcggcgcgtatgaaggcggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagatttacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggatacagtagggagatctccctactgtatcctattatatatatatttctaagtgtaactgtccttcctctgtgccaggaaacgggagggggctgatcctctgatcctcacttcactgtcatgtttgaaagaggtattggtgttctggagtgggggtcaacccctccccagtctctgtgctaagtctcactttgggacggatgcct

SEQ ID NO: 76039 - DNA, 3066 bp, Homo sapiens
aggctgtaccggcctgggatgttgggatgcggcggtagcggcagtggcggcgcgtatgaaggcggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcatatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaa

SEQ ID NO: 76040 - DNA, 2838 bp, Homo sapiens
  misc_feature (2797)..(2797): n is a, c, g, or t
aggctgtaccggcctgggatgttgggatgcggcggtagcggcagtggcggcgcgtatgaaggcggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaagaatctccaaaaaaagcccgccctggttcctttcccagccattgaanccctgaaaaacctcctgttgtttgggttccctgccgccaaa

SEQ ID NO: 76041 - DNA, 1704 bp, Homo sapiens
cggtagtggacgctgcgtacggacagctggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgtgagtacaggggttgggactgcagggaacctagtgtgaaagagcataggggtgttgtgaggtctggcacggggaggagacggtggtgggacagccaggtagggcctgggggctgggagaagctctctgtcagggagggtaggaaccagacccgggtgcggttttttccatttcctgtacagaccaggaggcagtcacttttgtccctgagctgtaccctgggcatctctgggaggcctgcctgggtctgtgtctccttcttccccttctcacatcatcacatttcccagatttattttcttcgtttttatttatttattttttttggtttctttttccccccatctctggaagtttgtcgactgaaactcacttttatgtttctgtttttgtgttggttttgtgcctctttttccccttccctacccatctcctcctgccccagtttctcggataaggttaatctcacgcttggtagcatatgggataagatcaagaaccttttctctaggtaaatccatggccaccggtactgtatctgttcctctgcccttacccattcctcactctagccttcggggggaggtgccccagacccttccagcctttcactcaccccactttcccctgctgtgtgatgtctggtcctgttacctgttaccctggctgggagcccccagaagaaggaaggtgagatactgaaagtcaggtccttcgggaatgtagggagcttattgctttgccaggggatggagagatgctgcctattgctggggttcctgactctcagctgaggggcacctgaggttctgggcagagctacttgcccttgaaagcattttttggcagaatctcttgaagtccctatgtatgtctgtagaggcttggtatagtatgacccacatgcctttgcaaagccattgtgtcaggccaggaggctgaggcccagggagagcacttggggccagaatctctcagtagaggcaacagagccaggattggcattcataacccaggcccctgaatcattctgcctttctcttctgggatgttgacagaggctggtgttcaggcctgtgcctcctggtggcacttattcctcattttcctttctcatctctctccccatcctttgcaaacttatctgctcatt

SEQ ID NO: 76042 - DNA, 401 bp, Homo sapiens
cggtagtggacgctgcgtacggacagctggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccgaggctgatgaggcaggccttgaactcctcg

SEQ ID NO: 76043 - DNA, 348 bp, Homo sapiens
agtgagccaccacgcccagcctactctgcctttcaaagggaaggtgtgagtgagccaacttctcaggcctgatccttaaccctgtgtccactctgccttgttttgtatttgatgtgactacatctttctcccctctttcctcaactatcttctagtgctatgacaggaagaagcttttccttttgaagggggccccttctgacctccatgctgattgctctgtctttgtccttttctccttaggtcttgggcgtctttggtactggcttttttaggggtctgcctggggattacccttgctgtggatagaagcaactttaagacctgtgaagagagttctttctgcaa

SEQ ID NO: 76044 - DNA, 439 bp, Homo sapiens
gctcccgcccggcggtttagtaaagccacagctgtgcgtctttcttggtcttggccgctctcagccgccgccctcctttggctgcttgcggcggtcaacgtcgccgcccccttcctgcagtgcgcggggtcgtcggggcgggggaaaagatgcggcctggcctcggggaatgcagcctgcggccccgcggcccctcggctgagctggaagcaccgggccagcagttaagcctgtactacccttctggctctaccctgtagagctccgaatcctcctctgcccttgtcttcacgtgagcaccagctctggcttagttcagtgtccacggtcgctgggcacggcccagggtccagtaagctcacggcgtggatggtgttgctcaaacacaacatgtaatcgaatggcttggtccacgctctcgggtttatattactgggga

SEQ ID NO: 76045 - DNA, 338 bp, Homo sapiens
cacatggcgactgctgatgggctgagacagcgctctgggggcatggaacgcccctttgtcctggccagggccttcttcgctggctcccagcgctttggtaaggtttagagaatggagctgtggcagaagggtgtgaaggccagatctcaggagccatggacctggacctgcctctctgaggaatgggagccacacactgcatctgtttcctctcagctatgcgctttgaaggaagtcagggtgtgggaggtccactccttgttcaaatgttcttgtgaactgcatcttcagcagggttctggggacccagagcggatgtgggaggtcagccatgtaaa

SEQ ID NO: 76046 - DNA, 273 bp, Homo sapiens
ggtgtgagccaccacacccggcctatgctgttcttttcttattgccagttcctggaggagcatttctgacttgtgccaaaattgaaaagttttcctttattgtctttcttccttcctaggcccctgtgggtgcagtaccctcaggatgtgactaccttcaatatagatgatcagtacttgcttggtgagaaatgaggatagttggtggtgggttggctttgggccaagcagcactgcggatgcccagggagggactagtgaagctggtggtgc

SEQ ID NO: 76047 - DNA, 508 bp, Homo sapiens
tagggaaggcctctccccatgacctgcgtctgtctgttccacctgcctccctgaatctctctcggcttgccaacccttctatggttgattgcctgcaacatatcagggggccttgatgatccggggagggccctgaaaaatgcatctttttagattcctaggagctctcttctctgacactgtttgtcttcttcctcccctctgtccttctgtccccattttctgcccacgttcccagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtggtaagggcctgagagaggagagttggtggaaagagggaaaacagcccagagactgagggcctagggaacttgcaccagatgacagctggcttttgctcctcactacccgtctcttctctcctcacc

SEQ ID NO: 76048 - DNA, 1928 bp, Homo sapiens
gcctgctcgggcgcgggcggcggcgcggccatgaagctgaagctgaagaacgtgtttctcgcctacttcctggtgtcgatcgccggcctcctctacgcgctggtacagctcggccagccatgtgactgccttcctcccctgcgggcagcagccgagcagctacggcagaaggatctgaggatttcccagctgcaagcggaactccgacggccaccccctgcccctgcccagccccctgaacccgaggccctgcctactatctatgttgttacccccacctatgccaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaa

SEQ ID NO: 76049 - DNA, 827 bp, Homo sapiens
  misc_feature (60)..(60): n is a, c, g, or t
  misc_feature (66)..(66): n is a, c, g, or t
  misc_feature (71)..(71): n is a, c, g, or t
  misc_feature (73)..(73): n is a, c, g, or t
  misc_feature (80)..(80): n is a, c, g, or t
  misc_feature (89)..(89): n is a, c, g, or t
  misc_feature (92)..(92): n is a, c, g, or t
  misc_feature (95)..(96): n is a, c, g, or t
  misc_feature (746)..(746): n is a, c, g, or t
  misc_feature (750)..(750): n is a, c, g, or t
  misc_feature (753)..(753): n is a, c, g, or t
  misc_feature (761)..(761): n is a, c, g, or t
  misc_feature (763)..(763): n is a, c, g, or t
ggccacatgaaatatgactacggcgtccctcggtgtatttcagtaccatggctggtgtgnatcgtnaaatngnctggccntggccgtcngangtnnatggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctctttctcggataaggttaatctcacgcttggtagcatatgggataagatcaagaaccttttctctaggcaaggatcaaaagacccagctgagggcgatggggcccagcctgaggaaacacccagggatggcgacaagccgaggactcngggnagncggaaaananccgggcctgagggacacccaaccctgcgggccgttgcccgtctgggtggccccccacccgcgcg

SEQ ID NO: 76050 - DNA, 3878 bp, Homo sapiens
cggtagtggacgctgcgtacggacagctggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctctttctcggataaggttaatctcacgcttggtagcatatgggataagatcaagaaccttttctctaggcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaa

SEQ ID NO: 76051 - DNA, 4323 bp, Homo sapiens
cggtagtggacgctgcgtacggacagctggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgtgagtacaggggttgggactgcagggaacctagtgtgaaagagcataggggtgttgtgaggtctggcacggggaggagacggtggtgggacagccaggtagggcctgggggctgggagaagctctctgtcagggagggtaggaaccagacccgggtgcggttttttccatttcctgtacagaccaggaggcagtcacttttgtccctgagctgtaccctgggcatctctgggaggcctgcctgggtctgtgtctccttcttccccttctcacatcatcacatttcccagatttattttcttcgtttttatttatttattttttttggtttctttttccccccatctctggaagtttgtcgactgaaactcacttttatgtttctgtttttgtgttggttttgtgcctctttttccccttccctacccatctcctcctgccccagtttctcggataaggttaatctcacgcttggtagcatatgggataagatcaagaaccttttctctaggcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaa

SEQ ID NO: 76052 - DNA, 2257 bp, Homo sapiens
tggtacgaggcagggggtgaatcggccgaggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaa

SEQ ID NO: 76053 - DNA, 2263 bp, Homo sapiens
agaggatccccaggaaacagcttaccattatgacgggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaa

SEQ ID NO: 76054 - DNA, 3796 bp, Homo sapiens
aggctgtaccggcctgggatgttgggatgcggcggtagcggcagtggcggcgcgtatgaaggcggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaagtggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaa

SEQ ID NO: 76055 - DNA, 1928 bp, Homo sapiens
aatgaatgggaaagagttggtatcaacggagtgggagaggtgaggagatcacaagaggaatttggagcccaggctcagccctctcatcctgccccaaatgttggcagaatctgggtcttagactagcataagtgaagtctggggagggccgaactccaaggcagaagaaagaatatctctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaa

SEQ ID NO: 76056 - DNA, 1667 bp, Homo sapiens
atcgagctcggcaccgttacattcgtgcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaa

SEQ ID NO: 76057 - DNA, 3646 bp, Homo sapiens
aggctgtaccggcctgggatgttgggatgcggcggtagcggcagtggcggcgcgtatgaaggcggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaa

SEQ ID NO: 76058 - DNA, 3609 bp, Homo sapiens
aggctgtaccggcctgggatgttgggatgcggcggtagcggcagtggcggcgcgtatgaaggcggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagcccggctttctgtctctggtcgtgatgagaacagtgtggagttaaccatggctgagggaccctacaagatcatcttgacagcacggccattccgccttgacctactagaggaccgaagtcttttgcttagtgtcaatgcccgaggactcttggagtttgagcatcagagggcccctagggtctcgcaaggatcaaaagacccagctgagggcgatggggcccagcctgaggaaacacccagggatggcgacaagccagaggagactcaggggaaggcagagaaagatgagccaggagcctgggaggagacattcaaaactcactctgacagcaagccgtatggccccatgtctgtgggtttggacttctctctgccaggcatggagcatgtctatgggatccctgagcatgcagacaacctgaggctgaaggtcactgagggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaagaccctgtttgggaagatgatggactacctgcagggctctggggagaccccacagacagatgttcgctggatgtcagagactggcatcattgacgtcttcctgctgctggggccctccatctctgatgttttccggcaatatgctagtctcacaggaacccaggcgttgcccccactcttctccctcggctaccaccagagccgttggaactaccgggacgaggctgatgtgctggaagtggatcagggctttgatgatcacaacctgccctgtgatgtcatctggctagacattgaacatgctgatggcaagcggtatttcacctgggaccccagtcgcttccctcagccccgcaccatgcttgagcgcttggcttctaagaggcggaagctggtggccatcgtagacccccacatcaaggtggactccggctaccgagttcacgaggagctgcggaacctggggctgtatgttaaaacccgggatggctctgactatgagggctggtgctggccaggctcagctggttaccctgacttcactaatcccacgatgagggcctggtgggctaacatgttcagctatgacaattatgagggctcagctcccaacctctttgtctggaatgacatgaacgaaccatctgtgttcaatggtcctgaggtcaccatgctcaaggatgcccagcattatgggggctgggagcaccgggatgtgcataacatctatggcctttatgtgcacatggcgactgctgatgggctgagacagcgctctgggggcatggaacgcccctttgtcctggccagggccttcttcgctggctcccagcgctttggagccgtgtggacaggggacaacactgccgagtgggaccatttgaagatctctattcctatgtgtctcagcttggggctggtgggactttccttctgtggggcggatgtgggtggcttcttcaaaaacccagagccagagctgcttgtgcgctggtaccagatgggtgcttaccagccattcttccgggcacatgcccacttggacactgggcgacgagagccatggctgttaccatctcagcacaatgatataatccgagatgccttgggccagcgatattctttgctgcccttctggtacaccctcttatatcaggcccatcgggaaggcattcctgtcatgaggcccctgtgggtgcagtaccctcaggatgtgactaccttcaatatagatgatcagtacttgcttggggatgcgttgctggttcaccctgtatcagactctggagcccatggtgtccaggtctatctgcctggccaaggggaggtgtggtatgacattcaaagctaccagaagcatcatggtccccagaccctgtacctgcctgtaactctaagcagtatccctgtgttccagcgtggagggacaatcgtgcctcgatggatgcgagtgcggcggtcttcagaatgtatgaaggatgaccccatcactctctttgttgcacttagccctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaa

SEQ ID NO: 76059 - DNA, 1338 bp, Homo sapiens
cgggtgtgaatcggacgaggagcctcagggtacagctcaaggagagctctttctggatgatgggcacacgttcaactatcagactcgccaagagttcctgctgcgtcgattctcattctctggcaacacccttgtctccagctcagcagaccctgaaggacactttgagacaccaatctggattgagcgggtggtgataataggggctggaaagccagcagctgtggtactccagacaaaaggatctccagaaagccgcctgtccttccagcatgaccctgagacctctgtgttggtcctgcgcaagcctggcatcaatgtggcatctgattggagtattcacctgcgataacccaagggatgttctgggttagggggagggaaggggagcattagtgctgagagatattctttcttctgccttggagttcggccctccccagacttcacttatgctagtctaagacccagattctgccaacatttgggcaggatgagagggctgaccctgggctccaaattcctcttgtgatctcctcacctctcccactccattgataccaactctttcccttcattcccccaacatcctgttgctctaactggagcacattcacttacgaacaccaggaaaccacagggcccttgtcgccccttctctttcccttatttaggagccctgaactcccccagagtctatccattcatgcctcttgtatgttgatgccacttcttggaagaagatgagggcaatgagttagggctccttttccccttccctcccaccagattgctctcccacctttcatttcttcctccaggctttactcccctttttatgccccaccgatacactgggaccaccccttaccccggacaggatgaatggatcaaaggagtgaggttgctaaagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagatggagaaatcagttgtggtttcagtgaatcatggtcacctgtatttattgctaggagaagcctgagggtggggggagatgatcatgtgtgctcggggttggctggaagccctgggtggggggttgggggaggactaatggggagtcggggaatatttgtgggtattttttttacttcctcttggttcccagctgtgacacgttttgatcaaaggagaaacaataaagggataaaccataaa

SEQ ID NO: 76060 - DNA, 1682 bp, Homo sapiens
ttccctacgtcgggagaggaaaactccatcaaaaaacgaaagccaggggcccaggatagccaactaatcgacccagtcaactaactgacccagtgcacaactctggtagctcagaaaacgcgggctaatttggaagtggacaggggcggagctgtggggccagcacggaatggatcacgtggtctgaagtaacttccttttctcctttcttttctttttggagtaacatctcaacggcacctcggctctgggctgtaagccctgcgatctcaaggcgcaaggctgggcgcaacggcagggttgcggggttacgggattgcggggtccggggagtggaacccgccgactccgggaacgaagcaccggcgccaaggtgtgggaggcggcggggtggagttggacgcctgcctcgcgccgacgcagtgcactcacgggggcggtcccagaggcagctagctgtggttccggttccgtcgcggagacacgtgaaggtcggtgcggagttcgtctctgcaagcttggtcgccctgggatggattcctcctcctcttcctccgcggcgggtttgggtgcagtggacccgcagttgcagcatttcatcgaggtagagactcaaaagcagcgcttccagcagctggtgcaccagatgactgaactttgttgggagaagtgcatggacaagcctgggccaaagttggacagtcgggctgaggcctgttttgtgaactgcgttgagcgcttcattgatacaagccagttcatcttgaatcgactggaacagacccagaaatccaagccagttttctcagaaagcctttctgactgatctcagcattacctctttggaaaaggaaggtagttcaagaaatgaagagctgttgatgggatgattgaagaaacagctatgagaggattggctcccatcttttgttactcttgggacatcctgtcatctgagaatgaacaaagaccaattttttgtgtgtgaagcttaagggtcatatgtttgcttgtattttttaatgctaatcttgtgaaaataattgacaggcgaaagaaaactctatttagatgcatattactgtacatgggactatgcttttctcaaagccccattaactgcttcctataattttgatagtgggaccacatacgtaaaaatctctcatttgtgtggagtcatttctgatttcaggggagatccttgtgtttatcagaaagggcagaagtaggggaagaataatttggtatccttatctagtgtttgattgtcaatgctggagaaaaatatctgtaagagtgtttatacagtacacttcagttatcttgatctccctttcctatatgatgatttgcttaaatatccatattaagtaagtctcaaggtagggtaggcagcctgagagtctagaggcctttagttataaaggaatctagccagtgaacataattcttattactagactgccacaaggaagaaattaacttaccctgtatatcagggtacaaaaaattcagtgatgtgcctaaataagttataaagatttaggccaatcagaagctaacagcagtttcaggtagaggtgcatgcctaatgttagttagtgtagattccatttactgcattcttctgatcactgaaataaaagctatataagattcaactctgtgattgagaaggc

SEQ ID NO: 76061 - DNA, 1020 bp, Homo sapiens
ttccctacgtcgggagaggaaaactccatcaaaaaacgaaagccaggggcccaggatagccaactaatcgacccagtcaactaactgacccagtgcacaactctggtagctcagaaaacgcgggctaatttggaagtggacaggggcggagctgtggggccagcacggaatggatcacgtggtctgaagtaacttccttttctcctttcttttctttttggagtaacatctcaacggcacctcggctctgggctgtaagccctgcgatctcaaggcgcaaggctgggcgcaacggcagggttgcggggttacgggattgcggggtccggggagtggaacccgccgactccgggaacgaagcaccggcgccaaggtgtgggaggcggcggggtggagttggacgcctgcctcgcgccgacgcagtgcactcacgggggcggtcccagaggcagctagctgtggttccggttccgtcgcggagacacgtgaaggtcggtgcggagttcgtctctgcaagcttggtcgccctgggatggattcctcctcctcttcctccgcggcgggtttgggtgcagtggacccgcagttgcagcatttcatcgaggtagagactcaaaagcagcgcttccagcagctggtgcaccagatgactgaactttgttgggttcctgtggcctagccggatgggagaagggtgactccgcttctctggggactgtcattccggacctcggctttgttggtgtagaggactgggtatcaaagaagacttatgccactggacacccagcactttcaggcacccgaggttgaagctgcctagtgctggtcaccaagactgatcggagcccccagtactgggattttatttttggcagcccgagtcccagagagtcagtgaatcagtgaatctgctattcctggactcctcgggatttaccttcattacccagttctaaccctctccgctgaaaaatgagtggctccagcccagtaactataaaagtggtgtaatctcta

SEQ ID NO: 76062 - DNA, 1245 bp, Homo sapiens
gatttataatagtatctattccatagtattgttgtaagaatttaatgtaaggctagagaacattgctatatacttggtcagctgccaaatgtgaactatcagtaacatatcagatattatttttaggtaaagtttttttttctctaagcaacaaaaagggacccctgcccccaaccgtctttttctttccaagttccctttgtgattctgtatcttgtcctgagcaggagaagtgcatggacaagcctgggccaaagttggacagtcgggctgaggcctgttttgtgaactgcgttgagcgcttcattgatacaagccagttcatcttgaatcgactggaacagacccagaaatccaagccagttttctcagaaagcctttctgactgatctcagcattacctctttggaaaaggaaggtagttcaagaaatgaagagctgttgatgggatgattgaagaaacagctatgagaggattggctcccatcttttgttactcttgggacatcctgtcatctgagaatgaacaaagaccaattttttgtgtgtgaagcttaagggtcatatgtttgcttgtattttttaatgctaatcttgtgaaaataattgacaggcgaaagaaaactctatttagatgcatattactgtacatgggactatgcttttctcaaagccccattaactgcttcctataattttgatagtgggaccacatacgtaaaaatctctcatttgtgtggagtcatttctgatttcaggggagatccttgtgtttatcagaaagggcagaagtaggggaagaataatttggtatccttatctagtgtttgattgtcaatgctggagaaaaatatctgtaagagtgtttatacagtacacttcagttatcttgatctccctttcctatatgatgatttgcttaaatatccatattaagtaagtctcaaggtagggtaggcagcctgagagtctagaggcctttagttataaaggaatctagccagtgaacataattcttattactagactgccacaaggaagaaattaacttaccctgtatatcagggtacaaaaaattcagtgatgtgcctaaataagttataaagatttaggccaatcagaagctaacagcagtttcaggtagaggtgcatgcctaatgttagttagtgtagattccatttactgcattcttctgatcactgaaataaaagctatataagattcaactctgtgattgagaaggc

SEQ ID NO: 76063 - DNA, 1317 bp, Homo sapiens
ttccctacgtcgggagaggaaaactccatcaaaaaacgaaagccaggggcccaggatagccaactaatcgacccagtcaactaactgacccagtgcacaactctggtagctcagaaaacgcgggctaatttggaagtggacaggggcggagctgtggggccagcacggaatggatcacgtggtctgaagtaacttccttttctcctttcttttctttttggagtaacatctcaacggcacctcggctctgggctgtaagccctgcgatctcaaggcgcaaggctgggcgcaacggcagggttgcggggttacgggattgcggggtccggggagtggaacccgccgactccgggaacgaagcaccggcgccaaggtgtgggaggcggcggggtggagttggacgcctgcctcgcgccgacgcagtgcactcacgggggcggtcccagaggcagctagctgtggttccggttccgtcgcggagacacgtgaaggtcggtgcggagttcgtctctgcaagcttggtcgccctgggatggattcctcctcctcttcctccgcggcgggtttgggtgcagtggacccgcagttgcagcatttcatcgaggtagagactcaaaagcagcgcttccagcagctggtgcaccagatgactgaactttgttggagatgggatcttgtgatgttgcccaggctagagtgcagtggcacaatcatgtcttcaatatcccattttcagcattggacagattttccagacagaaaaatcaacaaagaaatgtcagacttaatctgcactatagaaaaagtgaatctaatagatatttacagaacgtttcatccaacagctgcaaaatacacattcttctcctagcacatggatctttctcaaggacaaccatatgttaggtcacaaagcaagtcttaaaacatttttaaacattgaaatagcatcaagcatcttctctgaccacagtggaataaaactagaaatcaataacgagagggattttagaaactatacaaacacatggaaattaaacagtatgctcctgaatgacaagtgggtcaatgaagaaattaaaaagaaaattgaaaaatgtcttgaaacaaatgataatggaaacacaacataccaaaacctatgggatacagcaaaagcagtagtgagagggaagtttatagctataagcacctacatcaaaaaagaagaaaaacttcaaataaataatctaaccatgaatcttatagaactagagaactaagagcaaacaaaatccaaagttactagaagaaaatgaataatatagatcagagcgg

SEQ ID NO: 76064 - DNA, 557 bp, Homo sapiens
actagccacatgtggcttaatggctctcgaagtccgacagagcagattaagagacattgcttgctctttttactacttaatgaactttagttttctttttttctggttactgaattctagatgttagatttgtagagcctaccttttgaccagcacaagagaggcctgagccagtctgtggtcttctccttgggttggggggtgtgtgaggagtggatggggccagcgtacctcactggcaggtcctaggcgagttgggctttaccttctctccaagagacctgccagcctcttccctcgcttgaagacaccaggggtgcagaaggcattttctggccaactgttctttgctgatctgttcatcctaagaacaaaattgagtggcttaaaacaaaatgtagctagcctatagttccaaacctttaaagcctctgttatttaataaaggctggaaatgagttattctgaatagccagagtttctcagagagcaactctttaagcaccaggagtttagtaactttcatggtgggaagagttctaagtgttgaaggtact

SEQ ID NO: 76065 - DNA, 834 bp, Homo sapiens
atgaaatgatctaatgatactaagttttggtgatgatgtcagctcttacattgaaaacaatcactgtggaaaaatttgtccctcagtaaatttaaagataaacatgctcaaaacctagcaattgcactctgaagtatacatctttgcaggttatctttcattacagttatttttttccctgtcaggaccctaactaatacaatgccttgggaaaactaatgaacatgtatcctaggaagcatgtacaagaaagttcttcccagtcaggaaggtggccaagaaaaaaattttttaatgttcatagcagcactgcaatatccaaaagttagaaatgaaccaaatattcagcaatggtagaatggttaaattgtaccatggcatttatattgaaacagtagaattctacacagtggtgaaaatgaaggaaatagctaaccacaacatagatgaatatcacagacatagcatagagcaaaagaagcaaatcacagaaggatgccatcaacatgattccatttgtataaagtttaaaacagtataaactgaacaactatattgttttaagggtatatagttatatatatgagatacaactgtaaagaaaagcaagtgttttgctgtccccagaaccagaataatgatttcctctgtggagaagtacagcagtgtgattggggagtggcacctggtgcttctgggatgctggcaatgttctatttcttgtcttgggtggtgattgcatggatgttcacttttaaaatactctttatacatatatattttatatattcttgttcatatataacctttataataaagagaaaaaaatggcaa

SEQ ID NO: 76066 - DNA, 929 bp, Homo sapiens
agcgcacctcagtctaattgcctgccacttaattattgtcacactccacagggcactgattttcctctgcatttttcacttctgtctcaagcagggtctcaagacttctccccatttcccattcctccagcctaactctggcttgcagtaaaatactaaatttccagttccttctgacattcccaaatgccaatttcccctccctaattcacattatcaactatttgtcctttaaatgtacactttagtgtacattttaggtaccatattttaattaatcattttttgacaaagcattggctggcattttaaaaaagatttgttttctgtttgtaaagatttcccaagagaagaaagcaaagaataatcccctgacactgtattgtaaaaaatgttctgtgcctcctttccttttattgcctctagccacagaaaccttatcagaatatttttgggtcagggtttccctttggaaactttataaggtaatgtgtcctcagccacccttcagttttttccctggttctgggtttcagtactgtctggggataaatcaagatatccactgtggctgtgtatgctacaatgtctagtaaatttcagctcctggcctggaatgaaacttcgcatatctgggaatgggagacaggacagcctgaagttggagtgtagcctctcaagggagcaggtggatgccctgaggctgagaggagtctcctggggtactcttcctttgaaaagcaaacccttagagaagttaagattgtcttcaagcaacccgggttccatttctcgaagacacattgctggtcagccaatcagatggtggtaatgagggaaaaacaaataattactgccacctggattctccaagaattatgaaagagaaaatagtatcccaaaagacaaaaaaaaaaaaaaaaaaaaaa

SEQ ID NO: 76067 - DNA, 474 bp, Homo sapiens
tgtctctggcggcagccggagcttctggtgtagtcttcactgctctgtgtcttctgctcctagaggcccagcttctgtggcctcgttacctgcaggtattgggagatccacagctaagacgccaggacccactggaagcctagaaatgctcctggcctggaatgaaacttcgcatatctgggaatgggagacaggacagcctgaagttggagtgtagcctctcaagggagcaggtggatgccctgaggctgagaggagtctcctggggtactcttcctttgaaaagcaaacccttagagaagttaagattgtcttcaagcaacccgggttccatttctcgaagacacattgctggtcagccaatcagatggtggtaatgagggaaaaacaaataattactgccacctggattctccaagaattatgaaagagaaaatagtatcccaaaagacaaaaaaaaaaaaaaaaaaaaaa

SEQ ID NO: 76068 - DNA, 385 bp, Homo sapiens
tgtctctggcggcagccggagcttctggtgtagtcttcactgctctgtgtcttctgctcctagaggcccagcttctgtggcctcgttacctgcaggtattgggagatccacagctaagacgccaggacccactggaagcctagaaatgtgactgtgccttggtctggagtcctctgtgggcagctctgcccccactgccgcagctctccccgattgtgcagggaccactggacggtcgtcaggggagaatactgactcaggatgcagagttcatgaatgggaagagctttggtctgcggggttcccagtccccctttttttctattaaaaatttgtggaagtctccgcagaaatattaaagaatttaattaaagagtaattcaag

SEQ ID NO: 76069 - DNA, 993 bp, Homo sapiens
gccggagcttctggtgtagtcttcactgctctgtgtcttctgctcctagaggcccagcttctgtggcctcgttacctgcaggtattgggagatccacagctaagacgccaggacccactggaagcctagaaatggtgagagtgccgggtccgacatcccgagagagggggcggggctggttggaactggtgggaagtggctgtggcgggactctggcctccccgcagctggctccaaaatccgcggccccgagttctccttggcgcagctcggccctcagtccccttcagccataggatggcggccgggctgacagctcggaccccgggcatcctgtctcctccctgcgcagtgactgtgccttggtctggagtcctctgtgggcagctctgcccccactgccgcagctctccccgattgtgcagggaccactggacggtcgtcaggggagaatactgactcaggatgcagagttcatgaatgggaagagctttggtctgcggggttcccagtccccctttttttctattaaaaatttgtggaagtctccgcagaaatattaaagaatttaattaaagagtaattcaagaattgtagagcaccaagctatgttttgtagtttgtggtttatggaaggggcttgaagaaaacacttttataaagtgcatgataaaggaaagcaaattcaataattggttaggtaaagttatgtagtttcttaatttgtacgatcaaggtggaaattccctggtcatgtaatgagaggttaattggcagtttatagttggttaagcctgaattttattttcccccaatgtaatactttagaaaaaaatcattcgagttagatttttttgcaagtagcaaccctaggactggagcgcacctcagtctaattgcctgccacttaattattgtcacactccacagggcactgattttcctctgcatttttcacttctgtctcaagcagggtctcaagacttctcccca

SEQ ID NO: 76070 - DNA, 446 bp, Homo sapiens
tgatttcagctcactgcatcattcagtcggccgaaggcctggctagaacaaaaaggcagaaaaaaggtgaattcactctctctctgttttggagtagggagtcctatattctcctccccttggacatcagatctccaggttctctggccttcacactcagggacttgcaccagcagccccccaggtttttggtcttggactcagagttactccaccagctcccccggttctcagcccttcagacttggactgagccatgctacaggctcccctgtctcagcagcttgcagaaggcctaacgtggaactcctcagcctccatagttgagggagtgaatccccagcataaatccccactcatctatctacctatatatatccaataaattctgtttctctgaagaagtctgacttcttcagcccccaaaggcccccaaaggcccccaa

SEQ ID NO: 76071 - DNA, 692 bp, Homo sapiens
  misc_feature (140)..(141): n is a, c, g, or t
acaatctggaaggccaatttggccttgtaaaggtgcctctctacaggccgtgtcaactggcttctgagcccaaatgcaagcgaatgctgtcactgtatggaagagccattattacctcctgtctttccagaacgtgtgtnnaagaaaagtgagggaaaggggtgcgttggaggtgcaaagtcagcaacgattgtggcagatctgtctgagacaacaatacagacaccagatggtgaggagaggcttgggggagaggctcactccatggtctgggaccccagtggggaacgtctggctgtgcttatgaaagtcgcactcgaaacagccctgtgtttgagctccttccctgtggcattatccagggggagccaggagcccagccccagctcatcactttccatccttccttcaacaaaggggccctgctcagtgtgggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctctaagaataaataagttttccttttgttttccactca

SEQ ID NO: 76072 - DNA, 769 bp, Homo sapiens
gtatttttccctccagccttccctagttttgtggttatctcctctccatattcttgaactcacccccgacacctgttggctcagcctcttttagccctatttttcctgtcctctcctctacctacccaaataacccagagtgggtgtccagagtgggtgtccagagtgtggtgttgagagcacttactgggcagaaggacctggggagtgcctgtccttccttgtctttcacctagaaggtacctggtaagaggcctgtgaatggtttaatcagagctgcttcctcaaccctacagtgtttgagtgggtgaagacggcatccggctgggccctggcactctgtcgatgggcctcttccctccatgggtccctgttcccccatctgtctgtaagtttggcttcctccccagccctctgcatttgctgtgtccccatcctactctgccctcattcctatccttgcaggtcagggttgggtgtgatgacttcagagggtaggagtggtccagctcccctgttggaatattgaggagatggactccttttgccccagtgtgtcctgtgtctatcttgttcttacagctcaggagcgaagatctgatcgctgaatttgcccaagtcacaaattggtgagtgcacaagccctggagctttgtggaaaggaagtcctgaacctcaaaactccctttggggagaaggcaaagactcctactccttttctgattgctcaccatattctcattcctcctgttcccccaaaaaagaatac

SEQ ID NO: 76073 - DNA, 1826 bp, Homo sapiens
gcaggctggtactgggcctgggatttatgggctttgtcccttgcggtacccgtccgcatacgaatctagcccgggaaccgagttgcgggagtgcggtctgtgccgttccggccaggagtttgccgactgcagacgtcctgcgaaccggcaagatgtgctctctggggttgttccctcctccaccgcctcggggtcaagtcaccctatatgagcacaataacgagctggtgacgggcagtagctatgagagcccgccccccgacttccggggccagtggatcaatcttcctgtcctacaactgacaaaggatcccctaaagacccctggaaggctggaccatggcacaagaactgccttcatccatcaccgggagcaagtgtggaagagatgcatcaacatttggcgtgatgtgggcctttttggggtgctaaatgaaattgcaaactcagaagaagaggtgtttgagtgggtgaagacggcatccggctgggccctggcactctgtcgatgggcctcttccctccatgggtccctgttcccccatctgtctctcaggagcgaagatctgatcgctgaatttgcccaagtcacaaattggtccagctgctgcttgcgtgtctttgcatggcacccccacaccaacaagtttgcagtggccctgctagatgactcagtccgtgtgtataatgccagcagcaccatagtcccctccctgaagcaccggctgcagcgaaatgtggcgtctctggcctggaagccccttagtgcctctgtcttggctgtggcctgccagagctgcattcttatctggaccctggaccctacctccttgtctacccgaccctcttctggctgtgcccaagtgctgtctcaccctgggcatacacctgttaccagcttggcctgggcccccagtggggggcggctgctctcagcttcacccgtggatgctgctatccgggtatgggatgtctcaacagagacctgtgtcccccttccctggtttcgaggaggtggggtgaccaacctgctctggtccccagacggcagcaaaatcctggctaccactccttcagctgtctttcgagtctgggaggcccagatgtggacttgtgagaggtggcctactctatcagggcgctgtcagactggctgctggagcccagatggcagccgactgctgttcactgtattgggagagccactgatttactccctgtcttttccagaacgttgtggtgagggaaaggggtgcgttggaggtgcaaagtcagcaacgattgtggcagatctgtctgagacaacaatacagacaccagatggtgaggagaggcttgggggagaggctcactccatggtctgggaccccagtggggaacgtctggctgtgcttatgaaaggaaagccaagggtacaggatggtaaaccagtcatcctcctttttcgcactcgaaacagccctgtgtttgagctccttccctgtggcattatccagggggagccaggagcccagccccagctcatcactttccatccttccttcaacaaaggggccctgctcagtgtgggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctctaagaataaataagttttccttttgttttccactca

SEQ ID NO: 76074 - DNA, 1697 bp, Homo sapiens
tctaggtcgaggccggtggtaatcggccgaggttgtcccttgcggtacccgtccgcatacgaatctagcccgggaaccgagttgcgggagtgcggtctgtgccgttccggccaggagtttgccgactgcagacgtcctgcgaaccgtggatcaatcttcctgtcctacaactgacaaaggatcccctaaagacccctggaaggctggaccatggcacaagaactgccttcatccatcaccgggagcaagtgtggaagagatgcatcaacatttggcgtgatgtgggcctttttggggtgctaaatgaaattgcaaactcagaagaagaggtgtttgagtgggtgaagacggcatccggctgggccctggcactctgtcgatgggcctcttccctccatgggtccctgttcccccatctgtctctcaggagcgaagatctgatcgctgaatttgcccaagtcacaaattggtccagctgctgcttgcgtgtctttgcatggcacccccacaccaacaagtttgcagtggccctgctagatgactcagtccgtgtgtataatgccagcagcaccatagtcccctccctgaagcaccggctgcagcgaaatgtggcgtctctggcctggaagccccttagtgcctctgtcttggctgtggcctgccagagctgcattcttatctggaccctggaccctacctccttgtctacccgaccctcttctggctgtgcccaagtgctgtctcaccctgggcatacacctgttaccagcttggcctgggcccccagtggggggcggctgctctcagcttcacccgtggatgctgctatccgggtatgggatgtctcaacagagacctgtgtcccccttccctggtttcgaggaggtggggtgaccaacctgctctggtccccagacggcagcaaaatcctggctaccactccttcagctgtctttcgagtctgggaggcccagatgtggacttgtgagaggtggcctactctatcagggcgctgtcagactggctgctggagcccagatggcagccgactgctgttcactgtattgggagagccactgatttactccctgtcttttccagaacgttgtggtgagggaaaggggtgcgttggaggtgcaaagtcagcaacgattgtggcagatctgtctgagacaacaatacagacaccagatggtgaggagaggcttgggggagaggctcactccatggtctgggaccccagtggggaacgtctggctgtgcttatgaaaggaaagccaagggtacaggatggtaaaccagtcatcctcctttttcgcactcgaaacagccctgtgtttgagctccttccctgtggcattatccagggggagccaggagcccagccccagctcatcactttccatccttccttcaacaaaggggccctgctcagtgtgggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctctaagaataaataagttttccttttgttttccactca

SEQ ID NO: 76075 - DNA, 2304 bp, Homo sapiens
cacttccgttgagttccgcctcgccgtttgtcccttgcggtacccgtccgcatacgaatctagcccgggaaccgagttgcgggagtgcggtctgtgccgttccggccaggagtttgccgactgcagacgtcctgcgaaccggcaagatgtgctctctggggttgttccctcctccaccgcctcggggtcaagtcaccctatatgagcacaataacgagctggtgacgggcagtagctatgagagcccgccccccgacttccggggccagtggatcaatcttcctgtcctacaactgacaaaggatcccctaaagacccctggaaggctggaccatggcacaagaactgccttcatccatcaccgggagcaagtgtggaagagatgcatcaacatttggcgtgatgtgggcctttttggggtgctaaatgaaattgcaaactcagaagaagaggtgtttgagtgggtgaagacggcatccggctgggccctggcactctgtcgatgggcctcttccctccatgggtccctgttcccccatctgtctctcaggagcgaagatctgatcgctgaatttgcccaagtcacaaattggtccagctgctgcttgcgtgtctttgcatggcacccccacaccaacaagtttgcagtggccctgctagatgactcagtccgtgtgtataatgccagcagcaccatagtcccctccctgaagcaccggctgcagcgaaatgtggcgtctctggcctggaagccccttagtgcctctgtcttggctgtggcctgccagagctgcattcttatctggaccctggaccctacctccttgtctacccgaccctcttctggctgtgcccaagtgctgtctcaccctgggcatacacctgttaccagcttggcctgggcccccagtggggggcggctgctctcagcttcacccgtggatgctgctatccgggtatgggatgtctcaacagagacctgtgtcccccttccctggtttcgaggaggtggggtgaccaacctgctctggtccccagacggcagcaaaatcctggctaccactccttcagctgtctttcgagtctgggaggcccagatgtggacttgtgagaggtggcctactctatcagggcgctgtcagactggctgctggagcccagatggcagccgactgctgttcactgtattgggagagccactgatttactccctgtcttttccagaacgttgtggtgagggaaaggggtgcgttggaggtgcaaagtcagcaacgattgtggcagatctgtctgagacaacaatacagacaccagatggtgaggagaggcttgggggagaggctcactccatggtctgggaccccagtggggaacgtctggctgtgcttatgaaaggaaagccaagggtacaggatggtaaaccagtcatcctcctttttcgcactcgaaacagccctgtgtttgagctccttccctgtggcattatccagggggagccaggagcccagccccagctcatcactttccatccttccttcaacaaaggggccctgctcagtgtgggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgcccatcccaatttcactctagataataagttcctttgtttcaaaaaaaacgaacaaacgacacatgtgcgcggcggagcccgaaagttctaacacccggctgagcgcgggcccacgagtgtcacagggaacggtccagaacactgccacaaggcggctccacaaaacaccggccgaccgtgaccacaaggctggcacggctacacgacaggacaaaatccacgacgcaacaccacacacagaacgagcgagcgccagcccggcgccgccgaagggcgcgaagaacgagaacgagagcgagccaggccgtacgacagagagacgaccgaaggaagcggagggccgagcgcagagcacagcaacaacaacacgacgacgccgagggcaaaccagacgggcgagggagaaacgaggacacacccaagaaagagcaagagaagcagagaaagaggggagaaaagcagccaaagaaacagagagcaagaaaagcggcagccagcacaaagagagggaaagaaacagagcaagcaacaagcagacgaaag

SEQ ID NO: 76076 - DNA, 1721 bp, Homo sapiens
cacttccgttgagttccgcctcgccgtttgtcccttgcggtacccgtccgcatacgaatctagcccgggaaccgagttgcgggagtgcggtctgtgccgttccggccaggagtttgccgactgcagacgtcctgcgaaccggcaagatgtgctctctggggttgttccctcctccaccgcctcggggtcaagtcaccctatatgagcacaataacgagctggtgacgggcagtagctatgagagcccgccccccgacttccggggccagtggatcaatcttcctgtcctacaactgacaaaggatcccctaaagacccctggaaggctggaccatggcacaagaactgccttcatccatcaccgggagcaagtgtggaagagatgcatcaacatttggcgtgatgtgggcctttttggggtgctaaatgaaattgcaaactcagaagaagaggtgtttgagtgggtgaagacggcatccggctgggccctggcactctgtcgatgggcctcttccctccatgggtccctgttcccccatctgtctctcaggagcgaagatctgatcgctgaatttgcccaagtcacaaattgcaccatagtcccctccctgaagcaccggctgcagcgaaatgtggcgtctctggcctggaagccccttagtgcctctgtcttggctgtggcctgccagagctgcattcttatctggaccctggaccctacctccttgtctacccgaccctcttctggctgtgcccaagtgctgtctcaccctgggcatacacctgttaccagcttggcctgggcccccagtggggggcggctgctctcagcttcacccgtggatgctgctatccgggtatgggatgtctcaacagagacctgtgtcccccttccctggtttcgaggaggtggggtgaccaacctgctctggtccccagacggcagcaaaatcctggctaccactccttcagctgtctttcgagtctgggaggcccagatgtggacttgtgagaggtggcctactctatcagggcgctgtcagactggctgctggagcccagatggcagccgactgctgttcactgtattgggagagccactgatttactccctgtcttttccagaacgttgtggtgagggaaaggggtgcgttggaggtgcaaagtcagcaacgattgtggcagatctgtctgagacaacaatacagacaccagatggtgaggagaggcttgggggagaggctcactccatggtctgggaccccagtggggaacgtctggctgtgcttatgaaaggaaagccaagggtacaggatggtaaaccagtcatcctcctttttcgcactcgaaacagccctgtgtttgagctccttccctgtggcattatccagggggagccaggagcccagccccagctcatcactttccatccttccttcaacaaaggggccctgctcagtgtgggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctctaagaataaataagttttccttttgttttccactca

SEQ ID NO: 76077 - DNA, 2669 bp, Homo sapiens
tctaggtcgaggccggtggtaatcggccgaggttgtcccttgcggtacccgtccgcatacgaatctagcccgggaaccgagttgcgggagtgcggtctgtgccgttccggccaggagtttgccgactgcagacgtcctgcgaaccggcaagatgtgctctctggggttgttccctcctccaccgcctcggggtcaagtcaccctatatgagcacaataacgagctggtgacgggcagtagctatgagagcccgccccccgacttccggggccaggtggccagggcgaggagggaggggacctacaggcatgggggcggagtcggggactactggggaaaggaggcagtgtgacaggggcagggtcacagagtctggcggagtggaaacagcttggccccggcaggagactagaagggctggaatctgttttaggactgggattggagtataacgggggaacggttaaggagctgtggaggaggcctagagggaatggagagaatgagggagaatctagggagtgtgaggatgcgggagaactatctaaaagttggggacagtatctggggaggatcagaaggatacaacatggaacttttttccatggtgttcctgggaaggacaaggaagggaaactgacatttattgagcgtttgctatgtaagaaagaggctgagtcaggtgttttctaaaaatgtcatatggtttcataatcacagcaaccctatgaaatattattctagttgcacagatacgggagctaagacttgtttcccattctcacaagtgttagctttgtggaaatgggaaacagacctctggaatctcttatacttagcccagcggtgggttggagatggcacggaattaaagatttgggaagagactgactcaccgtcacacccctcacttttgtgctatagtggatcaatcttcctgtcctacaactgacaaaggatcccctaaagacccctggaaggctggaccatggcacaagaactgccttcatccatcaccgggagcaagtgtggaagagatgcatcaacatttggcgtgatgtgggcctttttggggtgctaaatgaaattgcaaactcagaagaagaggtgtttgagtgggtgaagacggcatccggctgggccctggcactctgtcgatgggcctcttccctccatgggtccctgttcccccatctgtctgtaagtttggcttcctccccagccctctgcatttgctgtgtccccatcctactctgccctcattcctatccttgcaggtcagggttgggtgtgatgacttcagagggtaggagtggtccagctcccctgttggaatattgaggagatggactccttttgccccagtgtgtcctgtgtctatcttgttcttacagctcaggagcgaagatctgatcgctgaatttgcccaagtcacaaattggtccagctgctgcttgcgtgtctttgcatggcacccccacaccaacaagtttgcagtggccctgctagatgactcagtccgtgtgtataatgccagcagcaccatagtcccctccctgaagcaccggctgcagcgaaatgtggcgtctctggcctggaagccccttagtgcctctgtcttggctgtggcctgccagagctgcattcttatctggaccctggaccctacctccttgtctacccgaccctcttctggctgtgcccaagtgctgtctcaccctgggcatacacctgttaccagcttggcctgggcccccagtggggggcggctgctctcagcttcacccgtggatgctgctatccgggtatgggatgtctcaacagagacctgtgtcccccttccctggtttcgaggaggtggggtgaccaacctgctctggtccccagacggcagcaaaatcctggctaccactccttcagctgtctttcgagtctgggaggcccagatgtggacttgtgagaggtggcctactctatcagggcgctgtcagactggctgctggagcccagatggcagccgactgctgttcactgtattgggagagccactgatttactccctgtcttttccagaacgttgtggtgagggaaaggggtgcgttggaggtgcaaagtcagcaacgattgtggcagatctgtctgagacaacaatacagacaccagatggtgaggagaggcttgggggagaggctcactccatggtctgggaccccagtggggaacgtctggctgtgcttatgaaaggaaagccaagggtacaggatggtaaaccagtcatcctcctttttcgcactcgaaacagccctgtgtttgagctccttccctgtggcattatccagggggagccaggagcccagccccagctcatcactttccatccttccttcaacaaaggggccctgctcagtgtgggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctctaagaataaataagttttccttttgttttccactca

SEQ ID NO: 76078 - DNA, 1733 bp, Homo sapiens
tctaggtcgaggccggtggtaatcggccgaggttgtcccttgcggtacccgtccgcatacgaatctagcccgggaaccgagttgcgggagtgcggtctgtgccgttccggccaggagtttgccgactgcagacgtcctgcgaaccggcaagatgtgctctctggggttgttccctcctccaccgcctcggggtcaagtcaccctatatgagcacaataacgagctggtgacgggcagtagctatgagagcccgccccccgacttccggggccagtggatcaatcttcctgtcctacaactgacaaaggatcccctaaagacccctggaaggctggaccatggcacaagaactgccttcatccatcaccgggagcaagtgtggaagagatgcatcaacatttggcgtgatgtgggcctttttggggtgctaaatgaaattgcaaactcagaagaagaggctcaggagcgaagatctgatcgctgaatttgcccaagtcacaaattggtccagctgctgcttgcgtgtctttgcatggcacccccacaccaacaagtttgcagtggccctgctagatgactcagtccgtgtgtataatgccagcagcaccatagtcccctccctgaagcaccggctgcagcgaaatgtggcgtctctggcctggaagccccttagtgcctctgtcttggctgtggcctgccagagctgcattcttatctggaccctggaccctacctccttgtctacccgaccctcttctggctgtgcccaagtgctgtctcaccctgggcatacacctgttaccagcttggcctgggcccccagtggggggcggctgctctcagcttcacccgtggatgctgctatccgggtatgggatgtctcaacagagacctgtgtcccccttccctggtttcgaggaggtggggtgaccaacctgctctggtccccagacggcagcaaaatcctggctaccactccttcagctgtctttcgagtctgggaggcccagatgtggacttgtgagaggtggcctactctatcagggcgctgtcagactggctgctggagcccagatggcagccgactgctgttcactgtattgggagagccactgatttactccctgtcttttccagaacgttgtggtgagggaaaggggtgcgttggaggtgcaaagtcagcaacgattgtggcagatctgtctgagacaacaatacagacaccagatggtgaggagaggcttgggggagaggctcactccatggtctgggaccccagtggggaacgtctggctgtgcttatgaaaggaaagccaagggtacaggatggtaaaccagtcatcctcctttttcgcactcgaaacagccctgtgtttgagctccttccctgtggcattatccagggggagccaggagcccagccccagctcatcactttccatccttccttcaacaaaggggccctgctcagtgtgggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctctaagaataaataagttttccttttgttttccactca

SEQ ID NO: 76079 - DNA, 1663 bp, Homo sapiens
gtatttttccctccagccttccctagttttgtggttatctcctctccatattcttgaactcacccccgacacctgttggctcagcctcttttagccctatttttcctgtcctctcctctacctacccaaataacccagagtgggtgtccagagtgggtgtccagagtgtggtgttgagagcacttactgggcagaaggacctggggagtgcctgtccttccttgtctttcacctagaaggtacctggtaagaggcctgtgaatggtttaatcagagctgcttcctcaaccctacagtgtttgagtgggtgaagacggcatccggctgggccctggcactctgtcgatgggcctcttccctccatgggtccctgttcccccatctgtctctcaggagcgaagatctgatcgctgaatttgcccaagtcacaaattggtccagctgctgcttgcgtgtctttgcatggcacccccacaccaacaagtttgcagtggccctgctagatgactcagtccgtgtgtataatgccagcagcaccatagtcccctccctgaagcaccggctgcagcgaaatgtggcgtctctggcctggaagccccttagtgcctctgtcttggctgtggcctgccagagctgcattcttatctggaccctggaccctacctccttgtctacccgaccctcttctggctgtgcccaagtgctgtctcaccctgggcatacacctgttaccagcttggcctgggcccccagtggggggcggctgctctcagcttcacccgtggatgctgctatccgggtatgggatgtctcaacagagacctgtgtcccccttccctggtttcgaggaggtggggtgaccaacctgctctggtccccagacggcagcaaaatcctggctaccactccttcagctgtctttcgagtctgggaggcccagatgtggacttgtgagaggtggcctactctatcagggcgctgtcagactggctgctggagcccagatggcagccgactgctgttcactgtattgggagagccactgatttactccctgtcttttccagaacgttgtggtgagggaaaggggtgcgttggaggtgcaaagtcagcaacgattgtggcagatctgtctgagacaacaatacagacaccagatggtgaggagaggcttgggggagaggctcactccatggtctgggaccccagtggggaacgtctggctgtgcttatgaaaggaaagccaagggtacaggatggtaaaccagtcatcctcctttttcgcactcgaaacagccctgtgtttgagctccttccctgtggcattatccagggggagccaggagcccagccccagctcatcactttccatccttccttcaacaaaggggccctgctcagtgtgggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctctaagaataaataagttttccttttgttttccactca

SEQ ID NO: 76080 - DNA, 1730 bp, Homo sapiens
cacttccgttgagttccgcctcgccgtttgtcccttgcggtacccgtccgcatacgaatctagcccgggaaccgagttgcgggagtgcggtctgtgccgttccggccaggagtttgccgactgcagacgtcctgcgaaccggcaagatgtgctctctggggttgttccctcctccaccgcctcggggtcaagtcaccctatatgagcacaataacgagctggtgacgggcagtagctatgagagcccgccccccgacttccggggccagtggatcaatcttcctgtcctacaactgacaaaggatcccctaaagacccctggaaggctggaccatggcacaagaactgccttcatccatcaccgggagcaagtgtggaagagatgcatcaacatttggcgtgatgtgggcctttttggggtgctaaatgaaattgcaaactcagaagaagaggtgtttgagtgggtgaagacggcatccggctgggccctggcactctgtcgatgggcctcttccctccatgggtccctgttcccccatctgtctctcaggagcgaagatctgatcgctgaatttgcccaagtcacaaattggtccagctgctgcttgcgtgtctttgcatggcacccccacaccaacaagtttgcagtggccctgctagatgactcagtccgtgtgtataatgccagcagcaccatagtcccctccctgaagcaccggctgcagcgaaatgtggcgtctctggcctggaagccccttagtgcctctgtcttggctgtggcctgccagagctgcattcttatctggaccctggaccctacctccttgtctacccgaccctcttctggctgtgcccaagtgctgtctcaccctgggcatacacctgttaccagcttggcctgggcccccagtggggggcggctgctctcagcttcacccgtggatgctgctatccgggtatgggatgtctcaacagagacctgtgtcccccttccctggtttcgaggaggtggggtgaccaacctgctctggtccccagacggcagcaaaatcctggctaccactccttcagctgtctttcgagtctgggaggcccagatgtggacttgtgagaggtggcctactctatcagggcgctgtcagactggctgctggagcccagatggcagccgactgctgttcactgtattgggagagccactgatttactccctgtcttttccagaacgttgtggtgagggaaaggggtgcgttggaggtgcaaagtcagcaacgattgtggcagatctgtctgagacaacaatacagacaccagatggtgaggagaggcttgggggagaggctcactccatggtctgggaccccagtggggaacgtctggctgtgcttatgaaaggaaagccaagggtacaggatggtaaaccagtcatcctcctttttcgcactcgaaacagccctgtgtttgagctccttccctgtggcattatccagggggagccaggagcccagccccagctcatcactttccatccttccttcaacaaaggggccctgctcagtgtggaaccccctgctgggggtggaggctctattcatgacctgcccctctttactgagacatccccaacctctgccccttgggaccctctcccagggccaccacctgttctgccccactccccacattcccacctctaagaataaataagttttccttttgttttccactca

SEQ ID NO: 76081 - DNA, 2376 bp, Homo sapiens
tctaggtcgaggccggtggtaatcggccgaggttgtcccttgcggtacccgtccgcatacgaatctagcccgggaaccgagttgcgggagtgcggtctgtgccgttccggccaggagtttgccgactgcagacgtcctgcgaaccggcaagatgtgctctctggggttgttccctcctccaccgcctcggggtcaagtcaccctatatgagcacaataacgagctggtgacgggcagtagctatgagagcccgccccccgacttccggggccaggtggccagggcgaggagggaggggacctacaggcatgggggcggagtcggggactactggggaaaggaggcagtgtgacaggggcagggtcacagagtctggcggagtggaaacagcttggccccggcaggagactagaagggctggaatctgttttaggactgggattggagtataacgggggaacggttaaggagctgtggaggaggcctagagggaatggagagaatgagggagaatctagggagtgtgaggatgcgggagaactatctaaaagttggggacagtatctggggaggatcagaaggatacaacatggaacttttttccatggtgttcctgggaaggacaaggaagggaaactgacatttattgagcgtttgctatgtaagaaagaggctgagtcaggtgttttctaaaaatgtcatatggtttcataatcacagcaaccctatgaaatattattctagttgcacagatacgggagctaagacttgtttcccattctcacaagtgttagctttgtggaaatgggaaacagacctctggaatctcttatacttagcccagcggtgggttggagatggcacggaattaaagatttgggaagagactgactcaccgtcacacccctcacttttgtgctatagtggatcaatcttcctgtcctacaactgacaaaggatcccctaaagacccctggaaggctggaccatggcacaagaactgccttcatccatcaccgggagcaagtgtggaagagatgcatcaacatttggcgtgatgtgggcctttttggggtgctaaatgaaattgcaaactcagaagaagaggtgtttgagtgggtgaagacggcatccggctgggccctggcactctgtcgatgggcctcttccctccatgggtccctgttcccccatctgtctctcaggagcgaagatctgatcgctgaatttgcccaagtcacaaattgcaccatagtcccctccctgaagcaccggctgcagcgaaatgtggcgtctctggcctggaagccccttagtgcctctgtcttggctgtggcctgccagagctgcattcttatctggaccctggaccctacctccttgtctacccgaccctcttctggctgtgcccaagtgctgtctcaccctgggcatacacctgttaccagcttggcctgggcccccagtggggggcggctgctctcagcttcacccgtggatgctgctatccgggtatgggatgtctcaacagagacctgtgtcccccttccctggtttcgaggaggtggggtgaccaacctgctctggtccccagacggcagcaaaatcctggctaccactccttcagctgtctttcgagtctgggaggcccagatgtggacttgtgagaggtggcctactctatcagggcgctgtcagactggctgctggagcccagatggcagccgactgctgttcactgtattgggagagccactgatttactccctgtcttttccagaacgttgtggtgagggaaaggggtgcgttggaggtgcaaagtcagcaacgattgtggcagatctgtctgagacaacaatacagacaccagatggtgaggagaggcttgggggagaggctcactccatggtctgggaccccagtggggaacgtctggctgtgcttatgaaaggaaagccaagggtacaggatggtaaaccagtcatcctcctttttcgcactcgaaacagccctgtgtttgagctccttccctgtggcattatccagggggagccaggagcccagccccagctcatcactttccatccttccttcaacaaaggggccctgctcagtgtgggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctctaagaataaataagttttccttttgttttccactca

SEQ ID NO: 76082 - DNA, 1401 bp, Homo sapiens
ataggcggagcgatcatatgtgtgccaatcaacataggcgtgatgtgggcttttgggggtgctaaatgaaattgcaaactcagaagaagaggtgttcgagtgggtccctgttccgccggtctgcctctcaggagcgaagatctgatcgctgaatttgcccaagtcacaaattggtccagctgctgcttgcgtgtctttgcatggcacccccacaccaacaagtttgcagtggccctgctagatgactcagtccgtgtgtataatgccagcagcaccatagtcccctccctgaagcaccggctgcagcgaaatgtggcgtctctggcctggaagccccttagtgcctctgtcttggctgtggcctgccagagctgcattcttatctggaccctggaccctacctccttgtctacccgaccctcttctggctgtgcccaagtgctgtctcaccctgggcatacacctgttaccagcttggcctgggcccccagtggggggcggctgctctcagcttcacccgtggatgctgctatccgggtatgggatgtctcaacagagacctgtgtcccccttccctggtttcgaggaggtggggtgaccaacctgctctggtccccagacggcagcaaaatcctggctaccactccttcagctgtctttcgagtctgggaggcccagatgtggacttgtgagaggtggcctactctatcagggcgctgtcagactggctgctggagcccagatggcagccgactgctgttcactgtattgggagagccactgatttactccctgtcttttccagaacgttgtggtgagggaaaggggtgcgttggaggtgcaaagtcagcaacgattgtggcagatctgtctgagacaacaatacagacaccagatggtgaggagaggcttgggggagaggctcactccatggtctgggaccccagtggggaacgtctggctgtgcttatgaaaggaaagccaagggtacaggatggtaaaccagtcatcctcctttttcgcactcgaaacagccctgtgtttgagctccttccctgtggcattatccagggggagccaggagcccagccccagctcatcactttccatccttccttcaacaaaggggccctgctcagtgtgggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctctaagaataaataagttttccttttgttttccactca

SEQ ID NO: 76083 - DNA, 1480 bp, Homo sapiens
cacttccgttgagttccgcctcgccgtttgtcccttgcggtacccgtccgcatacgaatctagcccgggaaccgagttgcgggagtgcggtctgtgccgttccggccaggagtttgccgactgcagacgtcctgcgaaccggcaagatgtgctctctggggttgttccctcctccaccgcctcggggtcaagtcaccctatatgagcacaataacgagctggtgacgggcagtagctatgagagcccgccccccgacttccggggccagtggatcaatcttcctgtcctacaactgacaaaggatcccctaaagacccctggaaggctggaccatggcacaagaactgccttcatccatcaccgggagcaagtgtggaagagatgcatcaacatttggcgtgatgtgggcctttttggggtgctaaatgaaattgcaaactcagaagaagaggtgtttgagtgggtgaagacggcatccggctgggccctggcactctgtcgatgggcctcttccctccatgggtccctgttcccccatctgtctctcaggagcgaagatctgatcgctgaatttgcccaagtcacaaattggtccagctgctgcttgcgtgtctttgcatggcacccccacaccaacaagtttgcagtggccctgctagatgactcagtccgtgtgtataatgccagcagcaccatagtcccctccctgaagcaccggctgcagcgaaatgtggcgtctctggcctggaagccccttagtgcctctgtcttggctgtggcctgccagagctgcattcttatctggaccctggaccctacctccttgtctacccgaccctcttctggctgtgcccaagtgctgtctcaccctgggcatacacctgttaccagcttggcctgggcccccagtggggggcggctgctctcagcttcacccgtggatgctgctatccgggtatgggatgtctcaacagagacctgtgtcccccttccctggtttcgaggaggtggggtgaccaacctgctctggtccccagacggcagcaaaatcctggctaccactccttcagctgtctttcgagtctgggaggcccagatgtggacttgtgagaggtggcctactctatcagggcgctgtcagactggctgctggagcccagatggcagccgactgctgttcactgtattgggagagccactgatttactccctgtcttttccagaacgttgtggtgagggaaaggggtgcgttggaggtgcaaagtcagcaacgattgtggcagatctgtctgagacaacaatacagacaccagatggtgaggagaggcttggaggatagggtgcctacccggggttgtacccctttgtgtatcctaatggctgtgcttattcaaaggatatgccatgggtacatcgatggtttcaccagcttatccttcttaatgtgctcatcgatacgggtcctgtgttctgagactc

SEQ ID NO: 76084 - DNA, 1246 bp, Homo sapiens
  misc_feature (1246)..(1246): n is a, c, g, or t
cacttccgttgagttccgcctcgccgtttgtcccttgcggtacccgtccgcatacgaatctagcccgggaaccgagttgcgggagtgcggtctgtgccgttccggccaggagtttgccgactgcagacgtcctgcgaaccggcaagatgtgctctctggggttgttccctcctccaccgcctcggggtcaagtcaccctatatgagcacaataacgagctggtgacgggcagtagctatgagagcccgccccccgacttccggggccagtggatcaatcttcctgtcctacaactgacaaaggatcccctaaagacccctggaaggctggaccatggcacaagaactgccttcatccatcaccgggagcaagtgtggaagagatgcatcaacatttggcgtgatgtgggcctttttggggtgctaaatgaaattgcaaactcagaagaagaggtgtttgagtgggtgaagacggcatccggctgggccctggcactctgtcgatgggcctcttccctccatgggtccctgttcccccatctgtctctcaggagcgaagatctgatcgctgaatttgcccaagtcacaaattggtccagctgctgcttgcgtgtctttgcatggcacccccacaccaacaagtttgcagtggccctgctagatgactcagtccgtgtgtataatgccagcagcaccatagtcccctccctgaagcaccggctgcagcgaaatgtggcgtctctggcctggaagccccttagtgcctctgtcttggctgtggcctgccagagctgcattcttatctggaccctggaccctacctccttgtctacccgaccctcttctggctgtgcccaagtgctgtctcaccctgggcatacacctgttaccagcttggcctgggcccccagtggggggcggctgctctcagcttcacccgtggatgctgctatccggttatgggatgtctcacagaaactgtgtccccttcctggttcgagaggtgggtggcaactgtcttggtcccagaggagaaatctggtacatctaaggggcttcgattggaggcaatggactggaggggcaaccataaggggaaagtgggaacaaagagcgcgggctggaggaaaccagagaaccggtacacagggggggaaggggaggaacaaggcttgaacaacctgggaggagagcagcgcggaggtcatagagaagaggagaaatcagctgtcctccacactgtagcn

SEQ ID NO: 76085 - DNA, 1695 bp, Homo sapiens
tctaggtcgaggccggtggtaatcggccgaggttgtcccttgcggtacccgtccgcatacgaatctagcccgggaaccgagttgcgggagtgcggtctgtgccgttccggccaggagtttgccgactgcagacgtcctgcgaaccggcaagatgtgctctctggggttgttccctcctccaccgcctcggggtcaagtcaccctatatgagcacaataacgagctggtgacgggcagtagctatgagagcccgccccccgacttccggggccaggtggccagggcgaggagggaggggacctacaggcatgggggcggagtcggggactactggggaaaggaggcagtgtgacaggggcagggtcacagagtctggcggagtggaaacagcttggccccggcaggagactagaagggctggaatctgttttaggactgggattggagtataacgggggaacggttaaggagctgtggaggaggcctagagggaatggagagaatgagggagaatctagggagtgtgaggatgcgggagaactatctaaaagttggggacagtatctggggaggatcagaaggatacaacatggaacttttttccatggtgttcctgggaaggacaaggaagggaaactgacatttattgagcgtttgctatgtaagaaagaggctgagtcaggtgttttctaaaaatgtcatatggtttcataatcacagcaaccctatgaaatattattctagttgcacagatacgggagctaagacttgtttcccattctcacaagtgttagctttgtggaaatgggaaacagacctctggaatctcttatacttagcccagcggtgggttggagatggcacggaattaaagatttgggaagagactgactcaccgtcacacccctcacttttgtgctatagtggatcaatcttcctgtcctacaactgacaaaggatcccctaaagacccctggaaggctggaccatggcacaagaactgccttcatccatcaccgggagcaagtgtggaagagatgcatcaacatttggcgtgatgtgggcctttttggggtgctaaatgaaattgcaaactcagaagaagagggtgagggaaaggggtgcgttggaggtgcaaagtcagcaacgattgtggcagatctgtctgagacaacaatacagacaccagatggtgaggagaggcttgggggagaggctcactccatggtctgggaccccagtggggaacgtctggctgtgcttatgaaaggaaagccaagggtacaggatggtaaaccagtcatcctcctttttcgcactcgaaacagccctgtgtttgagctccttccctgtggcattatccagggggagccaggagcccagccccagctcatcactttccatccttccttcaacaaaggggccctgctcagtgtgggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctctaagaataaataagttttccttttgttttccactca

SEQ ID NO: 76086 - DNA, 1326 bp, Homo sapiens
tctaggtcgaggccggtggtaatcggccgaggttgtcccttgcggtacccgtccgcatacgaatctagcccgggaaccgagttgcgggagtgcggtctgtgccgttccggccaggagtttgccgactgcagacgtcctgcgaaccggcaagatgtgctctctggggttgttccctcctccaccgcctcggggtcaagtcaccctatatgagcacaataacgagctggtgacgggcagtagctatgagagcccgccccccgacttccggggccaggtggccagggcgaggagggaggggacctacaggcatgggggcggagtcggggactactggggaaaggaggcagtgtgacaggggcagggtcacagagtctggcggagtggaaacagcttggccccggcaggagactagaagggctggaatctgttttaggactgggattggagtataacgggggaacggttaaggagctgtggaggaggcctagagggaatggagagaatgagggagaatctagggagtgtgaggatgcgggagaactatctaaaagttggggacagtatctggggaggatcagaaggatacaacatggaacttttttccatggtgttcctgggaaggacaaggaagggaaactgacatttattgagcgtttgctatgtaagaaagaggctgagtcaggtgttttctaaaaatgtcatatggtttcataatcacagcaaccctatgaaatattattctagttgcacagatacgggagctaagacttgtttcccattctcacaagtgttagctttgtggaaatgggaaacagacctctggaatctcttatacttagcccagcggtgggttggagatggcacggaattaaagatttgggaagagactgactcaccgtcacacccctcacttttgtgctatagtggatcaatcttcctgtcctacaactgacaaaggatcccctaaagacccctggaaggctggaccatggcacaagaactgccttcatccatcaccgggagcaagtgtggaagagatgcatcaacatttggcgtgatgtgggcctttttggggtgctaaatgaaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctctaagaataaataagttttccttttgttttccactca

SEQ ID NO: 76087 - DNA, 351 bp, Homo sapiens
tggggcttccaggagttggatggagaagctgagggccttggctgctgtatggctctgccaggtggcccttctttgggcccagactctgatccttttctttcccttctctgcagggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctctaagaataaataagtt

SEQ ID NO: 76088 - DNA, 407 bp, Homo sapiens
ctcgtgaaagcactctttcaccctggcctgagaccttgcagattacctcttctctgttgacctgctcgtggtgacttggtcgtttttccccttcgctgtttttttcttttaactttcacaatccttattcctttttcacaacctggatttgagcccagagtgggccatcaggataggaggttttagcaggaggcaaagaaatagaattttggggatggcttcttgtcatcttctgactccacatcctctgtgttcccctccagaccctcttctggctgtgcccaagtgctgtctcaccctgggcatacacctgttaccagcttggcctgggcccccagtggggggcggctgctctcagcttcacccgtggatgctgctatccgggtgagtgggtccctgcccctcat

SEQ ID NO: 76089 - DNA, 1820 bp, Homo sapiens
cacttccgttgagttccgcctcgccgtttgtcccttgcggtacccgtccgcatacgaatctagcccgggaaccgagttgcgggagtgcggtctgtgccgttccggccaggagtttgccgactgcagacgtcctgcgaaccggcaagatgtgctctctggggttgttccctcctccaccgcctcggggtcaagtcaccctatatgagcacaataacgagctggtgacgggcagtagctatgagagcccgccccccgacttccggggccagtggatcaatcttcctgtcctacaactgacaaaggatcccctaaagacccctggaaggctggaccatggcacaagaactgccttcatccatcaccgggagcaagtgtggaagagatgcatcaacatttggcgtgatgtgggcctttttggggtgctaaatgaaattgcaaactcagaagaagaggtgtttgagtgggtgaagacggcatccggctgggccctggcactctgtcgatgggcctcttccctccatgggtccctgttcccccatctgtctctcaggagcgaagatctgatcgctgaatttgcccaagtcacaaattggtccagctgctgcttgcgtgtctttgcatggcacccccacaccaacaagtttgcagtggccctgctagatgactcagtccgtgtgtataatgccagcagcaccatagtcccctccctgaagcaccggctgcagcgaaatgtggcgtctctggcctggaagccccttagtgcctctgtcttggctgtggcctgccagagctgcattcttatctggaccctggaccctacctccttgtctacccgaccctcttctggctgtgcccaagtgctgtctcaccctgggcatacacctgttaccagcttggcctgggcccccagtggggggcggctgctctcagcttcacccgtggatgctgctatccgggtatgggatgtctcaacagagacctgtgtcccccttccctggtttcgaggaggtggggtgaccaacctgctctggtccccagacggcagcaaaatcctggctaccactccttcagctgtctttcgagtctgggaggcccagatgtggacttgtgagaggtggcctactctatcagggcgctgtcagactggctgctggagcccagatggcagccgactgctgttcactgtattgggagagccactgatttactccctgtcttttccagaacgttgtggtgagggaaaggggtgcgttggaggtgcaaagtcagcaacgattgtggcagatctgtctgagacaacaatacagacaccagatggtgaggagaggcttgggggagaggctcactccatggtctgggaccccagtggggaacgtctggctgtgcttatgaaaggaaagccaagggtacaggatggtaaaccagtcatcctcctttttcgcactcgaaacagccctgtgtttgagctccttccctgtggcattatccagggggagccaggagcccagccccagctcatcactttccatccttccttcaacaaaggggccctgctcagtgtgggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctctaagaataaataagttttccttttgttttccactca

SEQ ID NO: 76090 - DNA, 1825 bp, Homo sapiens
tctaggtcgaggccggtggtaatcggccgaggttgtcccttgcggtacccgtccgcatacgaatctagcccgggaaccgagttgcgggagtgcggtctgtgccgttccggccaggagtttgccgactgcagacgtcctgcgaaccggcaagatgtgctctctggggttgttccctcctccaccgcctcggggtcaagtcaccctatatgagcacaataacgagctggtgacgggcagtagctatgagagcccgccccccgacttccggggccagtggatcaatcttcctgtcctacaactgacaaaggatcccctaaagacccctggaaggctggaccatggcacaagaactgccttcatccatcaccgggagcaagtgtggaagagatgcatcaacatttggcgtgatgtgggcctttttggggtgctaaatgaaattgcaaactcagaagaagaggtgtttgagtgggtgaagacggcatccggctgggccctggcactctgtcgatgggcctcttccctccatgggtccctgttcccccatctgtctctcaggagcgaagatctgatcgctgaatttgcccaagtcacaaattggtccagctgctgcttgcgtgtctttgcatggcacccccacaccaacaagtttgcagtggccctgctagatgactcagtccgtgtgtataatgccagcagcaccatagtcccctccctgaagcaccggctgcagcgaaatgtggcgtctctggcctggaagccccttagtgcctctgtcttggctgtggcctgccagagctgcattcttatctggaccctggaccctacctccttgtctacccgaccctcttctggctgtgcccaagtgctgtctcaccctgggcatacacctgttaccagcttggcctgggcccccagtggggggcggctgctctcagcttcacccgtggatgctgctatccgggtatgggatgtctcaacagagacctgtgtcccccttccctggtttcgaggaggtggggtgaccaacctgctctggtccccagacggcagcaaaatcctggctaccactccttcagctgtctttcgagtctgggaggcccagatgtggacttgtgagaggtggcctactctatcagggcgctgtcagactggctgctggagcccagatggcagccgactgctgttcactgtattgggagagccactgatttactccctgtcttttccagaacgttgtggtgagggaaaggggtgcgttggaggtgcaaagtcagcaacgattgtggcagatctgtctgagacaacaatacagacaccagatggtgaggagaggcttgggggagaggctcactccatggtctgggaccccagtggggaacgtctggctgtgcttatgaaaggaaagccaagggtacaggatggtaaaccagtcatcctcctttttcgcactcgaaacagccctgtgtttgagctccttccctgtggcattatccagggggagccaggagcccagccccagctcatcactttccatccttccttcaacaaaggggccctgctcagtgtgggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctctaagaataaataagttttccttttgttttccactca

SEQ ID NO: 76091 - DNA, 2475 bp, Homo sapiens
tctaggtcgaggccggtggtaatcggccgaggttgtcccttgcggtacccgtccgcatacgaatctagcccgggaaccgagttgcgggagtgcggtctgtgccgttccggccaggagtttgccgactgcagacgtcctgcgaaccggcaagatgtgctctctggggttgttccctcctccaccgcctcggggtcaagtcaccctatatgagcacaataacgagctggtgacgggcagtagctatgagagcccgccccccgacttccggggccaggtggccagggcgaggagggaggggacctacaggcatgggggcggagtcggggactactggggaaaggaggcagtgtgacaggggcagggtcacagagtctggcggagtggaaacagcttggccccggcaggagactagaagggctggaatctgttttaggactgggattggagtataacgggggaacggttaaggagctgtggaggaggcctagagggaatggagagaatgagggagaatctagggagtgtgaggatgcgggagaactatctaaaagttggggacagtatctggggaggatcagaaggatacaacatggaacttttttccatggtgttcctgggaaggacaaggaagggaaactgacatttattgagcgtttgctatgtaagaaagaggctgagtcaggtgttttctaaaaatgtcatatggtttcataatcacagcaaccctatgaaatattattctagttgcacagatacgggagctaagacttgtttcccattctcacaagtgttagctttgtggaaatgggaaacagacctctggaatctcttatacttagcccagcggtgggttggagatggcacggaattaaagatttgggaagagactgactcaccgtcacacccctcacttttgtgctatagtggatcaatcttcctgtcctacaactgacaaaggatcccctaaagacccctggaaggctggaccatggcacaagaactgccttcatccatcaccgggagcaagtgtggaagagatgcatcaacatttggcgtgatgtgggcctttttggggtgctaaatgaaattgcaaactcagaagaagaggtgtttgagtgggtgaagacggcatccggctgggccctggcactctgtcgatgggcctcttccctccatgggtccctgttcccccatctgtctctcaggagcgaagatctgatcgctgaatttgcccaagtcacaaattggtccagctgctgcttgcgtgtctttgcatggcacccccacaccaacaagtttgcagtggccctgctagatgactcagtccgtgtgtataatgccagcagcaccatagtcccctccctgaagcaccggctgcagcgaaatgtggcgtctctggcctggaagccccttagtgcctctgtcttggctgtggcctgccagagctgcattcttatctggaccctggaccctacctccttgtctacccgaccctcttctggctgtgcccaagtgctgtctcaccctgggcatacacctgttaccagcttggcctgggcccccagtggggggcggctgctctcagcttcacccgtggatgctgctatccgggtatgggatgtctcaacagagacctgtgtcccccttccctggtttcgaggaggtggggtgaccaacctgctctggtccccagacggcagcaaaatcctggctaccactccttcagctgtctttcgagtctgggaggcccagatgtggacttgtgagaggtggcctactctatcagggcgctgtcagactggctgctggagcccagatggcagccgactgctgttcactgtattgggagagccactgatttactccctgtcttttccagaacgttgtggtgagggaaaggggtgcgttggaggtgcaaagtcagcaacgattgtggcagatctgtctgagacaacaatacagacaccagatggtgaggagaggcttgggggagaggctcactccatggtctgggaccccagtggggaacgtctggctgtgcttatgaaaggaaagccaagggtacaggatggtaaaccagtcatcctcctttttcgcactcgaaacagccctgtgtttgagctccttccctgtggcattatccagggggagccaggagcccagccccagctcatcactttccatccttccttcaacaaaggggccctgctcagtgtgggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctctaagaataaataagttttccttttgttttccactca

SEQ ID NO: 76092 - DNA, 2376 bp, Homo sapiens
tctaggtcgaggccggtggtaatcggccgaggttgtcccttgcggtacccgtccgcatacgaatctagcccgggaaccgagttgcgggagtgcggtctgtgccgttccggccaggagtttgccgactgcagacgtcctgcgaaccggcaagatgtgctctctggggttgttccctcctccaccgcctcggggtcaagtcaccctatatgagcacaataacgagctggtgacgggcagtagctatgagagcccgccccccgacttccggggccaggtggccagggcgaggagggaggggacctacaggcatgggggcggagtcggggactactggggaaaggaggcagtgtgacaggggcagggtcacagagtctggcggagtggaaacagcttggccccggcaggagactagaagggctggaatctgttttaggactgggattggagtataacgggggaacgtatctggggaggatcagaaggatacaacatggaacttttttccatggtgttcctgggaaggacaaggaagggaaactgacatttattgagcgtttgctatgtaagaaagaggctgagtcaggtgttttctaaaaatgtcatatggtttcataatcacagcaaccctatgaaatattattctagttgcacagatacgggagctaagacttgtttcccattctcacaagtgttagctttgtggaaatgggaaacagacctctggaatctcttatacttagcccagcggtgggttggagatggcacggaattaaagatttgggaagagactgactcaccgtcacacccctcacttttgtgctatagtggatcaatcttcctgtcctacaactgacaaaggatcccctaaagacccctggaaggctggaccatggcacaagaactgccttcatccatcaccgggagcaagtgtggaagagatgcatcaacatttggcgtgatgtgggcctttttggggtgctaaatgaaattgcaaactcagaagaagaggtgtttgagtgggtgaagacggcatccggctgggccctggcactctgtcgatgggcctcttccctccatgggtccctgttcccccatctgtctctcaggagcgaagatctgatcgctgaatttgcccaagtcacaaattggtccagctgctgcttgcgtgtctttgcatggcacccccacaccaacaagtttgcagtggccctgctagatgactcagtccgtgtgtataatgccagcagcaccatagtcccctccctgaagcaccggctgcagcgaaatgtggcgtctctggcctggaagccccttagtgcctctgtcttggctgtggcctgccagagctgcattcttatctggaccctggaccctacctccttgtctacccgaccctcttctggctgtgcccaagtgctgtctcaccctgggcatacacctgttaccagcttggcctgggcccccagtggggggcggctgctctcagcttcacccgtggatgctgctatccgggtatgggatgtctcaacagagacctgtgtcccccttccctggtttcgaggaggtggggtgaccaacctgctctggtccccagacggcagcaaaatcctggctaccactccttcagctgtctttcgagtctgggaggcccagatgtggacttgtgagaggtggcctactctatcagggcgctgtcagactggctgctggagcccagatggcagccgactgctgttcactgtattgggagagccactgatttactccctgtcttttccagaacgttgtggtgagggaaaggggtgcgttggaggtgcaaagtcagcaacgattgtggcagatctgtctgagacaacaatacagacaccagatggtgaggagaggcttgggggagaggctcactccatggtctgggaccccagtggggaacgtctggctgtgcttatgaaaggaaagccaagggtacaggatggtaaaccagtcatcctcctttttcgcactcgaaacagccctgtgtttgagctccttccctgtggcattatccagggggagccaggagcccagccccagctcatcactttccatccttccttcaacaaaggggccctgctcagtgtgggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctctaagaataaataagttttccttttgttttccactca

SEQ ID NO: 76093 - DNA, 1735 bp, Homo sapiens
cacttccgttgagttccgcctcgccgtttgtcccttgcggtacccgtccgcatacgaatctagcccgggaaccgagttgcgggagtgcggtctgtgccgttccggccaggagtttgccgactgcagacgtcctgcgaaccggcaagatgtgctctctggggttgttccctcctccaccgcctcggggtcaagtcaccctatatgagcacaataacgagctggtgacgggcagtagctatgagagcccgccccccgacttccggggccagtggatcaatcttcctgtcctacaactgacaaaggatcccctaaagacccctggaaggctggaccatggcacaagaactgccttcatccatcaccgggagcaagtgtggaagagatgcatcaacatttggcgtgatgtgggcctttttggggtgctaaatgaaattgcaaactcagaagaagaggtgtttgagtgggtgaagacggcatccggctgggccctggcactctgtcgatgggcctcttccctccatgggtccctgttcccccatctgtctctcaggagcgaagatctgatcgctgaatttgcccaagtcacaaattggtccagctgctgcttgcgtgtctttgcatggcacccccacaccaacaagtttgcagtggccctgctagatgactcagtccgtgtgtataatgccagcagcaccatagtcccctccctgaagcaccggctgcagcgaaatgtggcgtctctggcctggaagccccttagtgcctctgtcttggctgtggcctgccagagctgcattcttatctggaccctggaccctacctccttgtctacccgaccctcttctggctgtgcccaagtgctgtctcaccctgggcatacacctgttaccagcttggcctgggcccccagtggggggcggctgctctcagcttcacccgtggatgctgctatccgggtatgggatgtctcaacagagacctgtgtcccccttccctggtttcgaggaggtggggtgaccaacctgctctggtccccagacggcagcaaaatcctggctaccactccttcagctgtctttcgagtctgggaggcccagatgtggacttgtgagaggtggcctactctatcagggcgctgtcagactggctgctggagcccagatggcagccgactgctgttcactgtattgggagagccactgatttactccctgtcttttccagaacgttgtggtgagggaaaggggtgcgttggaggtgcaaagtcagcaacgattgtggcagatctgtctgagacaacaatacagacaccagatggtgaggagaggcttgggggagaggctcactccatggtctgggaccccagtggggaacgtctggctgtgcttatgaaaggaaagccaagggtacaggatggtaaaccagtcatcctcctttttcgcactcgaaacagccctgtgtttgagctccttccctgggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctctaagaataaataagttttccttttgttttccactca

SEQ ID NO: 76094 - DNA, 2129 bp, Homo sapiens
cacttccgttgagttccgcctcgccgtttgtcccttgcggtacccgtccgcatacgaatctagcccgggaaccgagttgcgggagtgcggtctgtgccgttccggccaggagtttgccgactgcagacgtcctgcgaaccggcaagatgtgctctctggggttgttccctcctccaccgcctcggggtcaagtcaccctatatgagcacaataacgagctggtgacgggcagtagctatgagagcccgccccccgacttccggggccagtggatcaatcttcctgtcctacaactgacaaaggatcccctaaagacccctggaaggctggaccatggcacaagaactgccttcatccatcaccgggagcaagtgtggaagagatgcatcaacatttggcgtgatgtgggcctttttggggtgctaaatgaaattgcaaactcagaagaagaggtgtttgagtgggtgaagacggcatccggctgggccctggcactctgtcgatgggcctcttccctccatgggtccctgttcccccatctgtctctcaggagcgaagatctgatcgctgaatttgcccaagtcacaaattggtccagctgctgcttgcgtgtctttgcatggcacccccacaccaacaagtttgcagtggccctgctagatgactcagtccgtgtgtataatgccagcaggtgtgtgtggggacaccaggtgggctctgacttgtcaatatcaccttcccttgccagccttggttccggggagtcctgtagttcttgaacctgattcatggggctccttccagaactggggtcagggaagctccataactggatgcgtgcttcttctagacctaacctttatcccctcctgtcctatggtgcccctggcccctggatggatcatccttcttctctgtggctttccctccttaactgcactctggtccctggagccttagtgttcctgccttgactcagtttcctgccccttcaccctagcaccatagtcccctccctgaagcaccggctgcagcgaaatgtggcgtctctggcctggaagccccttagtgcctctgtcttggctgtggcctgccagagctgcattcttatctggaccctggaccctacctccttgtctacccgaccctcttctggctgtgcccaagtgctgtctcaccctgggcatacacctgttaccagcttggcctgggcccccagtggggggcggctgctctcagcttcacccgtggatgctgctatccgggtatgggatgtctcaacagagacctgtgtcccccttccctggtttcgaggaggtggggtgaccaacctgctctggtccccagacggcagcaaaatcctggctaccactccttcagctgtctttcgagtctgggaggcccagatgtggacttgtgagaggtggcctactctatcagggcgctgtcagactggctgctggagcccagatggcagccgactgctgttcactgtattgggagagccactgatttactccctgtcttttccagaacgttgtggtgagggaaaggggtgcgttggaggtgcaaagtcagcaacgattgtggcagatctgtctgagacaacaatacagacaccagatggtgaggagaggcttgggggagaggctcactccatggtctgggaccccagtggggaacgtctggctgtgcttatgaaaggaaagccaagggtacaggatggtaaaccagtcatcctcctttttcgcactcgaaacagccctgtgtttgagctccttccctgtggcattatccagggggagccaggagcccagccccagctcatcactttccatccttccttcaacaaaggggccctgctcagtgtgggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctctaagaataaataagttttccttttgttttccactca

SEQ ID NO: 76095 - DNA, 1566 bp, Homo sapiens
cactgttcctcctctctgaggcttttccctcagctttccagccagctgcctgtgacatagcctgtattttcctctgggtgatccacaggcctgggaggattaatttgtggatcaatcttcctgtcctacaactgacaaaggatcccctaaagacccctggaaggctggaccatggcacaagaactgccttcatccatcaccgggagcaagtgtggaagagatgcatcaacatttggcgtgatgtgggcctttttggggtgctaaatgaaattgcaaactcagaagaagaggctcaggagcgaagatctgatcgctgaatttgcccaagtcacaaattggtccagctgctgcttgcgtgtctttgcatggcacccccacaccaacaagtttgcagtggccctgctagatgactcagtccgtgtgtataatgccagcagcaccatagtcccctccctgaagcaccggctgcagcgaaatgtggcgtctctggcctggaagccccttagtgcctctgtcttggctgtggcctgccagagctgcattcttatctggaccctggaccctacctccttgtctacccgaccctcttctggctgtgcccaagtgctgtctcaccctgggcatacacctgttaccagcttggcctgggcccccagtggggggcggctgctctcagcttcacccgtggatgctgctatccgggtatgggatgtctcaacagagacctgtgtcccccttccctggtttcgaggaggtggggtgaccaacctgctctggtccccagacggcagcaaaatcctggctaccactccttcagctgtctttcgagtctgggaggcccagatgtggacttgtgagaggtggcctactctatcagggcgctgtcagactggctgctggagcccagatggcagccgactgctgttcactgtattgggagagccactgatttactccctgtcttttccagaacgttgtggtgagggaaaggggtgcgttggaggtgcaaagtcagcaacgattgtggcagatctgtctgagacaacaatacagacaccagatggtgaggagaggcttgggggagaggctcactccatggtctgggaccccagtggggaacgtctggctgtgcttatgaaaggaaagccaagggtacaggatggtaaaccagtcatcctcctttttcgcactcgaaacagccctgtgtttgagctccttccctgtggcattatccagggggagccaggagcccagccccagctcatcactttccatccttccttcaacaaaggggccctgctcagtgtgggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctctaagaataaataagttttccttttgttttccactca

SEQ ID NO: 76096 - DNA, 1598 bp, Homo sapiens
tctaggtcgaggccggtggtaatcggccgaggttgtcccttgcggtacccgtccgcatacgaatctagcccgggaaccgagttgcgggagtgcggtctgtgccgttccggccaggagtttgccgactgcagacgtcctgcgaaccgtggatcaatcttcctgtcctacaactgacaaaggatcccctaaagacccctggaaggctggaccatggcacaagaactgccttcatccatcaccgggagcaagtgtggaagagatgcatcaacatttggcgtgatgtgggcctttttggggtgctaaatgaaattgcaaactcagaagaagaggtgtttgagtgggtgaagacggcatccggctgggccctggcactctgtcgatgggcctcttccctccatgggtccctgttcccccatctgtctctcaggagcgaagatctgatcgctgaatttgcccaagtcacaaattgcaccatagtcccctccctgaagcaccggctgcagcgaaatgtggcgtctctggcctggaagccccttagtgcctctgtcttggctgtggcctgccagagctgcattcttatctggaccctggaccctacctccttgtctacccgaccctcttctggctgtgcccaagtgctgtctcaccctgggcatacacctgttaccagcttggcctgggcccccagtggggggcggctgctctcagcttcacccgtggatgctgctatccgggtatgggatgtctcaacagagacctgtgtcccccttccctggtttcgaggaggtggggtgaccaacctgctctggtccccagacggcagcaaaatcctggctaccactccttcagctgtctttcgagtctgggaggcccagatgtggacttgtgagaggtggcctactctatcagggcgctgtcagactggctgctggagcccagatggcagccgactgctgttcactgtattgggagagccactgatttactccctgtcttttccagaacgttgtggtgagggaaaggggtgcgttggaggtgcaaagtcagcaacgattgtggcagatctgtctgagacaacaatacagacaccagatggtgaggagaggcttgggggagaggctcactccatggtctgggaccccagtggggaacgtctggctgtgcttatgaaaggaaagccaagggtacaggatggtaaaccagtcatcctcctttttcgcactcgaaacagccctgtgtttgagctccttccctgtggcattatccagggggagccaggagcccagccccagctcatcactttccatccttccttcaacaaaggggccctgctcagtgtgggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctctaagaataaataagttttccttttgttttccactca

SEQ ID NO: 76097 - DNA, 1144 bp, Homo sapiens
aaaagcataggccagcagtgctttggtatatacatggctgccatggtccccttcttgtgctgtcttccaggctgactccaggcaaaacagggcattgcggacaacagggtgagtgactgtgagaggaatctccagaagtgcgcctgggtgcgcacccagaccctcttctggctgtgcccaagtgctgtctcaccctgggcatacacctgttaccagcttggcctgggcccccagtggggggcggctgctctcagcttcacccgtggatgctgctatccgggtatgggatgtctcaacagagacctgtgtcccccttccctggtttcgaggaggtggggtgaccaacctgctctggtccccagacggcagcaaaatcctggctaccactccttcagctgtctttcgagtctgggaggcccagatgtggacttgtgagaggtggcctactctatcagggcgctgtcagactggctgctggagcccagatggcagccgactgctgttcactgtattgggagagccactgatttactccctgtcttttccagaacgttgtggtgagggaaaggggtgcgttggaggtgcaaagtcagcaacgattgtggcagatctgtctgagacaacaatacagacaccagatggtgaggagaggcttgggggagaggctcactccatggtctgggaccccagtggggaacgtctggctgtgcttatgaaaggaaagccaagggtacaggatggtaaaccagtcatcctcctttttcgcactcgaaacagccctgtgtttgagctccttccctgtggcattatccagggggagccaggagcccagccccagctcatcactttccatccttccttcaacaaaggggccctgctcagtgtgggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctctaagaataaataagttttccttttgttttccactca

SEQ ID NO: 76098 - DNA, 1384 bp, Homo sapiens
tctaggtcgaggccggtggtaatcggccgaggttgtcccttgcggtacccgtccgcatacgaatctagcccgggaaccgagttgcgggagtgcggtctgtgccgttccggccaggagtttgccgactgcagacgtcctgcgaaccggcaagatgtgctctctggggttgttccctcctccaccgcctcggggtcaagtcaccctatatgagcacaataacgagctggtgacgggcagtagctatgagagcccgccccccgacttccggggccaggtggccagggcgaggagggaggggacctacaggcatgggggcggagtcggggactactggggaaaggaggcagtgtgacaggggcagggtcacagagtctggcggagtggaaacagcttggccccggcaggagactagaagggctggaatctgttttaggactgggattggagtataacgggggaacggttaaggagctgtggaggaggcctagagggaatggagagaatgagggagaatctagggagtgtgaggatgcgggagaactatctaaaagttggggacagtatctggggaggatcagaaggatacaacatggaacttttttccatggtgttcctgggaaggacaaggaagggaaactgacatttattgagcgtttgctatgtaagaaagaggctgagtcaggtgttttctaaaaatgtcatatggtttcataatcacagcaaccctatgaaatattattctagttgcacagatacgggagctaagacttgtttcccattctcacaagtgttagctttgtggaaatgggaaacagacctctggaatctcttatacttagcccagcggtgggttggagatggcacggaattaaagatttgggaagagactgactcaccgtcacacccctcacttttgtgctatagtggatcaatcttcctgtcctacaactgacaaaggatcccctaaagacccctggaaggctggaccatggcacaagaactgccttcatccatcaccgggagcaagtgtggaagagatgcatcaacatttggcgtgatgtgggcctttttggggtgctaaatgaaattccatccttccttcaacaaaggggccctgctcagtgtgggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctctaagaataaataagttttccttttgttttccactca

SEQ ID NO: 76099 - DNA, 311 bp, Homo sapiens
tttttaaatagagataggtttcactatgttgcccaggctggtctccaacttttgagctcaagcaatctgcccgcctcagcctcccaaagtgctggtattacaggcgtgagccactgcaccagaactttaatcatactttataaacaaagattagtctgacagaggttaaatcccctcacccaaaagcaaccacaagtcagtatcttaacacttccttcttaagggttttaaaaacatatttgagttagtattttatcttttatatctcgcctattaaaccactaataattttccatgccactaaaatgcaa

SEQ ID NO: 76100 - DNA, 333 bp, Homo sapiens
tggaatccagtcagtgtgttttcaagccacctcaagggcccttgctcctttgttgccctgcgtctccacccctttgacccctttatccagtgggtaatcatttaacctattcttggaccttgatcctcaatacggaacttgtgaattttgctcatcagttgataatgggagaaatattcgcttctgtccagtcctgggctcccacagggctgagtaaggacatttctctgccccaacttccagaggcaggagattagacagggatgacagttaaggggttactggtaataggaaaatcattaaaactggagatataactaggtaaaaaagaaa

SEQ ID NO: 76101 - DNA, 352 bp, Homo sapiens
ataatgtaattgcagcatccacaaagaaagcttcatgcatgtagtatgtatgcatatggtaatttgttttgcctgtgtataccttataaatctttattagtaaaatcttgattaccaacattttcaaaatccatagtttttctgtactgctataaatcacttagaaaataagataggttatcaattttttatttacttgttatttgttttacaaaaatttgaaagtatagagtttcacaaagctttttgttatttttaatttatataaaatagtcctacaatgcatatcttggttaatgtatgaatcaaatttttcatgatatccttatgaataaaatacagcctacatgct

SEQ ID NO: 76102 - DNA, 418 bp, Homo sapiens
tggccctcactcttagctccccaagtatttcgctccctttccctctctcctcaattccagcaacagtgatctgtgtgccctgcatgtctctgcatccctcattctccttccatgaggacattaaaataaattcatgatatcctgcctttgggcctttttgtaaatatccttcacccagcacatagaattcctaccgctagtcatatttagtacatgataatctacccattacaataaccacctcctcattctttcttgttctggacctcttcaatgctcatattgaagagactgtttttgactcttcagatctcctagaatgttcttgaggtctttcctttgattactttgtgatttatcaaatgaaacatgggacccttgaaggtaacttcttctgcaggattttttgtttgtttgt

SEQ ID NO: 76103 - DNA, 821 bp, Homo sapiens
ctcccctgaattcatttgctgtggcaaatatggcttccttaaaatctgctgtttatgaaaatacaggacacaacaaaaagacagctgtctgcaagtcatgaagacagccattaccaggaaccaaactgaatggtaccttgatcttgtgcttttcggtctcgagagctgtgagaaacaaatgcctgctgttcaaattgtccagcctatggtattttgttacggcagtctgagctgaccaagataaccggaaacctagaaaaaaaactgagagactagataacacatgctccagaaaaaaaagtacttgatccagaaaaagttgaggaaggagatatctttttcagttgtgcgtcaatttcagtatgttgcctgcaataacaaataaataattgatgaactaaatggacgttatgtcatataaactcttaataagaacacctatgaatatttatgaagagcataattttacagaggaacacccaagtaatggtcacaggaattgaagagcttgcaagggtcaagcgctaatcagtgatggaacttggttttaaactccattatttcctgcagcagagtctacatcctcaaatgtttcaccatgccatctacagtctgatgtgctttccagatttctcaccattccacttgatctcctttaaatgactttgatttgagagtgtgcatcttcaaatatagtgctcagaactggatgcaatgctcacaatatcatgtgaccagcactaagtcgatacaagtttattcctttgaatttgtcctggcgtttgacaaggatattgtggatattaaagatatttatttca

SEQ ID NO: 76104 - DNA, 487 bp, Homo sapiens
aggccgaggtgggtggatcacctgaggtcaggggttcaagaccagtctggccaacatggtgaaaccccatctctactaaaaacacaaaaattacctgggtgcggtggcaggcgcctgtagtcccaggtatttggaaggctgaggcaggagaattgccaacccaggaggcggaggttgcagtgagccgagatcgtgccactgcgctccagcctggtgacagagtgagactccatctcaataaataaataaataaataaataaataaataaataaataaatcatgttctaccaaaatatgaactactctcccaaactataagccaaaattacaattaagtaaaaatagtcaaaatgaaagcccacacttccagtcctgttttataagcaattagggaaaataataggatgcctaatttttcaactctgtgacctacgttgcaatctagaccttcatttctttcttttttttttttttttttttttttta

SEQ ID NO: 76105 - DNA, 642 bp, Homo sapiens
gcttttactgcagcatgatagaaaaattaaccacaggtatatcataacaaaaagaccatgagttaccattttcacaaagttcagatatatttaaattagcctatttaatctttttttggttgttgttgagatggagtctcactctgtctctcaggctggagtacagtggcacaatctcagctcactgcaacctctgcctcccaggttcaagtaattctcctgcctcagcctcccgagtagcggggattacaggtgcccaacaccacacatggctaatttttgtatttttagtagagatggggttttgccatgttagccaggctggtcttgaactcctgacctcagatgatccgcctgcctcggcctctcaaagtgctgggattacaggcatgagccatcgcacccagcctatggtacacctttactgaggaaacaattcaggaacatcactcttagtaaggcaattgttgattataagtcaaaaaaacaccatcatgtacaaattcaggggattttgtataccttgtttttttggttacaaatatgcaaaattaaagatgtttgctaatacttgtttccaatttttaaacttttcaagtgttgcactgttaataatgttaaaataaaaggcatttgacttag

SEQ ID NO: 76106 - DNA, 2962 bp, Homo sapiens
  misc_feature (2905)..(2905): n is a, c, g, or t
aacctgtttgtggcctggtcggcgtcccgtagggcgccctcccgcgctaggccggccggcgtggcgctcggcgccgaacaggccccgaggaggccgcagttaggcctagtgattatccagttgccctgagcggctgcggaggtgcgctccataagcgggcagggtgggaaaagttcgcccgtttgtccggaaggcagttgatggacctggggtcgacaccactgcggacgcagggcacggcacgggggcgagaaggcgaaggctgcaggcgtgaggagctgtgactaatgagaattaaaggccatggatgaagatgaatttgaattgcagccacaagagccaaactcattttttgatggaataggagctgatgctacacacatggatggtgatcagattgttgtggaaatacaagaagcagtttttgtttctaatattgtggattctgacataactgtgcataactttgttcctgatgacccagactcagttgtaatccaagatgttgttgaagatgttgtcatagaggaggatgttcagtgctcagatatcttagaagaggcagatgtatctgaaaatgtcatcattcctgagcaagtgctggactcagatgtaactgaagaagtttctttaccacactgcacagtcccagatgatgttttagcttctgacattacttcaacctcaatgtctatgccagaacatgttttaacgagtgaatccatgcatgtgtgtgacattggacatgttgaacatatggtgcatgatagtgtagtggaagcagaaatcattactgatcctctgacgagtgacatagtttcagaagaagtattggtagcagactgtgcccctgaagcagtcatagatgccagcgggatctcagtggaccagcaagataatgacaaagccagctgtgaggactacctaatgatttcgttggatgatgctggcaaaatagaacatgatggttccactggagtgaccatcgatgcagaatcagaaatggatccttgtaaagtggatagcacttgtcctgaagtcatcaaggtgtacatttttaaagctgaccctggagaagatgacttaggtggaactgtagacattgtggagagtgaacctgaaaatgatcatggagttgaactacttgatcagaacagcagtattcgtgttcccagggaaaagatggtttatatgactgtcaatgactctcaacaagaagatgaagatttaaatgttgctgaaattgctgatgaagtttatatggaagtgatcgtaggagaggaggatgctgctgttgcagcagcagcagctgctgtgcatgagcagcaaattgatgaggatgaaatgaaaaccttcgtaccaattgcatgggcagcagcttatggtaataattctgatggaattgaaaaccggaatggcactgcaagtgccctcttgcacatagatgagtctgctggccttggcagactggctaaacagaaaccaaagaaaaagagaagacctgattccaggcagtaccaaacagcaataattattggccctgatggtcatcctttgactgtctatccttgcatgatttgtgggaagaagtttaagtcgaggggttttttgaaaagacacatgaaaaaccatcctgaacaccttgccaagaagaagtaccactgtactgactgtgattacactaccaataagaagataagtttacataaccacctggagagccacaagctgaccagcaaggcagagaaggccattgaatgtgatgagtgtgggaagcatttttctcatgcaggggctttgtttactcacaaaatggtgcataaggaaaaaggggccaacaaaatgcacaagtgtaaattctgtgaatatgagacagctgaacaggggttattgaatcgccacctcttggcagtccacagcaagaactttcctcatatttgtgtggagtgtggtaaaggtttccgacacccgtcggaactgagaaagcacatgcgaatccataccggcgagaagccataccaatgccagtactgtgaatataggtctgcagactcttctaacttgaaaacacatataaaaacaaagcatagtaaagagatgccattcaagtgtgacatttgtcttctgactttctcagataccaaagaagtgcagcaacatactcttgtccaccaagaaagcaaaacacatcagtgtttgcattgcgaccacaagagttcaaactcaagtgatttgaaacgacatgtaatttcagttcatacgaaagactatcctcataagtgtgagatgtgcgagaaaggctttcacaggccttcagaacttaagaaacatgtggctgtccacaaaggtaaaaaaatgcaccaatgtagacattgtgactttaagattgcagacccatttgttctaagtcgccatattctctcagttcacacaaaggatcttccatttaggtgtaagagatgtagaaagggatttaggcaacaaaatgagcttaaaaagcatatgaagacacacagtggcaggaaagtatatcagtgtgagtactgtgagtatagcactacagatgcctcaggctttaaacggcacgttatttccattcatacaaaagactatcctcatcggtgtgagtactgcaagaaaggcttccgaagaccttcagaaaagaaccagcacataatgagacaccataaagaagttggtctgccctaacagtgtgtctacaagcttgtaaagatgttggccttgaagcagaaaattcattttttaaagccagtcttgttcacatccattactatacattgaattatgctgtgtaaaaatagaattattgcttctagtccacttttctttacattttattcaatacgctgtcctgaatcctattcagtttctttaatagatgagnaaaaatagcaacaagcaagttgcttataataaaataatttgtgattctcccgaattc

SEQ ID NO: 76107 - DNA, 2147 bp, Homo sapiens
  misc_feature (2090)..(2090): n is a, c, g, or t
aacctgtttgtggcctggtcggcgtcccgtagggcgccctcccgcgctaggccggccggcgtggcgctcggcgccgaacaggccccgaggaggccgcagttaggcctagtgattatccagttgccctgagcggctgcggaggtgcgctccataagcgggcagggtgggaaaagttcgcccgtttgtccggaaggcagttgatggacctggggtcgacaccactgcggacgcagggcacggcacgggggcgagaaggcgaaggctgcaggcgtgagtggatgatgctggcaaaatagaacatgatggttccactggagtgaccatcgatgcagaatcagaaatggatccttgtaaagtggatagcacttgtcctgaagtcatcaaggtgtacatttttaaagctgaccctggagaagatgacttaggtggaactgtagacattgtggagagtgaacctgaaaatgatcatggagttgaactacttgatcagaacagcagtattcgtgttcccagggaaaagatggtttatatgactgtcaatgactctcaacaagaagatgaagatttaagtaataattctgatggaattgaaaaccggaatggcactgcaagtgccctcttgcacatagatgagtctgctggccttggcagactggctaaacagaaaccaaagaaaaagagaagacctgattccaggcagtaccaaacagcaataattattggccctgatggtcatcctttgactgtctatccttgcatgatttgtgggaagaagtttaagtcgaggggttttttgaaaagacacatgaaaaaccatcctgaacaccttgccaagaagaagtaccactgtactgactgtgattacactaccaataagaagataagtttacataaccacctggagagccacaagctgaccagcaaggcagagaaggccattgaatgtgatgagtgtgggaagcatttttctcatgcaggggctttgtttactcacaaaatggtgcataaggaaaaaggggccaacaaaatgcacaagtgtaaattctgtgaatatgagacagctgaacaggggttattgaatcgccacctcttggcagtccacagcaagaactttcctcatatttgtgtggagtgtggtaaaggtttccgacacccgtcggaactgagaaagcacatgcgaatccataccggcgagaagccataccaatgccagtactgtgaatataggtctgcagactcttctaacttgaaaacacatataaaaacaaagcatagtaaagagatgccattcaagtgtgacatttgtcttctgactttctcagataccaaagaagtgcagcaacatactcttgtccaccaagaaagcaaaacacatcagtgtttgcattgcgaccacaagagttcaaactcaagtgatttgaaacgacatgtaatttcagttcatacgaaagactatcctcataagtgtgagatgtgcgagaaaggctttcacaggccttcagaacttaagaaacatgtggctgtccacaaaggtaaaaaaatgcaccaatgtagacattgtgactttaagattgcagacccatttgttctaagtcgccatattctctcagttcacacaaaggatcttccatttaggtgtaagagatgtagaaagggatttaggcaacaaaatgagcttaaaaagcatatgaagacacacagtggcaggaaagtatatcagtgtgagtactgtgagtatagcactacagatgcctcaggctttaaacggcacgttatttccattcatacaaaagactatcctcatcggtgtgagtactgcaagaaaggcttccgaagaccttcagaaaagaaccagcacataatgagacaccataaagaagttggtctgccctaacagtgtgtctacaagcttgtaaagatgttggccttgaagcagaaaattcattttttaaagccagtcttgttcacatccattactatacattgaattatgctgtgtaaaaatagaattattgcttctagtccacttttctttacattttattcaatacgctgtcctgaatcctattcagtttctttaatagatgagnaaaaatagcaacaagcaagttgcttataataaaataatttgtgattctcccgaattc

SEQ ID NO: 76108 - DNA, 455 bp, Homo sapiens
gcctagtgcgcgcgcagtaacctgtttgtggcctggtcggcgtcccgtagggcgccctcccgcgctaggccggccggcgtggcgctcggcgccgaacaggccccgaggaggccgcagttaggcctagtgattatccagttgccctgagcggctgcggaggtgcgctccataagcgggcagggtgggaaaagttcgcccgtttgtccggaaggcagttgatggacctggggtcgacaccactgcggacgcagggcacggcacgggggcgagaaggcgaaggctgcaggcgtgaggtgaaggccggaggcctgctgggcctattttcgctatgtaaatgtccgcgaaggggaggagggacgggggggcaagatggcggctgctaggcgcctgctgctggggagtattgagagtgttgtcgggaggcggagccgccatcttgaaggcggtatctggaa

SEQ ID NO: 76109 - DNA, 203 bp, Homo sapiens
aatcatctttattttgagaaactatgaggctcattgcagagatcactatttcttacttttattatctgtgtgcaacatactatgaagcccagaactagaccagtgccagaaaatatttgaaataaattatgtaggggcagtgttgaattaagaattaagagtttaacatataatatttatttataaaatcaatttctctaaaa

SEQ ID NO: 76110 - DNA, 372 bp, Homo sapiens
aggaagaggccaatggctgccccagaattcccagcaggatttgttcctcttggatcagtgaaaaggaaaatggaaatataaaaataataactgggccccaggaaagaacttggagatgggggtggcatctcctgcctggctccggctggctgggcgagtggcaggccatttcctccatgaagcctgccctgaccacaccagccctgagttacatgcctcagcctcagaaccgccgggggcctgggctgggaaagtgcccatcctcctctcaagtccgcggcactcgccatccaccaagatgggctgctgcttttacctgcatagcaactttcttctcctggtaacagcatcttgaaatccctttgagaaacc

SEQ ID NO: 76111 - DNA, 453 bp, Homo sapiens
ctaattctgcagttatttggaagagtgaagggtcagaaataacaaaaaccctcctgaggaagaaccaaagtagtagagatgggctgtcttgccttagagacattaaggtctgttataaagctataataacgaagacagcctggtattagggtgccagtgtagttacagacaaagagaccaatggaacaggataaaaagcccataaataatctcatgcatatatgcacacttgacttacaatggaaggagtattgcagatcagtggggagagactgaactaatcaataaatcatgcagttacaagatcatacatgtggagaaacaaaatgaaaccagatcctgaagtacacaaaaaatcggttccaggtatattgaatatttgtatttttaaatcaccaacagaaaggttttaaaggaaaggaaaacagtagaactttcaaagaactaaaaaaa

SEQ ID NO: 76112 - DNA, 414 bp, Homo sapiens
ggctggctctttgcttgacagtggttgcggtaaggtcatttcaaagagcatccttcttagtatgtttaaatagctatagaaaagccgctgcaccctcacctcttcagagacccagccagcgataatggcgcgctcactctgatctcgggggagttaggagagggttgggcgtgcttagcaggtttgtgatgtaaacagtgcccatccctgagctgagcaggacctacattttgggcttcggtttctctaaaattctcttaaattggacattattacatgtcaaatgtagttaatcttggtcagtacagtcttggatgggggttgtttggcccctgcagaagggcctgtgttgaagctggactctgtcacgtgacttggaaacatggctgtgagcaggaaaacagctcctagttg

SEQ ID NO: 76113 - DNA, 303 bp, Homo sapiens
gtctggaactcctggcctcaagtgatccgtctgtctcagcctcccaaaagtgctgggatacaggagtgagccaccgtgcccggcctggccttgttgcttttagtattgaaaactctaggatgctccatcttgtctgtggttgtactggctcccgagaagacctttagccactggcctggctgagttgccaaagttgggggagggggcagtgcacagacccagtttctgacactcaaagcaggggctataaattctgtacactcccatgtccacagctctgcaccactgactggggcgtgtggg

SEQ ID NO: 76114 - DNA, 588 bp, Homo sapiens
agtccatgtcagctcccatcctgggagtgcactgagacaggtggtgggaatgggaggaggaaaggagggagatgccaggaagctgggatcaggagccgtttgccaaagcaaggcctgtgaggtgttgattcgggaacaagtgaaagtgtttgtgaaggttttgagctgggaaaagttggaatcagattttgtacttgctgttatccccaagggtaaacaataagcaaacgaaaaaatcagggcgaagctaaagctctagttagggcatctctctgccttgaaaatgacctcaagaaatctaggaacctctgtggaatgcaacttgaagatggaaaggtgcctttgtctgaaggtccctccccttttatgcctgctgccggtgtgagggttggggattgggccctgggactcagtcactcagtcttcttggagagataaacttttagctgaagtgattgattttcccctattttaatatactattttaactaatatgagttacttatgatttttaacagtctgttttaaatatctttcttgtatattcctcacattatatctttttactatctgctttaaaaaaagtta

SEQ ID NO: 76115 - DNA, 446 bp, Homo sapiens
ttgcacacaacctatatatccaaaaataggggcttgacgaatacattgtcatttatccacacaatgaaatgctatacagcattaaaaaatcatgcagaactgtggtttcaaattatttctagtaaaggacacctccactttttcataatcagtctttctagaatcccagtgtacagaactgtttagaagtagagctctcccactttgggaggctgaggcaggcggatcacttgaggttgggagttccggaccagcctggccaacatggtgaaacccggtctctactaaaaatgcaaaaacaagctgggtgtggtggcaggcacctgtggtcccgctgctctggaggctgaggcataagagtagcttgaacccaagaggcggaggttgcagagagcagggattgcagcactgcactacagcctggtgacagagcaagactgtgtctc

SEQ ID NO: 76116 - DNA, 564 bp, Homo sapiens
gtccgcaaagatcagatagttgtagatacgcggcgttatttctgagggttctgttctgttccattgatctatatctctgttttggtaccagtgccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattctgtgaagaaagtcgttggtagcttgatggggatggcattgaatctataaattaccttgggcagtatggccattttcacgattaaatatcatatattttatttaaagtcccttatatgttgagatatatttctgagctttctgttatgttattattttctaatagtcttttttatgccaataatacattgtttttgattagtgtggctttatactacattttagtatctgtaaggccaatatcttctcatgattcttgtattttgtaatttttatgatatctctgatatataccttcataggaacattgaatcattacattt

SEQ ID NO: 76117 - DNA, 1225 bp, Homo sapiens
ggcagatcttttgggcatcaatggaacaggggaagagcgactaccacaagacctgaaggtgtccactgacaaggagggtggcgtccaggacctgctcctgcctgaagacatgctctcaggggaagaatatgagtgtgtctcacctgatgacatctccttgcctcctctcccaggaagccctgagtcccctcttgcaccatctgacatggaggtggaagagcctgtcagctcctccctcagccttcacataagcagctatggggtgcaggctgggaccagcagcccaggggatgcccaggaatctgttcttccaccacctgttgcctttgcggatgcatgcaatgataagagagaaacattttcaagtcattttgagaggccttacctccagttcaaagctgagcccccactaacctccagaggattcgtggaaaagagtactgccttacacagaatcagtgctgaacatccagagagcatgatgagtgaagtgcatgagagagctttacagcagcaccctcaggctcagggtggtttgctagaaacacgggagaaaatgcatgctgataataacttcactaaaacccaagataggctgcatgcttcctctgatgcattctcgggcctcaggtttcaatcaggcaccagcaggggctatcagaggcaaatggttcctcgagaagagattaaaagcacatcagcaaagagcagcgtggtcagcctagctgaccaggcacctaatttctccaggctcctgtctaatgtaactgtcatggaaggttctccagtgactttggaagttgaagtaacaggatttccagagcctacactgacatggtgggtagcctataatgacaagccataaatggaaacaaattcaatcacagagaaaaatcattctgtgagcactaactgaaaggtttagggctagctgattaatattctatgacactgcaactctgcatgattcaatctcacatcagacccctctcattttagtagcagcatagttaatacctttaagaaaaataaaaggtaaccatataaagtactaataatttaacaaatttccaaagcactgtaggttggttgtgcttgttttcttctgtgtttaacattccacatttctaaagattgtgggttgaaattattttttattgtctatttccatataagcatggcatctgcttgctttaactacctttatgcaattgaaaatataaga

SEQ ID NO: 76118 - DNA, 791 bp, Homo sapiens
agcggcaaagtcactcaagcaatacttcttataatcaaggcaagtggtcagcggctgccttaaaaaaaaaaaaaaaaagcctggaaatacagtccccagccagagtaaagatcctcctctgcgacctcacagcccagctggattgggaccctgcagcgctctcacctctctgctcaggaaaatgtggctgctgcgcgtctcagcccagccgaatttgatcttgtggatttcatgtctaatctcagcctagattactcgggcttgtttggcccgctctagcatgcctggtctctctattctctcttgattctctcccatccttattcatccctcactcattgattgatttaattcaacaaccaagccccctgctgtgctggatgtcagatgttctaggtgtgctcaaatgaaggcccttttcattttccggaggagttcacttcccatgttgggagacagtaacaggaacaaatcaggctgcctaggtgttcacgatgtcaccaatattgggaagttacattttgtaatattttaataaaaatagcttttctgagcccaaccccctcccaccgcctactgatctttggctcttagtttctgcgccttccaaattccctcctccatagctcacctggccttgaggcttttacaaactgctctggcctgcatcctggatctcactctagaaaccactctgctggggtcattccggcagagcacccagcttcccctctctctgtggcagaaaaacctgattctctcccactttgtcatgaaaagtcccttccctg

SEQ ID NO: 76119 - DNA, 657 bp, Homo sapiens
agaaggatgacaattacaactgatcaatattttcctagaaataaagtagcaaacagatgtctcttgaaaggctttaacaattattttttgctgtgaccaataaagtctgaagacatgtacagaagttaagcaaaggtaggaagcatctctaaactaattcatcacactctactaaacaaaattggaaattgggccaaaggatacagttcaggaatatgcacatgatttcttctaagccagagttctgaccaggagaaatgacttcaacgtgagaaaaggtagaaagaagaaggaaaacaagtgttaattcttaattaaatacagactaataaagtccacatcaccaagaaccctgtgaggctgcagcatcacattgaaccacactgacctcgtgtaaaacatgaaaatgccaaggataaaggaatgatatagtgaagtggtgatatcctaattgaaataatgtgaagcccaagtttatcatttcttttatttaattctgtattcttgacccattgtttgctgtctgggctgaatagcaccaattctattcaaagaagaagaatgtacatgaaagaacaaacatgaatattatgcataacaagaggatgaacatgcagaagaaaaatgaggattaaggtgaaaagaagtggaaaaatg

SEQ ID NO: 76120 - DNA, 825 bp, Homo sapiens
tgttgctaaggaaacagcctcactcagcaagggtcacctttggaaacaacggcaagacttcaaagcagatcaatagagaaataccaagacctgaacttcctagcaaatgctctcttctattttaaaccctacccctcaaagaatggcaatcctcccagatgtctcctcatctctattgcgtatttctgcaacacctatgattaagttgcttgatgaccattagaggccacagcaccaatcaggagagcagcttacaggcatgaagtccgcgggcacttcccaccaacattggaaagcaacacattcatgggatcaggattcattctgctgttgttttaaatctaaattttaagtacctctctattttcacacagaagaactcatattaaacatattgatctctaacttgatttgttctcaaataatttgaagaccttttggtgtactcaagtcacaaaggatatttggtggtggaccgtggacaatccagaccaaacctccagagggaaggcaaccaaggttgtgctggagaggccagaagcagcaaatcattaagtcatttccatgatggactatactcactctgtcttttgcctctggttgtgcctgttctactttgtaaattccaaagagagaatttttatctaggttgggccatatgtctctgcactagatcagtcaaccatggccgaagagactggtagaagtgaccattggaagcatcattatgagctctccagccactccagcttgtgctctgcaattacactggttttaccctcatttccttgagccagtttctaaataaaagcaacttaccacaac

SEQ ID NO: 76121 - DNA, 550 bp, Homo sapiens
ccccgggctgcaggaattcggcacgccgggtaggagctaggtgaccctcggctgctgcagggatctgcagcgactgcagccatgggggcccacctggtccggcgctacctgggcgatgcctcggtggagcccgaccccctgcagatgccaaccttcccgccagactacggcttccccgaacgcaaggagcgcgagatggtggccacacagcaggagatgatggacgcgcagctgaggctccagctgcgggactactgcgcccaccacctcatccggctgctcaagtgcaagcgtgacagcttccccaacttcctggcctgcaagcaggagcggcacgactgggactactgcgagcaccgcgactatgtgatgcgcatgaaggagtttgagcgggagcggaggctgctccagcggaagaagcggcgggagaagaaggcggcagagttggccaaaggccagggacccggggaagtggaccccaaggtggccctgtagggggtgcaccccccaccctatggaccagtcaaataaaagccttcaggcccctcaa

SEQ ID NO: 76122 - DNA, 554 bp, Homo sapiens
  misc_feature (15)..(15): n is a, c, g, or t
aggctgtaccggtcncgagtcgtttggatccgggtaggagctaggtgaccctcggctgctgcagggatctgcagcgactgcagccatgggggcccacctggtccggcgctacctgggcgatgcctcggtggagcccgaccccctgcagatgccaaccttcccgccagactacggcttccccgaacgcaaggagcgcgagatggtggccacacagcaggagatgatggacgcgcagctgaggctccagctgcgggactactgcgcccaccacctcatccggctgctcaagtgcaagcgtgacagcttccccaacttcctggcctgcaagcaggagcggcacgactgggactactgcgagcaccgcgactatgtgatgcgcatgaaggagtttgagcgggagcggaggctgctccagcggaagaagcggcgggagaagaaggcggcagagttggccaaaggccagggacccggggaagtggaccccaaggtggccctgtagggggtgcaccccccaccctatggaccagtcaaataaaagccttcaggcccctcaa

SEQ ID NO: 76123 - DNA, 636 bp, Homo sapiens
ccccagccttccacacccctggcccacccaagccccccacatgcccagcccgcccaagcccccctcccacccccgccaacacccacagcctgcaccccacccaggcctggcccctggcaggatgtggctccagaggccagggacctgaactgccactgaggtttctagccgggccccaccttagtcccagagagggctctctaggggcctgtttgatggggacagggcaggtggctgaagccacctaggggagtggccaagcccaggttccagtgggaagccctgccacctgcgtgggcagaccccagacccaagccacaggcactcggacatgtcttcttcagaggcctcccccacagtgctctgggacggcccctccgcttcccagggcttggggggcgtgtcctggccagggaccctgacagcccctctcgtgcttttcccccagctatgtgatgcgcatgaaggagtttgagcgggagcggaggctgctccagcggaagaagcggcgggagaagaaggcggcagagttggccaaaggccagggacccggggaagtggaccccaaggtggccctgtagggggtgcaccccccaccctatggaccagtcaaataaaagccttcaggcccctcaa

SEQ ID NO: 76124 - DNA, 721 bp, Homo sapiens
  misc_feature (630)..(630): n is a, c, g, or t
  misc_feature (634)..(635): n is a, c, g, or t
  misc_feature (637)..(637): n is a, c, g, or t
  misc_feature (639)..(640): n is a, c, g, or t
  misc_feature (653)..(653): n is a, c, g, or t
  misc_feature (659)..(659): n is a, c, g, or t
  misc_feature (670)..(670): n is a, c, g, or t
  misc_feature (685)..(685): n is a, c, g, or t
ccccgggctgcaggaattcggcacgccgggtaggagctaggtgaccctcggctgctgcagggatctgcagcgactgcagccatgggggcccacctggtccggcgctacctgggcgatgcctcggtggagcccgaccccctgcagatgccaaccttcccgccagactacggcttccccgaacgcaaggagcgcgagatggtggccacacagcaggagatgatggacgcgcagctgaggctccagctgcgggactactgcgcccaccacctcatccggctgctcaagtgcaagcgtgacagcttccccaacttcctggcctgcaagcaggagcggcacgactgggactactgcgagcaccgcgactatgtgatgcgcatgaaggagtttgagcgggagcggaggctgctccagcggaagaagcggcgggagaagaaggcggcagagttggccaaaggccagggacccggggaagtggaccccaaggtggccctgtagggggtgcaccccccaccctatggaccagtcaaataaaagccttcaggcccctcaaaaaaaaaaaaaaaaaaacaaaaaaaaaaaacccgggggccctaggggggggggggaaaaaggggtaggaatgggccgggncaanngngnnccggacccggttnctggcncagggggaaancggggggcccccaanggggagcgaaaattcaaaagcgggtaacggttagga

SEQ ID NO: 76125 - DNA, 1136 bp, Homo sapiens
ccccgggctgcaggaattcggcacgccgggtaggagctaggtgaccctcggctgctgcagggatctgcagcgactgcagccatgggggcccacctggtccggcgctacctgggcgatgcctcggtggagcccgaccccctgcagatgccaaccttcccgccagactacggcttccccgaacgcaaggagcgcgagatggtggccacacagcaggagatgatggacgcgcagctgaggctccagctgcgggactactgcgcccaccacctcatccggctgctcaagtgcaagcgtgacagcttccccaacttcctggcctgcaagcaggagcggcacgactgggactactgcgagcaccgcgactatgtgatgcgcatgaaggagtttgagcgggagcggaggctgctccagcggaagaagcggcgggagaagaaggcggcagagttggccaaaggccagggacccggggaagtggaccccaaggtggccctgtagggggtgcaccccccaccctatggaccagtcaaataaaagccttcaggcccctcaaaaaaaaaaaaaaaaaaacaaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaataaaaaaaaaaaaaaaattcaaagaaaacaaaaaacagaaaaagaaaaaccggtctagcctaattgtcgaataataaaaaaaactactgccctttttatacccaacgattatattataaaaaaagggaatacacccaattaaaggggctgataaaaaatcacgctgggcttagaaaaaggtgatgccaatgaaaaatgccgggattacaccttaaaacagttttggaaaacacaaagttatttcggaaattgcaagaattcaaaaaaggccataatcggggatattgaaaatgaaatcacgcctgtttgtacccttaggccgaaaagggaattttccttaaaaataacggtattaatcgggaaaagcaggttgttttttaaaaagtggcaggaatccgtaaaaaccgtttaaaaaaaaaaaatttaacgggcaaaccgggtttaacacaatggtccgggggcacttttg

SEQ ID NO: 76126 - DNA, 722 bp, Homo sapiens
ccccgggctgcaggaattcggcacgccgggtaggagctaggtgaccctcggctgctgcagggatctgcagcgactgcagccatgggggcccacctggtccggcgctacctgggcgatgcctcggtggagcccgaccccctgcagatgccaaccttcccgccagactacggcttccccgaacgcaaggagcgcgagatggtggccacacagcaggagatgatggacgcgcagctgaggctccagctgcgggactactgcgcccaccacctcatccggctgctcaagtgcaagcgtgacagcttccccaacttcctggcctgcaagcaggagcggcacgactgggactactgcgagcaccgcgactatgtgatgcgcatgaaggagtttgagcgggagcggaggctgctccagcggaagaagcggcgggagaagaaggcggcagagttggccaaaggccagggacccggggaagtggaccccaaggtggccctgtagggggtgcaccccccaccctatggaccagtcaaataaaagccttcaggcccctcaaaaaaaaaaaaaacaaccaaaatcacaaacaactaaatacacacacagcaaacaacaaaaaacaaccccgcgcgacctattgggcggccatcacagacgagtctacgagcgcacgttaccatgtgttctcccccccttttgcaccgcgtgtaatcgcggccccaaggggcaaa

SEQ ID NO: 76127 - DNA, 1111 bp, Homo sapiens
  misc_feature (585)..(585): n is a, c, g, or t
  misc_feature (603)..(604): n is a, c, g, or t
ccccgggctgcaggaattcggcacgccgggtaggagctaggtgaccctcggctgctgcagggatctgcagcgactgcagccatgggggcccacctggtccggcgctacctgggcgatgcctcggtggagcccgaccccctgcagatgccaaccttcccgccagactacggcttccccgaacgcaaggagcgcgagatggtggccacacagcaggagatgatggacgcgcagctgaggctccagctgcgggactactgcgcccaccacctcatccggctgctcaagtgcaagcgtgacagcttccccaacttcctggcctgcaagcaggagcggcacgactgggactactgcgagcaccgcgactatgtgatgcgcatgaaggagtttgagcgggagcggaggctgctccagcggaagaagcggcgggagaagaaggcggcagagttggccaaaggccagggacccggggaagtggaccccaaggtggccctgtagggggtgcaccccccaccctatggaccagtcaaataaaagccttcaggcccctcaaaaaaaaaaaaaaaaaaaaaaaaaagaaacactggntgcgggccgcgccccggnnccctcagagaaagcgcttctcatagagaccacattcgcggttggggcgcgcggcgggcgcccaaaggggtgaaaggaggacacatgggcgccaaacaggcggtgtgccctaaagggagaaccccgggcgccaagagagactaaggggggcggggggttctctccacaccaaaataaaaacaccgccgcgggaggcgaacaccaggaacgcgttctcgcgagacaaaactccccgagagagggagagtgtccgagaggggcgccaattaacgggggggatctctatatactaaacaggggggaggcccaaaagcggagagccccccgaagatatatatacaaatattttgagcgcgcccccgggggtcggcggggtggatgcccatacgaaaaaacagcacagcagcaccccccaacaccaacattcgtgcatcacgacaaaaaagcagcaaaaaacacatctcaatacgaagacacaacaccagctcaaaccggcgaaagacatatg

SEQ ID NO: 76128 - DNA, 722 bp, Homo sapiens
ccccgggctgcaggaattcggcacgccgggtaggagctaggtgaccctcggctgctgcagggatctgcagcgactgcagccatgggggcccacctggtccggcgctacctgggcgatgcctcggtggagcccgaccccctgcagatgccaaccttcccgccagactacggcttccccgaacgcaaggagcgcgagatggtggccacacagcaggagatgatggacgcgcagctgaggctccagctgcgggactactgcgcccaccacctcatccggctgctcaagtgcaagcgtgacagcttccccaacttcctggcctgcaagcaggagcggcacgactgggactactgcgagcaccgcgactatgtgatgcgcatgaaggagtttgagcgggagcggaggctgctccagcggaagaagcggcgggagaagaaggcggcagagttggccaaaggccagggacccggggaagtggaccccaaggtggccctgtagggggtgcaccccccaccctatggaccagtcaaataaaagccttcaggcccctcaagaataaaataaatgatgactcgctagaaagacatccgcggcactttactggggggcggaagcagggtattgaaaaggccgcttggccaacttttttttgctggcctttttttttgcacagagcgtgaacacgggcggccccataaggggcgcgtgaatggaaccccgttacc

SEQ ID NO: 76129 - DNA, 1131 bp, Homo sapiens
ccccgggctgcaggaattcggcacgccgggtaggagctaggtgaccctcggctgctgcagggatctgcagcgactgcagccatgggggcccacctggtccggcgctacctgggcgatgcctcggtggagcccgaccccctgcagatgccaaccttcccgccagactacggcttccccgaacgcaaggagcgcgagatggtggccacacagcaggagatgatggacgcgcagctgaggctccagctgcgggactactgcgcccaccacctcatccggctgctcaagtgcaagcgtgacagcttccccaacttcctggcctgcaagcaggagcggcacgactgggactactgcgagcaccgcgactatgtgatgcgcatgaaggagtttgagcgggagcggaggctgctccagcggaagaagcggcgggagaagaaggcggcagagttggccaaaggccagggacccggggaagtggaccccaaggtggccctgtagggggtgcaccccccaccctatggaccagtcaaataaaagccttcaggcccctcaaaaaaaaaaaaaaaaaaaaaaaaaaatgtgtgtgtgggcgcgcgctttggggccctccggaaagacttttttaaaacccttgcgttggggcccgggggcccagaggggtaggtgtgaagtgggtcaaataggtgttaccatggaggaaaaccggggacgagaggacaaagtggccggggaatctgcccaccaaatataaaaaacgcccgcgggaaaaaccgaagggttgcgtgaaaacagatcccaaaggggatgaccagaaggccactggacgcggaatgctataacgaaaggaagtgctcaaaggagaactcgcaaaattccaaaattaaggcccggccccggggaaaggaagaacgcaaaagaagaaggaaaaaaaagaaagaaaaggaagggcaaagcaaagagggggaagaagaagaggaaggaaggggggggggaggggcgagagagaaagggacgaagcggaagcagggggaagaggcagggggggagagagaggcaaagcggacggagaggaggagaggggagaggagggaggaagggagaacggagggaacgcggagagggagggcgaaagga

SEQ ID NO: 76130 - DNA, 501 bp, Homo sapiens
ccccgggctgcaggaattcggcacgccgggtaggagctaggtgaccctcggctgctgcagggatctgcagcgactgcagccatgggggcccacctggtccggcgctacctgggcgatgcctcggtggagcccgaccccctgcagatgccaaccttcccgccagactacggcttccccgaacgcaaggagcgcgagatggtggccacacagcaggagatgatggacgcgcagctgaggctccagctgcgggactactgcgcccaccacctcatccggctgctcaagtgcaagcgtgacagcttccccaacttcctggcctgcaagcaggagcggcacgactgggactactgcgagcaccgcgactatgtgatgctcatgaaggagtttgagcgggagcgtgttcttctccaaaaaagaagcggaagaagaagaaggcttttaaattgccaaaggcacggaccgggggacccgaaccccaggctggcgtgggggggccccccc

SEQ ID NO: 76131 - DNA, 516 bp, Homo sapiens
ccccgggctgcaggaattcggcacgccgggtaggagctaggtgaccctcggctgctgcagggatctgcagcgactgcagccatgggggcccacctggtccggcgctacctgggcgatgcctcggtggagcccgaccccctgcagatgccaaccttcccgccagactacggcttccccgaacgcaaggagcgcgagatggtggccacacagcaggagatgatggacgcgcagctgaggctccagtgctcaagtgcaagcgtgacagcttccccaacttcctggcctgcaagcaggagcggcacgactgggactactgcgagcaccgcgactatgtgatgcgcatgaaggagtttgagcgggagcggaggctgctccagcggaagaagcggcgggagaagaaggcggcagagttggccaaaggccagggacccggggaagtggaccccaaggtggccctgtagggggtgcaccccccaccctatggaccagtcaaataaaagccttcaggcccctcaa

SEQ ID NO: 76132 - DNA, 791 bp, Homo sapiens
  misc_feature (265)..(265): n is a, c, g, or t
  misc_feature (283)..(284): n is a, c, g, or t
gcggccgcctactactactactgctcgaattcaagcttctaactatgtgatgcgcatgaaggagtttgagcgggagcggaggctgctccagcggaagaagcggcgggagaagaaggcggcagagttggccaaaggccagggacccggggaagtggaccccaaggtggccctgtagggggtgcaccccccaccctatggaccagtcaaataaaagccttcaggcccctcaaaaaaaaaaaaaaaaaaaaaaaaaagaaacactggntgcgggccgcgccccggnnccctcagagaaagcgcttctcatagagaccacattcgcggttggggcgcgcggcgggcgcccaaaggggtgaaaggaggacacatgggcgccaaacaggcggtgtgccctaaagggagaaccccgggcgccaagagagactaaggggggcggggggttctctccacaccaaaataaaaacaccgccgcgggaggcgaacaccaggaacgcgttctcgcgagacaaaactccccgagagagggagagtgtccgagaggggcgccaattaacgggggggatctctatatactaaacaggggggaggcccaaaagcggagagccccccgaagatatatatacaaatattttgagcgcgcccccgggggtcggcggggtggatgcccatacgaaaaaacagcacagcagcaccccccaacaccaacattcgtgcatcacgacaaaaaagcagcaaaaaacacatctcaatacgaagacacaacaccagctcaaaccggcgaaagacatatg

SEQ ID NO: 76133 - DNA, 2904 bp, Homo sapiens
ccaagacttagcttaaacatcaggaaacaaactaaagccacaatccaaatgagagaaacactgtctcgtctaaactctagtttcatggtcagtgcaacagtgagttttcttttaataatggtatggtattgtcaagggaggcaaagtgttcatggtaacttggagctccccaatacatggccatgtcttctaaagacaacgtaatgagcccaagtgaactgaaggtcatactggcaggtgctgatgacagtttgtccttgaatgctgacatgtcttgaatattgcaaatgtcataatactcttttaaaacagtcctctacctgactctagttttgcgaggattagtttgtttccttggtagatttcaacatttcagaatgttacctccaaatttcacttgaattacttcctcctgtgaccttagcagatctgtcacatttgaaagcatatgactcacttccacccccttctaatgaaaaactgcatggtgttaaaagcactctcattagaaatataaggctgagaactgaagaaggctgtttaaagcaggaatttcactttattttactatgcctaaaaatacatctttggaccccttgcaaagtgctttaaaagtactttcaatttatgcatgactccaaaaaagtaatttttttttcccaaaaaaacctctttatttaaataattgggatatttgctaaatacctatttttttttacagtggcctaaaacccctattaatgaaaagtgaaatttgatttaattaggactcttgcagtcatcttcacgactgaggagaagtttcaataggctgtctagacattatgatgttaataggagattaaaatacatttggcaattcattttcattcttaatttgagtgcatgaaccactgcagatgagctgataagcagaaattctcaagtgggtttcactaataaatgtttttttatatgatttgaaatcaagtaaagggacaatgtttatgtacgtgtataacaacattcagcacatttgaggaatcacacactataataaagcttaaacctgtcatagaaccttgatctatattactttgtcttcagtaaaaagtgaaggatgagattttgtctttcatgttattgtagctggcatgcttcaaaattttgagcttactgggactgacagcctctcacttcaatctgagggattgacagaatttaaacaggctcattgattctgtacactctacccttcctgtggcaagtgataatgggatttcattaatgaatcaatttgttttacaaatgacatccactgtggcattggaagacagttgggtctgactcaagtttaacatttcttaccaaacattcttaagtatgaaattggtcctttaatccaaatgctcttggtcatggctgtcctttgcggattacatagcattcaggaaagtacaaaaactaaacactaaatccccaactggccccaaagaccttttatgatgtgagagacaagagttcaccccagattaatttcttttatcattggctttatactctaacatatagatactctctatagcaaaaaagggatgaatggctttcaatattcatttctgtttattcttgtgagggaaaataatatatcaagaaaattttcttccacttagaaagctttaaagctgaagtagaggtgcagtcaagcttggatctgcaggaagaaccactaggccactgagtcatacttgagcttttcttactactgccccaatttctaaattgttttttcttttcagcgtgtagggcttgggctctgtttccttttattagcatgtcacctgagggtggaacaaacaattggaaataaaatttgattattttatttcttataaagtattaatttcttaagggggtttgaaatcattggtaaaattaatatcagtacattatatgtcataaattttgattatctataatgtcttttcttatctaccacaaataattgagagttggctaaattcttgcagaatatatgggaaaaaaatcatagcaaagaattcagcttccctcaaaagaaagctatttttgtttccttcactccactaaatttgaaccagtagcacggatcaacacgacttctgcaatgagagtataacggtagctcttggtacagtcatattcatatttttaaatctttctttgaccaaaactattgcattgttttcattacattttgactgcgttacttattaaggccgaatgactttgacacccccgtggattatttttatgatcacatcaaatttaaacaatgtccaaagtgtaactttaatgttatattttgtttcaaaccctctggtctaagattattgagaaagatgttttttcctcctccctcaaatatgttatctcttcatatataaaaaaataagttattccatgcttttcaggaactgtaaaaattatttcaaaaagatatttgaaaaagttttctctattctggacacaaatgcttccatttatttcaaaagaagaagaagaaaaatggaatcttaatttaaaaaaatatatgtagtagtatctgctatgagatattcagtctctataaaaaaaaaaagggacacagcttcttttaaaacccttgtttcagtccatattcaacttcatggaacttctgaaacatcattcaattttgaactttatttaagagcatttttgtactgctgtctctgactgtcatggaaagttctgtaattctaaggtgtttctggttttatttttaatttcttcatctgtaccacagtcaaattagcaaccatctcccccatcccttgggctttctgtagatcagtggatgttaggtttaaacttctgttttctttgatgaagctttcaataaaaaatgaaaataaaatcaattga

SEQ ID NO: 76134 - DNA, 770 bp, Homo sapiens
agatactctctatagcaaaaaagggatgaatggctttcaatattcatttctgtttattcttgtgagggaaaataatatatcaagaaaattttcttccacttagaaagctttaaagctgaagtagaggtgcagtcaagcttggatctgcaggaagaaccactaggccactgagtcatacttgagcttttcttactactgccccaatttctaaattgtgcataaatacaatcactctcaatttttgaagggctaattatctactttgtgggtgtgttttgttttttcttttcagcgtgtagggcttgggctctgtttccttttattagcatgtcacctgagggtggaacaaacaattggaaataaaatttgattattttatttcttataaagtattaatttcttaagggggtttgaaatcattggtaaaattaatatcagtacattatatgtcataaattttgattatctataatgtcttttcttatctaccacaaataattgagagttggctaaattcttgcagaatatatgggaaaaaaatcatagcaaagaattcagcttccctcaaaagaaagctatttttgtttccttcactccactaaatttgaaccagtagcacggatcaacacgacttctgcaatgagagtataacggtagctcttggtacagtcatattcatatttttaaatctttctttgaccaaaactattgcattgttttcattacattttgactgcgttacttattaaggccgaatgactttgacaccc

SEQ ID NO: 76135 - DNA, 248 bp, Homo sapiens
gcagatatttaaaaattgatctgctcagggtgtcagatgcactaggtacaccactgccctttatcctacttaatttttgtcataatacttgcctgatttattgtatattttcattattttatataacatttaatatatttatatattttattaatatataatgaacaataaaagtttattaatatatgttcatatttcatagtctatattatttaacatttattatatattttatgtgttattcacct

SEQ ID NO: 76136 - DNA, 455 bp, Homo sapiens
aaaccttcttgattaaaatatatagttctaaaactattctgtaggacactgtaatgatggatatatataattatgcatttggcgaaacttacagaatgcataacacaaggattgaatcctaaagtcaactatggactttaataataataatgtatcaatattggctcattaattataacaaatgcatcatactaattcaagatgctagtaatagggaaaattatggatgtgtatgtgtgtgtagtgggtatatgggaacgctctttactctgtgaccaatttttctgttaatctataactgttctaaaaaaattctattaattaaaataaatacactgcctcaaatatatgttttatttatatatcaatttggttcatttgtttgaagaacattttgcaatggtgaaaacaaccattaaggtactatcttacatttaataaatgctgatcaattc

SEQ ID NO: 76137 - DNA, 701 bp, Homo sapiens
aagaatctgagagaccttttaaagtgagacagagaagctgattaccagagaaaaggctaactggaaaattcatagaaatttaaaaccaaccaaaggtaacccaaagaaatgtccttacttttttactctgctctgaaatagaccagtgtttctcaaacttgtctgcgtaggaatcccatagggatcttatttaaaatagcttctgggttagtaagtctggagtaggaccaagagtctggatctctaacaagctcccaggagacaatgatgctgctgttctgcaaatcacactgagtggcaaggaagtagacaaaagaagcagatttgaaaggggtcagtacacaggcaaggggtaagaagggtaagaatgtaatctaatgctgcttcgttcagctaaattggctagagctttagctaaaaaatgaaagaaaaaaagcctacagtttaaacagaaattgtgttttctcccttttgatgccaagctccttgaaaaaatcaagtacttaggtaacgattggtgtggcaatatcagaaaaaggccttattctacaataaaatttgtagaatcaaattttattttgtttttttagagacagagtctcactctgtcacccaggaagcagaggttgcagtaagccaagattgcaccattgcactccagcctgggcaacaagagtgaaattccatctcaaaaaaaaaaa

SEQ ID NO: 76138 - DNA, 1774 bp, Homo sapiens
tttataggaatgtttaacagccattaggtgtttagttctttttatcagaggatattatactattctcagttgtctttacagttttcatgctagcaaaggagttggttactctgctcattttgttggcaactgttttatagtcacatcattgaagtccaaaggaaaatgttttcagcattgtgtgaaatatgattttcaaccacgtaaggcaggtaaaagtaaatatttttgtaactcacttgttacgacagaattcttaactatccttttatgacctctgtagtattctctttcactggctttcctatgcttttaatgattttctcttatcctagtttgcattttctttttacttttatgtctgatttttgtcttctataagatcagtgctttgatctcttgtggtgtatttctcttacattctctcatctcagtctgatctgttctatggcattctttcaatagatacttattatttactgagtattggacaccattgtaggcactagggagttataaatctttgcctcttttttaaaaaagttaaatgttaaacccccagattaagcaatgcacagatacttttcttgtgggagattcacctaatcctggtagttctgaatcttgtttcctaagattggaggttttgttaatttctgatgctttagtaatgctggccttcaaggaatggaatgttgctgtactgttagttttggctcatgaaatgtgtctttacttaatatcccaaataatagcaaaaacaaggtcaaaacacattttaaaaactgctgtaaagagaaaatgcagagaaatgtgcaactgtataattagaattataagagataattcattcataatcaggtggcattttctagagagattttcctgcctgtgtaccggactccatctttgtgtcagagtaacaagccaactgaaagtcgagatgaaagaaaacaaggacagagtgcgtaggagttcccgtcacacacgtttaaggcttttttccccttccaggttcagggttctttcttgggtatatgacaatgagattgtcaatgctttttagggcacactgcctcctcctaacagaaatatcaccttaccctttgtgattaatggtacaatcataatagatatgatgaatccaaatgtggtgagggggaggtctttatatctttttcatatcttttttgttttcttgttgcttatgatctgatgtgtgtcttgtcatatacagaaaaaaaatattttgggtggtattttcaaaaatttgtttagattttgcatgattctaatgaaaatatttgttttatatttaatgtcagtaattgtagtttctattaaagaatatcaatttaacaataattcatcaatatatacttagaaaatagcttaaaaagcagtgacctgaataaatatattcattcattataatggtgtattctttcttttttaatgcaaattgattactttaataccaatcacattgcctttgctctggaaattctgttttattaaaactaagatgagaccaagatagtttgctaaaattgccaaattattttgaatttcagtggaattgattagaagtacagattgttggtattataatttttcatgttaggattgtgtgtttttaacaaatatttaggtaactttctcatcagacagttttaggaaacagtggtttaaagaatatacatgcaaacaattagggtgaagttataaccaaatgaaattgtcattaaccaataaaaagcgctttaacccaaaa

SEQ ID NO: 76139 - DNA, 349 bp, Homo sapiens
atgtgtttggtgttcaacaacttgtagaatatataaatggatgaatgcatattataccattccatgaaccaatgctgctgagaatgcaatggatgtactgcatcattggacactgaggttaacaaacataaggcaaaatagtatagcagaattgcttacccacgatagaaccagaacagagtgaattctattaacttcatatggctgaaacttttaagagttctttagatataactgcaatgaaaactggaaccacactttagttatgtttttggtacacatttatgtttcagttcacggtttaataaaccacataggtcattttatagtgaaggattagtcattctca

SEQ ID NO: 76140 - DNA, 308 bp, Homo sapiens
ctctggagttctatctaaaagggcaaaactatttttaaaataatatgaaactatttgcctttttcactgagttggcatgaggcaaaagcaatggaggataaaattgctccaccaaactgttccagtgcttgtgttgctggattttattcatagtaaaacaaaaaatgtgtttgacttaagaatattcttaatgaggcagtacaaatgattactattattaaatatcgaccttgaatattcttttaatactatatgtgacaaagtgggaaatatatgtatagcacttctgctgcatatgaaatatgatg

SEQ ID NO: 76141 - DNA, 414 bp, Homo sapiens
gggtcttagaaacagaaaatggtcccaatttgtgaacttttccatttgacaagatggaatataggctttccatataggatagaatcacaaaatgaagatatcagcaaaataattccatgcgagaaaatttcagaaaagcagagtcatccgggtgtgttccgtgcccctctttgatccctgaacatggttttggcacaggacaaggaggagtgaggggcgtggatgttctgctccatgtgtgacgactgtgccagcggcgtatactcagtacggctcaggaagagtcccaggaaaagtactgagatgcaaaccctcatgggcttaaatacatccggcctgtctctggtcctcgaacccagcaggctatgggggcagcaggtctgtgtgcaggcccagggacagcctgtgccaggc

SEQ ID NO: 76142 - DNA, 392 bp, Homo sapiens
atgttctgaaaaccaaattcaccatctactgatttttttaatgtgctttccataccctatacctcaaggtaataaataggtgatcaagactttcagacatgaaaagttcccagtaagaaaagtaaatgtcagtgctttcgttttcttatcaagcaacacaatggatatcctaatgcatatttcctggcatataacatgtcagacgattgtaaacattttcttttggtcacacaacatacatccaaactctggatgtttttgtttccctacttaggactaggataactcacctcaaaattaaatataattgcaaccagtctagaacagtttccccaacagacttgatttccaagaaatattaatttttttttctttttgacacagagtctcgc

SEQ ID NO: 76143 - DNA, 453 bp, Homo sapiens
tttcagaaaagaaacaagaatagctgcttgatcataactgtaagcccaaaaatgaaatacaaataagacatatccaagatttagatgttagttattctctctgttttgactgacacttgttagcgagaaggatgggttcaaatacagttgggagggttcaattttccttagactaagttggtgttctttctataatatgaatcaggggactggagagaagctgtattctgtaatcagaaatgacatttgcgaatattaaagtacaaggacattaaatgatactacattccaccaacttgtaagctaaaagccctttcacagagttctctgtccattaaaacatcaacttcttatacatttgggtttcttgacttgttttaagtaacagggctgaatttttgtagggctccgacaatctgcaataatttcaagtttgcatgtgtttatcggttg

SEQ ID NO: 76144 - DNA, 220 bp, Homo sapiens
tagtgcttactttgtctgtcactgtgcttcatcttgtcagggatacagagtggaagacctgatctctgctttcaaagcagcctacattctgtctgaagaaactaggctagtatagccgggcatggtggctcacacctgtaatcccagcactttgggaggccgaggccgacggatcgcttgaggtcaggagtttgagaccagcctggccaacatggcgaaa

SEQ ID NO: 76145 - DNA, 2195 bp, Homo sapiens
tcattgggtgattgatttctatgctccttggtgtggaccttgccagaattttgctccagaatttgagctcttggctaggatgattaaaggaaaagtgaaagctggaaaagtagactgtcaggcttatgctcagacatgccagaaagctgggatcagggcctatccaactgttaagttttatttctacgaaagagcaaagagaaattttcaagaagaggggggggggggggccccccccaaaaacccttcgtgtaggagggtggcagtctccctcccttctggagacaccaccagatgggccagccagaggcagcagcagcctcttcccatggatccaccacgagcgtcccacttgagccctcggaagaagagaccccggcagacgggtgccttgatggcctcctctcctcaagacatcaaatttcaagatttggtcgtcttcattttggagaagaaaatgggaaccacccgcagagcgttcctcatggagctggcccgcaggaaagggttcagggttgaaaatgagctcagtgattctgtcacccacattgtagcagagaacaactcgggttcggatgttctggagtggcttcaagcacagaaagtacaagtcagctcacaaccagagctcctcgatgtctcctggctgatcgaatgcataggagcagggaaaccggtggaaatgacaggaaaacaccagcttgttgtgagaagagactattcagatagcaccaacccaggccccccgaagactccaccaattgctgtacaaaagatctcccagtatgcgtgtcagagaagaaccactttaaacaactgtaaccagatattcacggatgcctttgatatactggctgaaaactgtgagtttagagaaaatgaagactcctgtgtgacatttatgagagcagcttctgtattgaaatctctgccattcacaatcatcagtatgaaggacacagaaggaattccctgcctggggtccaaggtgaagggtatcatagaggagattattgaagatggagaaagttctgaagttaaagctgtgttaaatgatgaacgatatcaatccttcaaactctttacttctgtatttggagtggggctgaagacttctgagaagtggttcaggatgggtttcagaactctgagtaaagtaaggtcggacaaaagcctgaaatttacacgaatgcagaaagcaggatttctgtattatgaagaccttgtcagctgtgtgaccagggcagaagcagaggccgtcagtgtgctggttaaagaggctgtctgggcatttcttccggatgctttcgtcaccatgacaggagggttccggaggggtaagaagatggggcatgatgtagattttttaattaccagcccaggatcaacagaggatgaagagcaacttttacagaaagtgatgaacttatgggaaaagaagggattacttttatattatgaccttgtggagtcaacatttgaaaagctcaggttgcctagcaggaaggttgatgctttggatcattttcaaaagtgctttctgattttcaaattgcctcgtcaaagagtggacagtgaccagtccagctggcaggaaggaaagacctggaaggccatccgtgtggatttagttctgtgcccctacgagcgtcgtgcctttgccctgttgggatggactggctcccggcagtttgagagagacctccggcgctatgccacacatgagcggaagatgattctggataaccatgctttatatgacaagaccaagaggatattcctcaaagcagaaagtgaagaagaaatttttgcgcatctgggattggattatattgaaccgtgggaaagaaatgcctaggaaagtgttgtcaacattttttcctattcttttcaagttaaataaattatgcttcatattagtaaaagatgccataggagagtttggggttatttaggtcttattgaaatgcagattgctactagaaataaataactttggaaacatgggaaggtgccactggtaatgggtaaggttctaataggccatgtttatgactgttgcatagaattcacaatgcatttttcaagagaaatgatgttgtcactggtggctcattcagggaagctcatcaaagcccactttgttcgcagtgtagctgaaatactgtctatctctaataaaaacaggaggaaac

SEQ ID NO: 76146 - DNA, 2576 bp, Homo sapiens
atggcttggccccttattctgtgatcttgaataactgagccttggttctcttgcttataaaatgtacctatgtaagtgaacagtggtaatacccaccatgaaatactatggagcagttagaagcaacagagcaattagaatacggatctggaaaacatagttccaagtgaaataaaaaggtgattggcaaaatgagaaatgtaacaatgccatttatgtaaagtcaaaacaaccacaagcagaatataacacccatgcaaataacagacatccagtacagtgtaatgattgtctacaaaaggaggagaatgcaagtgagttgggaggtttaaaggggatcaataaataaagaccacagaagggcctcagtacatttagaaataaataacatgcaaacaatgatgcttccctaccttcctcacgaggttactctgaggagctaatgagattgtgcgtatgaaaacaaaagttaattgactgtcttcattatgatctccatattggacaaatgaactgaacagagataaaaattccccatcacactttggcaggaagctgttgccagggcagcacctgtgaagccctggcctggcttcagagtctgctggtgagatgacatcaaaacccttcgtgtaggagggtggcagtctccctcccttctggagacaccaccagatgggccagccagaggcagcagcagcctcttcccatggatccaccacgagcgtcccacttgagccctcggaagaagagaccccggcagacgggtgccttgatggcctcctctcctcaagacatcaaatttcaagatttggtcgtcttcattttggagaagaaaatgggaaccacccgcagagcgttcctcatggagctggcccgcaggaaagggttcagggttgaaaatgagctcagtgattctgtcacccacattgtagcagagaacaactcgggttcggatgttctggagtggcttcaagcacagaaagtacaagtcagctcacaaccagagctcctcgatgtctcctggctgatcgaatgcataggagcagggaaaccggtggaaatgacaggaaaacaccagcttgttgtgagaagagactattcagatagcaccaacccaggccccccgaagactccaccaattgctgtacaaaagatctcccagtatgcgtgtcagagaagaaccactttaaacaactgtaaccagatattcacggatgcctttgatatactggctgaaaactgtgagtttagagaaaatgaagactcctgtgtgacatttatgagagcagcttctgtattgaaatctctgccattcacaatcatcagtatgaaggacacagaaggaattccctgcctggggtccaaggtgaagggtatcatagaggagattattgaagatggagaaagttctgaagttaaagctgtgttaaatgatgaacgatatcaatccttcaaactctttacttctgtatttggagtggggctgaagacttctgagaagtggttcaggatgggtttcagaactctgagtaaagtaaggtcggacaaaagcctgaaatttacacgaatgcagaaagcaggatttctgtattatgaagaccttgtcagctgtgtgaccagggcagaagcagaggccgtcagtgtgctggttaaagaggctgtctgggcatttcttccggatgctttcgtcaccatgacaggagggttccggaggggtaagaagatggggcatgatgtagattttttaattaccagcccaggatcaacagaggatgaagagcaacttttacagaaagtgatgaacttatgggaaaagaagggattacttttatattatgaccttgtggagtcaacatttgaaaagctcaggttgcctagcaggaaggttgatgctttggatcattttcaaaagtgctttctgattttcaaattgcctcgtcaaagagtggacagtgaccagtccagctggcaggaaggaaagacctggaaggccatccgtgtggatttagttctgtgcccctacgagcgtcgtgcctttgccctgttgggatggactggctcccggcagtttgagagagacctccggcgctatgccacacatgagcggaagatgattctggataaccatgctttatatgacaagaccaagaggatattcctcaaagcagaaagtgaagaagaaatttttgcgcatctgggattggattatattgaaccgtgggaaagaaatgcctaggaaagtgttgtcaacattttttcctattcttttcaagttaaataaattatgcttcatattagtaaaagatgccataggagagtttggggttatttaggtcttattgaaatgcagattgctactagaaataaataactttggaaacatgggaaggtgccactggtaatgggtaaggttctaataggccatgtttatgactgttgcatagaattcacaatgcatttttcaagagaaatgatgttgtcactggtggctcattcagggaagctcatcaaagcccactttgttcgcagtgtagctgaaatactgtctatctctaataaaaacaggaggaaac

SEQ ID NO: 76147 - DNA, 386 bp, Homo sapiens
tcccattaaaacatttcaattatatttaaaagaatcactgccaataactatactccttttcattccaggaatgcacatttaaagacttggcttatgttaaacatatgtagagagacatttttagcatctagaactgaatttcttacccatactgtctctgctcactctcgagtgattctctaataagaggtaagcattctagggcaagtcaagggatggaagaggcaaaattgttgaaaaaaaattgtcatttctcccaccaccctgctcttatttatctgaattcagatcttgggggcagagtgcccaggttttaacttagtttcactctttttttcatatatatatatatatatatatatgtgtgtgtgtgtgtgtgtgtgtgt

SEQ ID NO: 76148 - DNA, 544 bp, Homo sapiens
ctagcccataaatataagaaattatcagatgtcaattaacaatggaataaaatgaaattaaattttaaaatgaaaacattctagaaaatattcccaagaagagatttatttatttatttttctggctatctatccttaagggttcgggaaaaaatggccggtggagaacaaaagattgaaattttagctcattcatgatgcacgtgaccgggaaggagtgttaagatgtcctgtacttccttccataatcacaggttgaggtgagggttgcctaaagtctgatcagccacattttgacagtggagactcagaggcctagttaggaacacagaaggaaaaatgttaaaggcagacctttataaccaaaacaatcaacaggtctaaaagccaaagaaaccagtatttcagaattgttaacttactcctagatgtgtgttaggcatcgggcttatcttaaagaagtgtcttagaccacagaaacatagacccatgatatttggaccaagcataggttaaaactaggggagggaggcacgaattacaa

SEQ ID NO: 76149 - DNA, 639 bp, Homo sapiens
tatgaaagtttattgtttgctcatatgaagtttaaatgggtatcctgattagtagggaaagggggatttccacgtgcatactcggggatcaggtttcttccattatgtgcagtccgctgcaatcagcttgattgtggttggggaaagggaagagaatatggcccatggggttttcacaggccaagtctaaaagtgtgtggtttttttcctactcacattccattggctagaactcagtcacatgaccacacccaactgcaagggatgatgggaaatgtggtctagttgtgggccaaggaagaagacagacctggggagtggctagccagtctctgctgcatgctcgctgtttcctttatcgtttaattctttaaaactcaatatttgctacctatgccatagctaaaaaaataatgtccctaataataaaagggttattgaaatcagtaattaaaagacgaacattccaacaacaacagaaaagcaacatataggtccctttctgatgaccaataagccattaaaaataaaccttttactctgatagcaatcaatgaattgtaagttaatatgaagtataaaaatattttaaaatataaaaattaaaatcggctagccaatcagcagacttttctgtct

SEQ ID NO: 76150 - DNA, 3915 bp, Homo sapiens
taatacatgccctccttgccaattgttttctctagttcaatttatttttctttctttctttctttcttccttccttctttccttccttccttccttcctttctttttttctttttttttttttcggggtctggctctgtggcccaggctggagtgcagtgccatgatctcggcttactgcagccttacctcccaggctcaattaattctcccacctcagcctcctgagtagctgggattacaggtgtgcgccaccatgcccggctaatttttgtatttttagtagaggcagggtttcaccatgttggccaggctggtcttgaactcctgatctcaggtgatctgccctcctctacctcccaaagtgctgggattataggcgtgagccaccacacctggcccagttctatacttttctgtaaaaagtaaacaagttgcccaaatccttgtctctactttcagctgggaaactggcctgggcagctcaaaccattagatctggagagggagagggtgctgagtctgctcagtgatgtggcagtagtggatcaaaaatatctgtttggaggtcagacaggcctagattcactgctgtgcaattttgagtaagttccttgacttcccttgacttctctgatcctcatttttcttatctgaaaaatgcagcaaatagaatgatagaattattgtgagaacccaaacccagtagagtgctaggacagtgccagtcacatagtatgggctgtggtactagcagatgcagtcattgcctttagtacaaaagatgtacttgggaggtgacgagcatccagcaatggggacgagagccaggtggatgggaacaggataaacagcctctctggatccagtctgtctaccttctcaccctgaccatttctgtgtcactccccatgtgtttcaggtcatagccgcgtacccttttgtggccagaagcagccatgaagtgagcctgcaggcaggccagcctgtgaccatcctggaggcccaggacaagaaggggaaccctgagtggagcctggtggaagtgaatggacagaggggttatgtgccttctggcttcttggccagggctcggagcccagttctgtggggctggagtctgccctcttagggtaccctctttggagcctacattgccaaatgatgggggaggcttagaggctctgaccctggggggaaaagaagcaaaggaaaggtggaggtggaagggaagaccaggccagggtgggtgaagcacactcaggaggcagccagaagacatgggcgggcctcgcagagtgcttggtgtggtgggggcacaggaggctccagccaggactgctcattatgtctgcataaagaactcattccgacctggggtcacaatgcacttggacagcaggtcacagctgattggccaggactctccataggttatggccagtcttagctgtgcctgcatccgggcctgcctgtgggcgtgggtcacacgggataatgttacctgcgtgctgtgtggttgcaggaagcgggttctggaggagtccagaactgcctggtcagacagttcacttcctacacatggtatcaggagacatcataaccaatgagtcagcttttatttctctatgctggaagctgagtttatcttgggcagtgacccactgggagccctctcaagtggggaagccatggatttatcggtgtagcagagaggttcccaagactcttgactggtcctgggagtgggtgtgaccaagtcatagttctggaatgtgtgtaggcaaattcagaggctgttccagggaagaggggattttgatactgtgttaggtggggtgtgtgaggctgttggcagcaggtgaacagctactgctgtgttctcaggactagggaacaaaggggtatgcaaatcatagaggaaactctgggaaggcggtgataaggcctggtgggtggggaggttagggaatggcttgctttcctgtttctggttagaaggggagccagggggaacccccagtggtttcaggtggcccctgaggtcctggaggcagccgtggatgtgatgcaattggctgtgggaccttagatgtaggacacaacttcagtgttcccatccagaaagacctcactcacagggttgtgctgagaatgacgtggggctaagcatgcagagctccctgtaaactgtgaagtgtgatacaaatgtaaatgacagcagtgatctcggggtggcccccggcatgctgccctcccccacgcccatgcctgtggcagcaaaccttgttcatcagtatagctttctttcctgtaacccaggatctaccttggggggcttctcaatactgcattctatgtagccagcctctttaacttggtaagtgagccaccccattctagaacctggaaattggagcccctcaaaaacagttcctgttcaaggaggactgacctgctggggcaatgttgggtgcagtgcagtccctgcttggggtggtcatgtctaggctgttgctctgggcaaagataagttgcaagattcacagaaatgggaaaatgtgaccaagtgtgatcttaacaactgacaaagtttgtaaccaacccaagttagaatgtgtgtcaaacaggaggtagtttagatatgcttccaagaacatgtctgtgttataaccatagtgcctaagcagtgagctctggtttttgaagggcttttaagaaatatatacatgtctgtgtcagtctataacttgcctcctctgggcctgttaaagcatgaagactgcatgacacaagagaaatgcaagccctacggttcctttctcagcagcgaattcacttgagaggatgctcttgactcattctctctgctctttcctgctcagatttctgataaaaatagagagcataggggaacagataatgaaataggaaacccactcgtgggttccacagatacctaccgaaggcctactgtgtgctagaattgtagctcaggagttctcagtgtagctgctcactgaagttaccatggcaggtttcaactggcagaatccaggctccgtcccacccagagattctgatgaaattggtttagggtgtggctcgggcctcaggaattcagaaagcttcccaggtgcttccaatgtgcagccagggttagggacctctaccctagacacaaagtattggacagatagacctggtgccagagatggccatgagctgtaagctaggacgtgccccacctgagctctgcactagctagttcaaacaggcgctttaaaggcagtgtgaaaggggacagcctgttctgccaggtctcagaatgtatatttattaagtgccattaaaagggacctgaacaaaattggatgtcttgtaggcataagggaggaaaataaaatatacttggaaccaagtctatgtcatgaagggaaaataaaaatgtattcagtagcacgtgggttatggtttctcatagaccaggggataagattaaaagtcactgaagagtgggaaaatgcatgttgagaagatgagaatggcctgtattttctccaggggaatctgtgtaatgtgccttttccctctccaaatgcctagaaccatggcactgtgtcttatttatttaaccgttgggctgtctcatactaaacttgcaaagatatttgcctatgaactgaacaagacttccaggagttgaagtctggttcacaagggtaccccttgcctcctgtgatggagtgagaactcttaaacccctcaggccccaactcagttgtggagatgaggacaagattacaatatcaaaagaaagatgaatgaattcttggttaatatgacgaaccccagctcaatgagtaactgatgtgaactgctgggaataaaggacttcaaagatgaaaaaaaaaag

SEQ ID NO: 76151 - DNA, 516 bp, Homo sapiens
tactactaaattcgcggccgcgtcgacccatcctggaggcccaggacaagaaggggaaccctgagtggagcctggtggaagtgaatggacagaggggttatgtgccttctggcttcttggccagggctcggagcccagttctgtggggctggagtctgccctcttagggtaccctctttggagcctacattgccaaatgatgggggaggcttagaggctctgaccctggggggaaaagaagcaaaggaaaggtggaggtggaagggaagaccaggccagggtgggtgaagcacactcaggaggcagccagaagacatgggcgggcctcgcagagtgcttggtgtggtgggggcacaggaggctccagccaggactgctcattatgtctgcataaagaactcattccgacctggggtcacaatgcacttggacagcaggtcacagctgattgaagactggccataacctgtggagagtcctggccaatcagctgtgaccgtcgacgcggccgcgaat

SEQ ID NO: 76152 - DNA, 3179 bp, Homo sapiens
gcggccgctggctggtggacaccgggggacatcgtgggtatgtgccggctgggaaactacagctgtaccatgtggtccccagtgcagaggagctcagaaggcaggcggggctgaacaaagacccccgatgtctaacaccggagcccagcccagctctagtgccctctattcccaccatgaaccaggtcatagccgcgtacccttttgtggccagaagcagccatgaagtgagcctgcaggcaggccagcctgtgaccatcctggaggcccaggacaagaaggggaaccctgagtggagcctggtggaagtgaatggacagaggggttatgtgccttctggcttcttggccagggctcggagcccagttctgtggggctggagtctgccctcttagggtaccctctttggagcctacattgccaaatgatgggggaggcttagaggctctgaccctggggggaaaagaagcaaaggaaaggtggaggtggaagggaagaccaggccagggtgggtgaagcacactcaggaggcagccagaagacatgggcgggcctcgcagagtgcttggtgtggtgggggcacaggaggctccagccaggactgctcattatgtctgcataaagaactcattccgacctggggtcacaatgcacttggacagcaggtcacagctgattggccaggactctccataggttatggccagtcttagctgtgcctgcatccgggcctgcctgtgggcgtgggtcacacgggataatgttacctgcgtgctgtgtggttgcaggaagcgggttctggaggagtccagaactgcctggtcagacagttcacttcctacacatggtatcaggagacatcataaccaatgagtcagcttttatttctctatgctggaagctgagtttatcttgggcagtgacccactgggagccctctcaagtggggaagccatggatttatcggtgtagcagagaggttcccaagactcttgactggtcctgggagtgggtgtgaccaagtcatagttctggaatgtgtgtaggcaaattcagaggctgttccagggaagaggggattttgatactgtgttaggtggggtgtgtgaggctgttggcagcaggtgaacagctactgctgtgttctcaggactagggaacaaaggggtatgcaaatcatagaggaaactctgggaaggcggtgataaggcctggtgggtggggaggttagggaatggcttgctttcctgtttctggttagaaggggagccagggggaacccccagtggtttcaggtggcccctgaggtcctggaggcagccgtggatgtgatgcaattggctgtgggaccttagatgtaggacacaacttcagtgttcccatccagaaagacctcactcacagggttgtgctgagaatgacgtggggctaagcatgcagagctccctgtaaactgtgaagtgtgatacaaatgtaaatgacagcagtgatctcggggtggcccccggcatgctgccctcccccacgcccatgcctgtggcagcaaaccttgttcatcagtatagctttctttcctgtaacccaggatctaccttggggggcttctcaatactgcattctatgtagccagcctctttaacttggtaagtgagccaccccattctagaacctggaaattggagcccctcaaaaacagttcctgttcaaggaggactgacctgctggggcaatgttgggtgcagtgcagtccctgcttggggtggtcatgtctaggctgttgctctgggcaaagataagttgcaagattcacagaaatgggaaaatgtgaccaagtgtgatcttaacaactgacaaagtttgtaaccaacccaagttagaatgtgtgtcaaacaggaggtagtttagatatgcttccaagaacatgtctgtgttataaccatagtgcctaagcagtgagctctggtttttgaagggcttttaagaaatatatacatgtctgtgtcagtctataacttgcctcctctgggcctgttaaagcatgaagactgcatgacacaagagaaatgcaagccctacggttcctttctcagcagcgaattcacttgagaggatgctcttgactcattctctctgctctttcctgctcagatttctgataaaaatagagagcataggggaacagataatgaaataggaaacccactcgtgggttccacagatacctaccgaaggcctactgtgtgctagaattgtagctcaggagttctcagtgtagctgctcactgaagttaccatggcaggtttcaactggcagaatccaggctccgtcccacccagagattctgatgaaattggtttagggtgtggctcgggcctcaggaattcagaaagcttcccaggtgcttccaatgtgcagccagggttagggacctctaccctagacacaaagtattggacagatagacctggtgccagagatggccatgagctgtaagctaggacgtgccccacctgagctctgcactagctagttcaaacaggcgctttaaaggcagtgtgaaaggggacagcctgttctgccaggtctcagaatgtatatttattaagtgccattaaaagggacctgaacaaaattggatgtcttgtaggcataagggaggaaaataaaatatacttggaaccaagtctatgtcatgaagggaaaataaaaatgtattcagtagcacgtgggttatggtttctcatagaccaggggataagattaaaagtcactgaagagtgggaaaatgcatgttgagaagatgagaatggcctgtattttctccaggggaatctgtgtaatgtgccttttccctctccaaatgcctagaaccatggcactgtgtcttatttatttaaccgttgggctgtctcatactaaacttgcaaagatatttgcctatgaactgaacaagacttccaggagttgaagtctggttcacaagggtaccccttgcctcctgtgatggagtgagaactcttaaacccctcaggccccaactcagttgtggagatgaggacaagattacaatatcaaaagaaagatgaatgaattcttggttaatatgacgaaccccagctcaatgagtaactgatgtgaactgctgggaataaaggacttcaaagatgaaaaaaaaaag

SEQ ID NO: 76153 - DNA, 2542 bp, Homo sapiens
ggtgactccgaggattaaatatatccggctatccacatatccgccaggactctccataggttatggccagtcttagctgtgcctgcatccgggcctgcctgtgggcgtgggtcacacgggataatgttacctgcgtgctgtgtggttgcaggaagcgggttctggaggagtccagaactgcctggtcagacagttcacttcctacacatggtatcaggagacatcataaccaatgagtcagcttttatttctctatgctggaagctgagtttatcttgggcagtgacccactgggagccctctcaagtggggaagccatggatttatcggtgtagcagagaggttcccaagactcttgactggtcctgggagtgggtgtgaccaagtcatagttctggaatgtgtgtaggcaaattcagaggctgttccagggaagaggggattttgatactgtgttaggtggggtgtgtgaggctgttggcagcaggtgaacagctactgctgtgttctcaggactagggaacaaaggggtatgcaaatcatagaggaaactctgggaaggcggtgataaggcctggtgggtggggaggttagggaatggcttgctttcctgtttctggttagaaggggagccagggggaacccccagtggtttcaggtggcccctgaggtcctggaggcagccgtggatgtgatgcaattggctgtgggaccttagatgtaggacacaacttcagtgttcccatccagaaagacctcactcacagggttgtgctgagaatgacgtggggctaagcatgcagagctccctgtaaactgtgaagtgtgatacaaatgtaaatgacagcagtgatctcggggtggcccccggcatgctgccctcccccacgcccatgcctgtggcagcaaaccttgttcatcagtatagctttctttcctgtaacccaggatctaccttggggggcttctcaatactgcattctatgtagccagcctctttaacttggtaagtgagccaccccattctagaacctggaaattggagcccctcaaaaacagttcctgttcaaggaggactgacctgctggggcaatgttgggtgcagtgcagtccctgcttggggtggtcatgtctaggctgttgctctgggcaaagataagttgcaagattcacagaaatgggaaaatgtgaccaagtgtgatcttaacaactgacaaagtttgtaaccaacccaagttagaatgtgtgtcaaacaggaggtagtttagatatgcttccaagaacatgtctgtgttataaccatagtgcctaagcagtgagctctggtttttgaagggcttttaagaaatatatacatgtctgtgtcagtctataacttgcctcctctgggcctgttaaagcatgaagactgcatgacacaagagaaatgcaagccctacggttcctttctcagcagcgaattcacttgagaggatgctcttgactcattctctctgctctttcctgctcagatttctgataaaaatagagagcataggggaacagataatgaaataggaaacccactcgtgggttccacagatacctaccgaaggcctactgtgtgctagaattgtagctcaggagttctcagtgtagctgctcactgaagttaccatggcaggtttcaactggcagaatccaggctccgtcccacccagagattctgatgaaattggtttagggtgtggctcgggcctcaggaattcagaaagcttcccaggtgcttccaatgtgcagccagggttagggacctctaccctagacacaaagtattggacagatagacctggtgccagagatggccatgagctgtaagctaggacgtgccccacctgagctctgcactagctagttcaaacaggcgctttaaaggcagtgtgaaaggggacagcctgttctgccaggtctcagaatgtatatttattaagtgccattaaaagggacctgaacaaaattggatgtcttgtaggcataagggaggaaaataaaatatacttggaaccaagtctatgtcatgaagggaaaataaaaatgtattcagtagcacgtgggttatggtttctcatagaccaggggataagattaaaagtcactgaagagtgggaaaatgcatgttgagaagatgagaatggcctgtattttctccaggggaatctgtgtaatgtgccttttccctctccaaatgcctagaaccatggcactgtgtcttatttatttaaccgttgggctgtctcatactaaacttgcaaagatatttgcctatgaactgaacaagacttccaggagttgaagtctggttcacaagggtaccccttgcctcctgtgatggagtgagaactcttaaacccctcaggccccaactcagttgtggagatgaggacaagattacaatatcaaaagaaagatgaatgaattcttggttaatatgacgaaccccagctcaatgagtaactgatgtgaactgctgggaataaaggacttcaaagatgaaaaaaaaaag

SEQ ID NO: 76154 - DNA, 1891 bp, Homo sapiens
cacacctgtagtccaaactactcaggaggcagccgtggatgtgatgcaattggctgtgggaccttagatgtaggacacaacttcagtgttcccatccagaaagacctcactcacagggttgtgctgagaatgacgtggggctaagcatgcagagctccctgtaaactgtgaagtgtgatacaaatgtaaatgacagcagtgatctcggggtggcccccggcatgctgccctcccccacgcccatgcctgtggcagcaaaccttgttcatcagtatagctttctttcctgtaacccaggatctaccttggggggcttctcaatactgcattctatgtagccagcctctttaacttggtaagtgagccaccccattctagaacctggaaattggagcccctcaaaaacagttcctgttcaaggaggactgacctgctggggcaatgttgggtgcagtgcagtccctgcttggggtggtcatgtctaggctgttgctctgggcaaagataagttgcaagattcacagaaatgggaaaatgtgaccaagtgtgatcttaacaactgacaaagtttgtaaccaacccaagttagaatgtgtgtcaaacaggaggtagtttagatatgcttccaagaacatgtctgtgttataaccatagtgcctaagcagtgagctctggtttttgaagggcttttaagaaatatatacatgtctgtgtcagtctataacttgcctcctctgggcctgttaaagcatgaagactgcatgacacaagagaaatgcaagccctacggttcctttctcagcagcgaattcacttgagaggatgctcttgactcattctctctgctctttcctgctcagatttctgataaaaatagagagcataggggaacagataatgaaataggaaacccactcgtgggttccacagatacctaccgaaggcctactgtgtgctagaattgtagctcaggagttctcagtgtagctgctcactgaagttaccatggcaggtttcaactggcagaatccaggctccgtcccacccagagattctgatgaaattggtttagggtgtggctcgggcctcaggaattcagaaagcttcccaggtgcttccaatgtgcagccagggttagggacctctaccctagacacaaagtattggacagatagacctggtgccagagatggccatgagctgtaagctaggacgtgccccacctgagctctgcactagctagttcaaacaggcgctttaaaggcagtgtgaaaggggacagcctgttctgccaggtctcagaatgtatatttattaagtgccattaaaagggacctgaacaaaattggatgtcttgtaggcataagggaggaaaataaaatatacttggaaccaagtctatgtcatgaagggaaaataaaaatgtattcagtagcacgtgggttatggtttctcatagaccaggggataagattaaaagtcactgaagagtgggaaaatgcatgttgagaagatgagaatggcctgtattttctccaggggaatctgtgtaatgtgccttttccctctccaaatgcctagaaccatggcactgtgtcttatttatttaaccgttgggctgtctcatactaaacttgcaaagatatttgcctatgaactgaacaagacttccaggagttgaagtctggttcacaagggtaccccttgcctcctgtgatggagtgagaactcttaaacccctcaggccccaactcagttgtggagatgaggacaagattacaatatcaaaagaaagatgaatgaattcttggttaatatgacgaaccccagctcaatgagtaactgatgtgaactgctgggaataaaggacttcaaagatgaaaaaaaaaag

SEQ ID NO: 76155 - DNA, 1348 bp, Homo sapiens
gaaagcctaagtgtttcaggcaaaggcaagtgtgtgtgcaaaggaacttgagaaaacagattttcctaatacctaaagcataaggtaagaagatagtaacagaaagtgaaagggaaaacaattaagcagaaaccagattacaaagggtcacatacatgatggtatcgttttgcacaaactcatccaattgtctaaactcatcaaactgtacacattaaaggtgcaattctttatcaatcatacctcgacaaagctgttacaaaaagaaaatgatgtggtcttccagacactatctggagccacccacccacacgctaacttattggagtctttagggatccacttggtaatcaaacagcacagtgaatagaggaactctttggcataagaggatcataggttcaagtcccagctctaccactttctggcagtgtaaccactggcccttaccccagagcaagtgtcattctgtgccacacatatgcagcaatatatggacccacggggtcgaagccatctctctggctatgactacgttggcttcaccaattcctactttggcaactaataagcagctcctcgtggatcgtagaaaatcttagtgtcgtgggaaatttactggggggcaaagagtacaggcaaatgtggaagataaagatggcctcgtgtgtgtgtgtgtgtgtgtgtgtgtgtgtgtgtgcttgtgtttgtgtgcatattacatttattgtaggatcttaaaaaatctcaagggtgggagatagaaaggttaatagagttggaggagtggaagctattttgtatgcaactagtcactgctgaggggtgtcaaagtttctatttttatttgttctgttttgcacgtctttatcattttgctttattccgattatagaataaagtaattctttttaaaaatattttttggggcaaagttaagtaaaatgttgagcttctatatttctgggaactgtactcatataagagtgggcagctaattttactgtaaagaagggccatggtatagtagataaataaaatccaaggcaattttcaaacaatttttttaaactttggaatgtgtttaaatttaaatttgaaaataaagatatttgattttctggggaacatgaatattttagtttgtacaatgaaacaacacacagatcagcataacacctgttttcttcttgttttttttccatacttcaaaattattgtagatgttattactctcagaaagacaaaattccagcatagcagggctttctcttgtcctccaagctcccgtattttctcttaagttttaatgtaataaaaataatacttcaatatcctgttaaagtaa

SEQ ID NO: 76156 - DNA, 1201 bp, Homo sapiens
caaatgttgttaggcatataattccttctatttaataaaacaactttagggaatgagatttacagaataatcaaagtgagtaagctctctttttcaagaaagggctgagattaaaagttaagttactcattagaaattataaatttatgagataaaaattgtgtgtaatagaaatagggcttgcgtcttccagagactctccatctcctgcatttatggcgtaatatgggaagccccaaggaaccagctattttgaatccctataactgtatttttctctttttatacttttcaggcccttaccccagagcaagtgtcattctgtgccacacatatgcagcaatatatggacccacggggtcgaagccatctctctggctatgactacgttggcttcaccaattcctactttggcaactaataagcagctcctcgtggatcgtagaaaatcttagtgtcgtgggaaatttactggggggcaaagagtacaggcaaatgtggaagataaagatggcctcgtgtgtgtgtgtgtgtgtgtgtgtgtgtgtgtgtgcttgtgtttgtgtgcatattacatttattgtaggatcttaaaaaatctcaagggtgggagatagaaaggttaatagagttggaggagtggaagctattttgtatgcaactagtcactgctgaggggtgtcaaagtttctatttttatttgttctgttttgcacgtctttatcattttgctttattccgattatagaataaagtaattctttttaaaaatattttttggggcaaagttaagtaaaatgttgagcttctatatttctgggaactgtactcatataagagtgggcagctaattttactgtaaagaagggccatggtatagtagataaataaaatccaaggcaattttcaaacaatttttttaaactttggaatgtgtttaaatttaaatttgaaaataaagatatttgattttctggggaacatgaatattttagtttgtacaatgaaacaacacacagatcagcataacacctgttttcttcttgttttttttccatacttcaaaattattgtagatgttattactctcagaaagacaaaattccagcatagcagggctttctcttgtcctccaagctcccgtattttctcttaagttttaatgtaataaaaataatacttcaatatcctgttaaagtaa

SEQ ID NO: 76157 - DNA, 8223 bp, Homo sapiens
tgtcgattgtgtatggctgatgggattctaggaccaagcaagaggttttttttttttcccccacatacttaacgtttctatatttctatttgaattcgactggacagttccatttgaattatttctctctctctctctctctctctgacacattttatcttgccaggttctaaacctttaggaaaaatggagcaatttccaaaggaaaccgttgtggagagcagtgggccaaaggttttggaaacagcagaagagatccaggagaggcgtcaggaagtgttgactcggtatcaaagtttcaaggagcgggttgctgagaggggtcagaagcttgaggattcctatcacttacaagttttcaagcgagatgcagatgatctggggaagtggatcatggagaaagtcaatatcttaaccgataagagctatgaagacccaactaatatacaggggaaatatcagaagcatcaatcccttgaagcagaggtgcaaacgaaatcaagactcatgtctgaactggaaaaaacaagggaagaacgatttaccatgggtcattctgcccacgaagaaacgaaggcccatatagaggagctacgccacctgtgggacctgctgttagagctgaccctggagaagggtgaccagttgctgcgggccctgaagttccagcagtatgtacaggagtgtgctgacatcttagagtggattggagacaaggaggctatagcgacatcagtggagctaggtgaagactgggagcgcaccgaagttctgcataagaaatttgaagacttccaagtggagctggtagctaaagaagggagagttgttgaagtgaaccaatatgccaatgagtgtgccgaggaaaaccatcctgacctacccttaattcagtctaagcaaaatgaggtgaatgctgcctgggagcgccttcgtggtttggctctccagagacagaaagctctgtccaatgctgcaaacttacaacgattcaaaagggatgtgactgaagccatccagtggatcaaggagaaggaacctgtactcacctctgaggactatggcaaagaccttgttgcctctgaaggactgtttcacagccacaagggacttgagagaaatcttgcagtcatgagtgacaaggtgaaggagttatgtgctaaagcagagaagctgacactttcccatccttcagatgcacctcagatccaggagatgaaagaagatctggtctccagctgggagcatattcgtgccctggccaccagcagatatgaaaaactgcaggctacttattggtaccatcgattttcatctgactttgatgaactctcaggctggatgaacgagaagactgctgcgatcaatgctgatgagctgccaacagatgtggctggtggagaagttctgctggacaggcatcagcagcataagcatgagattgactcttacgatgaccgatttcaatctgctgatgagactggtcaagacctcgtgaatgccaatcatgaagcctctgatgaagttcgggaaaagatggaaatacttgacaacaactggactgccctgctggaactgtgggacgagcgtcatcgtcagtatgagcagtgcttggactttcatctcttctacagagacagtgagcaagtggacagttggatgagtagacaagaggccttcctggaaaacgaggatctgggaaactcactgggcagtgcagaagcccttcttcagaagcatgaagactttgaggaagcctttactgcccaggaagagaagatcataactgtagacaagactgcaaccaaattgattggtgatgaccattatgattcagagaacatcaaggctatccgtgacggcctgttagcccggcgggatgccctacgtgaaaaggctgccactagacgtagattgctgaaggagtcattgcttctgcaaaaactgtatgaggactcagatgacctaaagaactggatcaacaagaagaaaaagttggcagatgatgaagattacaaggacatacagaacttgaagagcagggttcaaaagcagcaagtctttgaaaaggagttggcagttaataagacccagctggaaaacatacagaaaactggccaagagatgattgagggtggtcactatgcctctgacaatgtgaccactcgtctgagtgaagttgccagcctctgggaggagttgctggaggctacaaaacagaaagggacccagttgcatgaggccaaccagcagctgcaatttgaaaataatgcagaagatttgcagcgctggctggaggatgttgagtggcaagtcacctctgaggattatgggaaaggcctggccgaggtacagaatcgactcaggaaacacggcctcctggagtcggctgtggctgctcgtcaggatcaggtggatatccttacagacctggctgcatattttgaagaaataggccatcctgattctaaggatataagggcaaggcaagagtccttggtatgccgatttgaagctctgaaagagccactggccaccagaaagaagaagctcttagaacttctccatctgcagctgatttgtagagacacagaggatgaggaagcctggatccaagagactgaaccctcagctacttccacctaccttggaaaggacctgattgcttccaaaaagcttctgaataggcatagagtcatcctggacaacattgccagccatgaaccacgcattcaagagataacagaaaggggaaacaaaatggtagaggaaggacactttgctgcagaagatgtggcctctagggtcaagagtttgaaccagaatatggagtctctccgtgctcgagctgctaggcgacaaaatgatcttgaagccaatgtccagttccagcagtacctggctgacctgcatgaagcagaaacatggatcagagagaaggaacctattgtagataatactaactatggtgctgatgaagaagcagctggggctcttctaaagaagcatgaggcctttctattagatctcaattcatttggagacagtatgaaagctctgcggaatcaggcaaacgcctgccagcaacaacaggctgcaccagtggagggagttgctggagaacaaagggtcatggctttatatgacttccaggcccgcagcccccgagaagtcaccatgaagaaaggtgatgtcttaacgctgctcagttccatcaataaggactggtggaaggtggaagctgctgatcatcagggcattgtcccagctgtctatgtcagaagactggcccacgatgagttcccgatgctcccacagcggcgacgagaagagccaggaaacatcacccagcgccaggagcagattgagaaccaataccgctccctcttggatcgggcagaagaacgcagacgtcgtctattgcaacgttataatgaatttttattggcctatgaggcaggagacatgctggaatggattcaagagaaaaaggcagaaaacactggagtggaactagatgatgtttgggagctgcagaaaaagtttgatgagttccaaaaggatttgaataccaatgagcctcggctaagggatatcaacaaggtagctgatgatctactatttgaaggacttctaacaccagaaggagctcaaatccggcaggaattgaatgcccgctggggttctttgcagaggcttgcagatgaacagcggcagctgctgggcagtgcccatgctgttgaagtgtttcacagagaagcagatgacacgaaggagcagattgagaagaaatgccaggccctcagtgctgcagaccctggctcagatctgttcagtgttcaggctcttcagcgacggcatgagggctttgaaagggacctcgtacccctgggagataaggtgaccatactgggggagacagcagagcggctcagtgagtcccatccagatgccactgaggacctgcagagacagaaaatggagctgaatgaggcctgggaagacctgcaggggcgtacaaaggatcgtaaggagagcctaaatgaggcccagaaattctacctgttcctcagcaaggccagggatctgcagaactggatcagtagcattggtggcatggtatcatcacaggagctggccgaagacttaactggcatagagatcttgctggagagacatcaggagcaccgtgctgacatggaggcagaggctcccaccttccaggccttagaggacttcagtgcagaacttatcgacagtgggcaccatgctagccctgaaattgaaaaaaagcttcaagctgtcaagctagagagagatgatttggagaaggcttgggaaaaacgcaagaagatcctagaccagtgcctggagttgcagatgttccaggggaactgtgatcaagttgagagccggatggtggcacgtgagaattccctgaggtcagatgacaaaagttccttagacagtctggaggctttgatgaagaaacgggacgatttggacaaagcaatcactgcccaggaagggaagatcactgacctagaacattttgctgagagcctcattgctgatgaacactatgccaaagaagagattgctacgcggctccaacgtgtactagacaggtggaaggctctcaaagcacaactgattgatgagcggacaaagcttggagactatgccaacctaaaacaattctaccgagaccttgaggagctggaagaatggatcagtgagatgctgcccacagcctgtgatgaatcctacaaagacgccactaacattcagaggaaatacctgaaacaccagacctttgcacatgaagtcgatggccgatctgagcaggtgcatggcgtcatcaacctggggaactccctgattgagcgtagttgtgatggcaatgaagaggccatgaaggagcaactggaacagctgaaggaacattgggatcatctgcttgagagaacaaatgacaaagggaagaagctcaatgaggccagtcgtcaacagaggttcaacacaagcatccgggactttgagttctggctctcagaggcagagacattgctggccatgaaagatcaggccagggacttggcttcagcaggaaacctactcaagaagcatcagctattggagagagagatgttggctcgagaggatgcactcaaggacctgaatacattggctgaagatttgctctccagcgggactttcaacgttgatcagattgtgaagaaaaaagataatgtcaacaagcgtttcctgaatgtccaagaattggcagctgcacaccacgaaaaattgaaagaggcctatgccttgttccagttcttccaggatctagatgatgaggaatcctggatagaggagaagttgatacgagtgagctcccaggactatgggagagatcttcagggggttcagaacttgctgaagaagcacaaacgcctagagggggagctggtggcccatgagcctgccatccagaatgtgctggatatggcagagaagctgaaagacaaggctgctgtggggcaagaggagatccagttgcggctggctcagtttgttgaacactgggagaagctcaaagagttggccaaggcccgaggacttaagttggaagaatccctagaatacttgcaattcatgcagaatgctgaggaagaggaagcttggatcaatgaaaagaatgctttggctgtccgaggagattgtggagatacattagctgctactcagagcttgctaatgaagcatgaagctttggaaaatgactttgctgtccatgagacccgagtacaaaatgtgtgtgcacaaggagaagacatcctaaataaggtgttgcaggaggaaagtcagaacaaagagatttcttccaagatagaggctctgaatgaaaagaccccttctctggctaaggcaatagctgcttggaagttgcaattggaagacgattatgcctttcaggaattcaactggaaggctgatgtggtagaggcttggatagctgataaggaaacaagcctaaagaccaatggcaatggtgcagaccttggtgacttcctcactcttctggcaaaacaggacactctggatgccagtctgcagagtttccagcaagagagacttcccgagatcactgacctgaaggacaaactgatttctgctcaacacaaccagtctaaagccattgaagagcgttatgccgctctgctgaagcgctgggaacagttgctggaagcctcggcagtccacagacagaaattgctggagaaacagctgcctctacagaaggctgaggacctgttcgtggaatttgcacataaggcttcagctttgaacaactggtgtgaaaagatggaagaaaacttgtcagagcctgtgcactgtgtctccctgaatgaaattcggcagctgcagaaagaccatgaggacttcttggcctccctggctagggctcaagcagactttaaatgtttgctggagctagaccagcagattaaggccttaggtgtgccttccagcccttatacctggttaacagtggaggtgctggaaaggacctggaagcacctatctgacatcattgaggaacgggagcaggagctgcaaaaggaagaggcaagacaggtcaagaactttgagatgtgtcaggagtttgaacagaatgccagtaccttccttcaatggatcctggaaaccagggcttactttctggatggatcattgctcaaagaaacaggaactctggaatctcagctggaagcaaataaaagaaaacagaaggagatccaggcgatgaagcgtcaactaaccaagattgtggacctgggggacaacttggaagacgctctgatccttgatatcaaatacagcaccattggattggctcagcagtgggaccagctctaccagcttgggttgcggatgcaacacaacctggagcaacagatccaggccaaggacatcaaaggtgtgagtgaagagactctaaaggaatttagcacaatctataaacactttgatgagaatttgacagggcgcctgactcacaaagagttccggtcctgcctgagaggactcaattactacttgcccatggtggaggaggatgaacatgagcccaagtttgagaagttcctggatgctgtggatccagggaggaagggctatgtctcactggaggactatactgctttcctgattgacaaggagtcagaaaacatcaagtccagtgatgaaatagagaatgccttccaagccctggcagagggcaagtcatatattaccaaagaagacatgaagcaggcccttaccccagagcaagtgtcattctgtgccacacatatgcagcaatatatggacccacggggtcgaagccatctctctggctatgactacgttggcttcaccaattcctactttggcaactaataagcagctcctcgtggatcgtagaaaatcttagtgtcgtgggaaatttactggggggcaaagagtacaggcaaatgtggaagataaagatggcctcgtgtgtgtgtgtgtgtgtgtgtgtgtgtgtgtgtgcttgtgtttgtgtgcatattacatttattgtaggatcttaaaaaatctcaagggtgggagatagaaaggttaatagagttggaggagtggaagctattttgtatgcaactagtcactgctgaggggtgtcaaagtttctatttttatttgttctgttttgcacgtctttatcattttgctttattccgattatagaataaagtaattctttttaaaaatattttttggggcaaagttaagtaaaatgttgagcttctatatttctgggaactgtactcatataagagtgggcagctaattttactgtaaagaagggccatggtatagtagataaataaaatccaaggcaattttcaaacaatttttttaaactttggaatgtgtttaaatttaaatttgaaaataaagatatttgattttctggggaacatgaatattttagtttgtacaatgaaacaacacacagatcagcataacacctgttttcttcttgttttttttccatacttcaaaattattgtagatgttattactctcagaaagacaaaattccagcatagcagggctttctcttgtcctccaagctcccgtattttctcttaagttttaatgtaataaaaataatacttcaatatcctgttaaagtaa

SEQ ID NO: 76158 - DNA, 948 bp, Homo sapiens
atctcccttttctctcatgtgattcctgttccggacctccatgtccagggcttactttctggatggcttactttctggatggatcattgctcaaagaaacaggaactctggaatctcagctggaagcaaataaaagaaaacagaaggagatccaggcgatgaagcgtcaactaaccaagattgtggacctgggggacaacttggaagacgctctgatccttgatatcaaatacagcaccattggattggctcagcagtgggaccagctctaccagcttgggttgcggatgcaacacaacctggagcaacagatccaggccaagtattgagggcgtgtggccagagcagggagggatgcaggtggtgttaggtgttaggaccttaactaagggcgagagtttggtgcaccagataaaagagttgcttcagagaaccaatattctgggtctttactgccccacggaatgactatttctctttatactgaaatccatcatgaaataaaagacagtgctctccatccacctgagcctactcatcacccacttggacaacaactgacttttatacccaatttctcagagttctttcaccatcttatgtgatctcttaggaaaccattccctttcatagaattttatctaaaatgtaatgtctagattaaaagaaacatttaaagtgtggccaaatagagcagaagggcagaaactcattttctagataaattcactatatcaaagcagctctaggtctcaatagcattttggcaacatttttatctagattaggattggcaaactttttctgtaaatggtctgataataaataatttaactttgtaaggcacatatattttctgctgtaactccttgattctgctgttgtagtgaaaaaagcagctatgataagtgaatgaccgtggccatgttccaataaagctttatatat

SEQ ID NO: 76159 - DNA, 7376 bp, Homo sapiens
tgtcgattgtgtatggctgatgggattctaggaccaagcaagaggttttttttttttcccccacatacttaacgtttctatatttctatttgaattcgactggacagttccatttgaattatttctctctctctctctctctctctgacacattttatcttgccaggttctaaacctttaggaaaaatggagcaatttccaaaggaaaccgttgtggagagcagtgggccaaaggttttggaaacagcagaagagatccaggagaggcgtcaggaagtgttgactcggtatcaaagtttcaaggagcgggttgctgagaggggtcagaagcttgaggattcctatcacttacaagttttcaagcgagatgcagatgatctggggaagtggatcatggagaaagtcaatatcttaaccgataagagctatgaagacccaactaatatacaggggaaatatcagaagcatcaatcccttgaagcagaggtgcaaacgaaatcaagactcatgtctgaactggaaaaaacaagggaagaacgatttaccatgggtcattctgcccacgaagaaacgaaggcccatatagaggagctacgccacctgtgggacctgctgttagagctgaccctggagaagggtgaccagttgctgcgggccctgaagttccagcagtatgtacaggagtgtgctgacatcttagagtggattggagacaaggaggctatagcgacatcagtggagctaggtgaagactgggagcgcaccgaagttctgcataagaaatttgaagacttccaagtggagctggtagctaaagaagggagagttgttgaagtgaaccaatatgccaatgagtgtgccgaggaaaaccatcctgacctacccttaattcagtctaagcaaaatgaggtgaatgctgcctgggagcgccttcgtggtttggctctccagagacagaaagctctgtccaatgctgcaaacttacaacgattcaaaagggatgtgactgaagccatccagtggatcaaggagaaggaacctgtactcacctctgaggactatggcaaagaccttgttgcctctgaaggactgtttcacagccacaagggacttgagagaaatcttgcagtcatgagtgacaaggtgaaggagttatgtgctaaagcagagaagctgacactttcccatccttcagatgcacctcagatccaggagatgaaagaagatctggtctccagctgggagcatattcgtgccctggccaccagcagatatgaaaaactgcaggctacttattggtaccatcgattttcatctgactttgatgaactctcaggctggatgaacgagaagactgctgcgatcaatgctgatgagctgccaacagatgtggctggtggagaagttctgctggacaggcatcagcagcataagcatgagattgactcttacgatgaccgatttcaatctgctgatgagactggtcaagacctcgtgaatgccaatcatgaagcctctgatgaagttcgggaaaagatggaaatacttgacaacaactggactgccctgctggaactgtgggacgagcgtcatcgtcagtatgagcagtgcttggactttcatctcttctacagagacagtgagcaagtggacagttggatgagtagacaagaggccttcctggaaaacgaggatctgggaaactcactgggcagtgcagaagcccttcttcagaagcatgaagactttgaggaagcctttactgcccaggaagagaagatcataactgtagacaagactgcaaccaaattgattggtgatgaccattatgattcagagaacatcaaggctatccgtgacggcctgttagcccggcgggatgccctacgtgaaaaggctgccactagacgtagattgctgaaggagtcattgcttctgcaaaaactgtatgaggactcagatgacctaaagaactggatcaacaagaagaaaaagttggcagatgatgaagattacaaggacatacagaacttgaagagcagggttcaaaagcagcaagtctttgaaaaggagttggcagttaataagacccagctggaaaacatacagaaaactggccaagagatgattgagggtggtcactatgcctctgacaatgtgaccactcgtctgagtgaagttgccagcctctgggaggagttgctggaggctacaaaacagaaagggacccagttgcatgaggccaaccagcagctgcaatttgaaaataatgcagaagatttgcagcgctggctggaggatgttgagtggcaagtcacctctgaggattatgggaaaggcctggccgaggtacagaatcgactcaggaaacacggcctcctggagtcggctgtggctgctcgtcaggatcaggtggatatccttacagacctggctgcatattttgaagaaataggccatcctgattctaaggatataagggcaaggcaagagtccttggtatgccgatttgaagctctgaaagagccactggccaccagaaagaagaagctcttagaacttctccatctgcagctgatttgtagagacacagaggatgaggaagcctggatccaagagactgaaccctcagctacttccacctaccttggaaaggacctgattgcttccaaaaagcttctgaataggcatagagtcatcctggacaacattgccagccatgaaccacgcattcaagagataacagaaaggggaaacaaaatggtagaggaaggacactttgctgcagaagatgtggcctctagggtcaagagtttgaaccagaatatggagtctctccgtgctcgagctgctaggcgacaaaatgatcttgaagccaatgtccagttccagcagtacctggctgacctgcatgaagcagaaacatggatcagagagaaggaacctattgtagataatactaactatggtgctgatgaagaagcagctggggctcttctaaagaagcatgaggcctttctattagatctcaattcatttggagacagtatgaaagctctgcggaatcaggcaaacgcctgccagcaacaacaggctgcaccagtggagggagttgctggagaacaaagggtcatggctttatatgacttccaggcccgcagcccccgagaagtcaccatgaagaaaggtgatgtcttaacgctgctcagttccatcaataaggactggtggaaggtggaagctgctgatcatcagggcattgtcccagctgtctatgtcagaagactggcccacgatgagttcccgatgctcccacagcggcgacgagaagagccaggaaacatcacccagcgccaggagcagattgagaaccaataccgctccctcttggatcgggcagaagaacgcagacgtcgtctattgcaacgttataatgaatttttattggcctatgaggcaggagacatgctggaatggattcaagagaaaaaggcagaaaacactggagtggaactagatgatgtttgggagctgcagaaaaagtttgatgagttccaaaaggatttgaataccaatgagcctcggctaagggatatcaacaaggtagctgatgatctactatttgaaggacttctaacaccagaaggagctcaaatccggcaggaattgaatgcccgctggggttctttgcagaggcttgcagatgaacagcggcagctgctgggcagtgcccatgctgttgaagtgtttcacagagaagcagatgacacgaaggagcagattgagaagaaatgccaggccctcagtgctgcagaccctggctcagatctgttcagtgttcaggctcttcagcgacggcatgagggctttgaaagggacctcgtacccctgggagataaggtgaccatactgggggagacagcagagcggctcagtgagtcccatccagatgccactgaggacctgcagagacagaaaatggagctgaatgaggcctgggaagacctgcaggggcgtacaaaggatcgtaaggagagcctaaatgaggcccagaaattctacctgttcctcagcaaggccagggatctgcagaactggatcagtagcattggtggcatggtatcatcacaggagctggccgaagacttaactggcatagagatcttgctggagagacatcaggagcaccgtgctgacatggaggcagaggctcccaccttccaggccttagaggacttcagtgcagaacttatcgacagtgggcaccatgctagccctgaaattgaaaaaaagcttcaagctgtcaagctagagagagatgatttggagaaggcttgggaaaaacgcaagaagatcctagaccagtgcctggagttgcagatgttccaggggaactgtgatcaagttgagagccggatggtggcacgtgagaattccctgaggtcagatgacaaaagttccttagacagtctggaggctttgatgaagaaacgggacgatttggacaaagcaatcactgcccaggaagggaagatcactgacctagaacattttgctgagagcctcattgctgatgaacactatgccaaagaagagattgctacgcggctccaacgtgtactagacaggtggaaggctctcaaagcacaactgattgatgagcggacaaagcttggagactatgccaacctaaaacaattctaccgagaccttgaggagctggaagaatggatcagtgagatgctgcccacagcctgtgatgaatcctacaaagacgccactaacattcagaggaaatacctgaaacaccagacctttgcacatgaagtcgatggccgatctgagcaggtgcatggcgtcatcaacctggggaactccctgattgagcgtagttgtgatggcaatgaagaggccatgaaggagcaactggaacagctgaaggaacattgggatcatctgcttgagagaacaaatgacaaagggaagaagctcaatgaggccagtcgtcaacagaggttcaacacaagcatccgggactttgagttctggctctcagaggcagagacattgctggccatgaaagatcaggccagggacttggcttcagcaggaaacctactcaagaagcatcagctattggagagagagatgttggctcgagaggatgcactcaaggacctgaatacattggctgaagatttgctctccagcgggactttcaacgttgatcagattgtgaagaaaaaagataatgtcaacaagcgtttcctgaatgtccaagaattggcagctgcacaccacgaaaaattgaaagaggcctatgccttgttccagttcttccaggatctagatgatgaggaatcctggatagaggagaagttgatacgagtgagctcccaggactatgggagagatcttcagggggttcagaacttgctgaagaagcacaaacgcctagagggggagctggtggcccatgagcctgccatccagaatgtgctggatatggcagagaagctgaaagacaaggctgctgtggggcaagaggagatccagttgcggctggctcagtttgttgaacactgggagaagctcaaagagttggccaaggcccgaggacttaagttggaagaatccctagaatacttgcaattcatgcagaatgctgaggaagaggaagcttggatcaatgaaaagaatgctttggctgtccgaggagattgtggagatacattagctgctactcagagcttgctaatgaagcatgaagctttggaaaatgactttgctgtccatgagacccgagtacaaaatgtgtgtgcacaaggagaagacatcctaaataaggtgttgcaggaggaaagtcagaacaaagagatttcttccaagatagaggctctgaatgaaaagaccccttctctggctaaggcaatagctgcttggaagttgcaattggaagacgattatgcctttcaggaattcaactggaaggctgatgtggtagaggcttggatagctgataaggaaacaagcctaaagaccaatggcaatggtgcagaccttggtgacttcctcactcttctggcaaaacaggacactctggatgccagtctgcagagtttccagcaagagagacttcccgagatcactgacctgaaggacaaactgatttctgctcaacacaaccagtctaaagccattgaagagcgttatgccgctctgctgaagcgctgggaacagttgctggaagcctcggcagtccacagacagaaattgctggagaaacagctgcctctacagaaggtttaaaaaaattatgaggcatgatcagttctctgttacctgtatattagccatgaaattcggaaacagatattgggaaactcagtttgggataatacaaaaaccttttattgcattgaaagatgttgggaagacattcttactgagcaaaaagtagattgaaaagaagctttaaaaattttttttagattgattgattagttgcataactaacttgagatggaagccaggcaaacagtggaagaggtggatggaacaagaggatgggaggtctttgtgtatgatagaattaaaactgtcaggcaaaagtcaaggttgtccctgtacttttcctaacccaaataaaaggagcactggacaagttgtcataaaacatgttctcaccttatatcaagctttcctaggttgaagaccttgtaaaagtcatttaatatctctaaaccttgatatccccatttagaaaattgagtagcatcaccattctattctgcctttctgttatcactattaaaaaagataatgaatctaaaagtgtaataattccatattattacattattacattcatataaatatgtatggttgtaatatgtgtgtattaataatacataattatatgtacattatctgtacctaaatatatgtacattaataatacataataaatatgtatgattaatatggattaatataataatgtaacattattacattactacatccatataaaattccatataaatatgtaatcaaaatattccttcaaatgttggctgctaaggcattggatgttgatcataaaaatatcaataatggaaggaggccaggtgcagtggctcacgcctataatcccagcactttggtagggcaaggcaggtggatcactagatcagaagatcaagatcatcctggctaacacggtgaaacaccgtctctactaaaaatacaaaaaattagccgggcgtggtggcgggcacctgtagtcccagctactcaggaggctgaggcaggagaacggcgtgatcccgggagatggagcttgcagtgagcccagatcgcggccactgtactcc

SEQ ID NO: 76160 - DNA, 7597 bp, Homo sapiens
tgtcgattgtgtatggctgatgggattctaggaccaagcaagaggttttttttttttcccccacatacttaacgtttctatatttctatttgaattcgactggacagttccatttgaattatttctctctctctctctctctctctgacacattttatcttgccaggttctaaacctttaggaaaaatggagcaatttccaaaggaaaccgttgtggagagcagtgggccaaaggttttggaaacagcagaagagatccaggagaggcgtcaggaagtgttgactcggtatcaaagtttcaaggagcgggttgctgagaggggtcagaagcttgaggattcctatcacttacaagttttcaagcgagatgcagatgatctggggaagtggatcatggagaaagtcaatatcttaaccgataagagctatgaagacccaactaatatacaggggaaatatcagaagcatcaatcccttgaagcagaggtgcaaacgaaatcaagactcatgtctgaactggaaaaaacaagggaagaacgatttaccatgggtcattctgcccacgaagaaacgaaggcccatatagaggagctacgccacctgtgggacctgctgttagagctgaccctggagaagggtgaccagttgctgcgggccctgaagttccagcagtatgtacaggagtgtgctgacatcttagagtggattggagacaaggaggctatagcgacatcagtggagctaggtgaagactgggagcgcaccgaagttctgcataagaaatttgaagacttccaagtggagctggtagctaaagaagggagagttgttgaagtgaaccaatatgccaatgagtgtgccgaggaaaaccatcctgacctacccttaattcagtctaagcaaaatgaggtgaatgctgcctgggagcgccttcgtggtttggctctccagagacagaaagctctgtccaatgctgcaaacttacaacgattcaaaagggatgtgactgaagccatccagtggatcaaggagaaggaacctgtactcacctctgaggactatggcaaagaccttgttgcctctgaaggactgtttcacagccacaagggacttgagagaaatcttgcagtcatgagtgacaaggtgaaggagttatgtgctaaagcagagaagctgacactttcccatccttcagatgcacctcagatccaggagatgaaagaagatctggtctccagctgggagcatattcgtgccctggccaccagcagatatgaaaaactgcaggctacttattggtaccatcgattttcatctgactttgatgaactctcaggctggatgaacgagaagactgctgcgatcaatgctgatgagctgccaacagatgtggctggtggagaagttctgctggacaggcatcagcagcataagcatgagattgactcttacgatgaccgatttcaatctgctgatgagactggtcaagacctcgtgaatgccaatcatgaagcctctgatgaagttcgggaaaagatggaaatacttgacaacaactggactgccctgctggaactgtgggacgagcgtcatcgtcagtatgagcagtgcttggactttcatctcttctacagagacagtgagcaagtggacagttggatgagtagacaagaggccttcctggaaaacgaggatctgggaaactcactgggcagtgcagaagcccttcttcagaagcatgaagactttgaggaagcctttactgcccaggaagagaagatcataactgtagacaagactgcaaccaaattgattggtgatgaccattatgattcagagaacatcaaggctatccgtgacggcctgttagcccggcgggatgccctacgtgaaaaggctgccactagacgtagattgctgaaggagtcattgcttctgcaaaaactgtatgaggactcagatgacctaaagaactggatcaacaagaagaaaaagttggcagatgatgaagattacaaggacatacagaacttgaagagcagggttcaaaagcagcaagtctttgaaaaggagttggcagttaataagacccagctggaaaacatacagaaaactggccaagagatgattgagggtggtcactatgcctctgacaatgtgaccactcgtctgagtgaagttgccagcctctgggaggagttgctggaggctacaaaacagaaagggacccagttgcatgaggccaaccagcagctgcaatttgaaaataatgcagaagatttgcagcgctggctggaggatgttgagtggcaagtcacctctgaggattatgggaaaggcctggccgaggtacagaatcgactcaggaaacacggcctcctggagtcggctgtggctgctcgtcaggatcaggtggatatccttacagacctggctgcatattttgaagaaataggccatcctgattctaaggatataagggcaaggcaagagtccttggtatgccgatttgaagctctgaaagagccactggccaccagaaagaagaagctcttagaacttctccatctgcagctgatttgtagagacacagaggatgaggaagcctggatccaagagactgaaccctcagctacttccacctaccttggaaaggacctgattgcttccaaaaagcttctgaataggcatagagtcatcctggacaacattgccagccatgaaccacgcattcaagagataacagaaaggggaaacaaaatggtagaggaaggacactttgctgcagaagatgtggcctctagggtcaagagtttgaaccagaatatggagtctctccgtgctcgagctgctaggcgacaaaatgatcttgaagccaatgtccagttccagcagtacctggctgacctgcatgaagcagaaacatggatcagagagaaggaacctattgtagataatactaactatggtgctgatgaagaagcagctggggctcttctaaagaagcatgaggcctttctattagatctcaattcatttggagacagtatgaaagctctgcggaatcaggcaaacgcctgccagcaacaacaggctgcaccagtggagggagttgctggagaacaaagggtcatggctttatatgacttccaggcccgcagcccccgagaagtcaccatgaagaaaggtgatgtcttaacgctgctcagttccatcaataaggactggtggaaggtggaagctgctgatcatcagggcattgtcccagctgtctatgtcagaagactggcccacgatgagttcccgatgctcccacagcggcgacgagaagagccaggaaacatcacccagcgccaggagcagattgagaaccaataccgctccctcttggatcgggcagaagaacgcagacgtcgtctattgcaacgttataatgaatttttattggcctatgaggcaggagacatgctggaatggattcaagagaaaaaggcagaaaacactggagtggaactagatgatgtttgggagctgcagaaaaagtttgatgagttccaaaaggatttgaataccaatgagcctcggctaagggatatcaacaaggtagctgatgatctactatttgaaggacttctaacaccagaaggagctcaaatccggcaggaattgaatgcccgctggggttctttgcagaggcttgcagatgaacagcggcagctgctgggcagtgcccatgctgttgaagtgtttcacagagaagcagatgacacgaaggagcagattgagaagaaatgccaggccctcagtgctgcagaccctggctcagatctgttcagtgttcaggctcttcagcgacggcatgagggctttgaaagggacctcgtacccctgggagataaggtgaccatactgggggagacagcagagcggctcagtgagtcccatccagatgccactgaggacctgcagagacagaaaatggagctgaatgaggcctgggaagacctgcaggggcgtacaaaggatcgtaaggagagcctaaatgaggcccagaaattctacctgttcctcagcaaggccagggatctgcagaactggatcagtagcattggtggcatggtatcatcacaggagctggccgaagacttaactggcatagagatcttgctggagagacatcaggagcaccgtgctgacatggaggcagaggctcccaccttccaggccttagaggacttcagtgcagaacttatcgacagtgggcaccatgctagccctgaaattgaaaaaaagcttcaagctgtcaagctagagagagatgatttggagaaggcttgggaaaaacgcaagaagatcctagaccagtgcctggagttgcagatgttccaggggaactgtgatcaagttgagagccggatggtggcacgtgagaattccctgaggtcagatgacaaaagttccttagacagtctggaggctttgatgaagaaacgggacgatttggacaaagcaatcactgcccaggaagggaagatcactgacctagaacattttgctgagagcctcattgctgatgaacactatgccaaagaagagattgctacgcggctccaacgtgtactagacaggtggaaggctctcaaagcacaactgattgatgagcggacaaagcttggagactatgccaacctaaaacaattctaccgagaccttgaggagctggaagaatggatcagtgagatgctgcccacagcctgtgatgaatcctacaaagacgccactaacattcagaggaaatacctgaaacaccagacctttgcacatgaagtcgatggccgatctgagcaggtgcatggcgtcatcaacctggggaactccctgattgagcgtagttgtgatggcaatgaagaggccatgaaggagcaactggaacagctgaaggaacattgggatcatctgcttgagagaacaaatgacaaagggaagaagctcaatgaggccagtcgtcaacagaggttcaacacaagcatccgggactttgagttctggctctcagaggcagagacattgctggccatgaaagatcaggccagggacttggcttcagcaggaaacctactcaagaagcatcagctattggagagagagatgttggctcgagaggatgcactcaaggacctgaatacattggctgaagatttgctctccagcgggactttcaacgttgatcagattgtgaagaaaaaagataatgtcaacaagcgtttcctgaatgtccaagaattggcagctgcacaccacgaaaaattgaaagaggcctatgccttgttccagttcttccaggatctagatgatgaggaatcctggatagaggagaagttgatacgagtgagctcccaggactatgggagagatcttcagggggttcagaacttgctgaagaagcacaaacgcctagagggggagctggtggcccatgagcctgccatccagaatgtgctggatatggcagagaagctgaaagacaaggctgctgtggggcaagaggagatccagttgcggctggctcagtttgttgaacactgggagaagctcaaagagttggccaaggcccgaggacttaagttggaagaatccctagaatacttgcaattcatgcagaatgctgaggaagaggaagcttggatcaatgaaaagaatgctttggctgtccgaggagattgtggagatacattagctgctactcagagcttgctaatgaagcatgaagctttggaaaatgactttgctgtccatgagacccgagtacaaaatgtgtgtgcacaaggagaagacatcctaaataaggtgttgcaggaggaaagtcagaacaaagagatttcttccaagatagaggctctgaatgaaaagaccccttctctggctaaggcaatagctgcttggaagttgcaattggaagacgattatgcctttcaggaattcaactggaaggctgatgtggtagaggcttggatagctgataaggaaacaagcctaaagaccaatggcaatggtgcagaccttggtgacttcctcactcttctggcaaaacaggacactctggatgccagtctgcagagtttccagcaagagagacttcccgagatcactgacctgaaggacaaactgatttctgctcaacacaaccagtctaaagccattgaagagcgttatgccgctctgctgaagcgctgggaacagttgctggaagcctcggcagtccacagacagaaattgctggagaaacagctgcctctacagaaggctgaggacctgttcgtggaatttgcacataaggcttcagctttgaacaactggtgtgaaaagatggaagaaaacttgtcagagcctgtgcactgtgtctccctgaatgaaattcggcagctgcagaaagaccatgaggacttcttggcctccctggctagggctcaagcagactttaaatgtttgctggagctagaccagcagattaaggccttaggtgtgccttccagcccttatacctggttaacagtggaggtgctggaaaggacctggaagcacctatctgacatcattgaggaacgggagcaggagctgcaaaaggaagaggcaagacaggtcaagaactttgagatgtgtcaggagtttgaacagaatgccagtaccttccttcaatggatcctggaaaccagggcttactttctggatggatcattgctcaaagaaacaggaactctggaatctcagctggaagcaaataaaagaaaacagaaggagatccaggcgatgaagcgtcaactaaccaagattgtggacctgggggacaacttggaagacgctctgatccttgatatcaaatacagcaccattggattggctcagcagtgggaccagctctaccagcttgggttgcggatgcaacacaacctggagcaacagatccaggccaagtattgagggcgtgtggccagagcagggagggatgcaggtggtgttaggtgttaggaccttaactaagggcgagagtttggtgcaccagataaaagagttgcttcagagaaccaatattctgggtctttactgccccacggaatgactatttctctttatactgaaatccatcatgaaataaaagacagtgctctccatccacctgagcctactcatcacccacttggacaacaactgacttttatacccaatttctcagagttctttcaccatcttatgtgatctcttaggaaaccattccctttcatagaattttatctaaaatgtaatgtctagattaaaagaaacatttaaagtgtggccaaatagagcagaagggcagaaactcattttctagataaattcactatatcaaagcagctctaggtctcaatagcattttggcaacatttttatctagattaggattggcaaactttttctgtaaatggtctgataataaataatttaactttgtaaggcacatatattttctgctgtaactccttgattctgctgttgtagtgaaaaaagcagctatgataagtgaatgaccgtggccatgttccaataaagctttatatat

SEQ ID NO: 76161 - DNA, 2294 bp, Homo sapiens
catgtttactacttgccgggtagaactggaggatagactttagaacaagaaatcatataattgaaaactacctttgctacttttggaattttaaaactgaaataattttagaaataattcgacctccctcatttgtaaatgatgaaagacttaaacaatttcacacaatgagaaaatgccagaaccagggctcgtaccgctaactcacatgttcaaccatcaaagtacacagtccctattggttttagttctgcccttttagattggtggccctgcagatatttaaagacaggcattatttttatcctcaatcttctcttctgctgagaggctttatcaggaaagatggtagtgtcttttttttctctctgcaggctgaggacctgttcgtggaatttgcacataaggcttcagctttgaacaactggtgtgaaaagatggaagaaaacttgtcagagcctgtgcactgtgtctccctgaatgaaattcggcagctgcagaaagaccatgaggacttcttggcctccctggctagggctcaagcagactttaaatgtttgctggagctagaccagcagattaaggccttaggtgtgccttccagcccttatacctggttaacagtggaggtgctggaaaggacctggaagcacctatctgacatcattgaggaacgggagcaggagctgcaaaaggaagaggcaagacaggtcaagaactttgagatgtgtcaggagtttgaacagaatgccagtaccttccttcaatggatcctggaaaccagggcttactttctggatggatcattgctcaaagaaacaggaactctggaatctcagctggaagcaaataaaagaaaacagaaggagatccaggcgatgaagcgtcaactaaccaagattgtggacctgggggacaacttggaagacgctctgatccttgatatcaaatacagcaccattggattggctcagcagtgggaccagctctaccagcttgggttgcggatgcaacacaacctggagcaacagatccaggccaaggacatcaaaggtgtgagtgaagagactctaaaggaatttagcacaatctataaacactttgatgagaatttgacagggcgcctgactcacaaagagttccggtcctgcctgagaggactcaattactacttgcccatggtggaggaggatgaacatgagcccaagtttgagaagttcctggatgctgtggatccagggaggaagggctatgtctcactggaggactatactgctttcctgattgacaaggagtcagaaaacatcaagtccagtgatgaaatagagaatgccttccaagccctggcagagggcaagtcatatattaccaaagaagacatgaagcaggcccttaccccagagcaagtgtcattctgtgccacacatatgcagcaatatatggacccacggggtcgaagccatctctctggctatgactacgttggcttcaccaattcctactttggcaactaataagcagctcctcgtggatcgtagaaaatcttagtgtcgtgggaaatttactggggggcaaagagtacaggcaaatgtggaagataaagatggcctcgtgtgtgtgtgtgtgtgtgtgtgtgtgtgtgtgtgcttgtgtttgtgtgcatattacatttattgtaggatcttaaaaaatctcaagggtgggagatagaaaggttaatagagttggaggagtggaagctattttgtatgcaactagtcactgctgaggggtgtcaaagtttctatttttatttgttctgttttgcacgtctttatcattttgctttattccgattatagaataaagtaattctttttaaaaatattttttggggcaaagttaagtaaaatgttgagcttctatatttctgggaactgtactcatataagagtgggcagctaattttactgtaaagaagggccatggtatagtagataaataaaatccaaggcaattttcaaacaatttttttaaactttggaatgtgtttaaatttaaatttgaaaataaagatatttgattttctggggaacatgaatattttagtttgtacaatgaaacaacacacagatcagcataacacctgttttcttcttgttttttttccatacttcaaaattattgtagatgttattactctcagaaagacaaaattccagcatagcagggctttctcttgtcctccaagctcccgtattttctcttaagttttaatgtaataaaaataatacttcaatatcctgttaaagtaa

SEQ ID NO: 76162 - DNA, 5516 bp, Homo sapiens
tgtcgattgtgtatggctgatgggattctaggaccaagcaagaggttttttttttttcccccacatacttaacgtttctatatttctatttgaattcgactggacagttccatttgaattatttctctctctctctctctctctctgacacattttatcttgccaggttctaaacctttaggaaaaatggagcaatttccaaaggaaaccgttgtggagagcagtgggccaaaggttttggaaacagcagaagagatccaggagaggcgtcaggaagtgttgactcggtatcaaagtttcaaggagcgggttgctgagaggggtcagaagcttgaggattcctatcacttacaagttttcaagcgagatgcagatgatctggggaagtggatcatggagaaagtcaatatcttaaccgataagagctatgaagacccaactaatatacaggggaaatatcagaagcatcaatcccttgaagcagaggtgcaaacgaaatcaagactcatgtctgaactggaaaaaacaagggaagaacgatttaccatgggtcattctgcccacgaagaaacgaaggcccatatagaggagctacgccacctgtgggacctgctgttagagctgaccctggagaagggtgaccagttgctgcgggccctgaagttccagcagtatgtacaggagtgtgctgacatcttagagtggattggagacaaggaggctatagcgacatcagtggagctaggtgaagactgggagcgcaccgaagttctgcataagaaatttgaagacttccaagtggagctggtagctaaagaagggagagttgttgaagtgaaccaatatgccaatgagtgtgccgaggaaaaccatcctgacctacccttaattcagtctaagcaaaatgaggtgaatgctgcctgggagcgccttcgtggtttggctctccagagacagaaagctctgtccaatgctgcaaacttacaacgattcaaaagggatgtgactgaagccatccagtggatcaaggagaaggaacctgtactcacctctgaggactatggcaaagaccttgttgcctctgaaggactgtttcacagccacaagggacttgagagaaatcttgcagtcatgagtgacaaggtgaaggagttatgtgctaaagcagagaagctgacactttcccatccttcagatgcacctcagatccaggagatgaaagaagatctggtctccagctgggagcatattcgtgccctggccaccagcagatatgaaaaactgcaggctacttattggtaccatcgattttcatctgactttgatgaactctcaggctggatgaacgagaagactgctgcgatcaatgctgatgagctgccaacagatgtggctggtggagaagttctgctggacaggcatcagcagcataagcatgagattgactcttacgatgaccgatttcaatctgctgatgagactggtcaagacctcgtgaatgccaatcatgaagcctctgatgaagttcgggaaaagatggaaatacttgacaacaactggactgccctgctggaactgtgggacgagcgtcatcgtcagtatgagcagtgcttggactttcatctcttctacagagacagtgagcaagtggacagttggatgagtagacaagaggccttcctggaaaacgaggatctgggaaactcactgggcagtgcagaagcccttcttcagaagcatgaagactttgaggaagcctttactgcccaggaagagaagatcataactgtagacaagactgcaaccaaattgattggtgatgaccattatgattcagagaacatcaaggctatccgtgacggcctgttagcccggcgggatgccctacgtgaaaaggctgccactagacgtagattgctgaaggagtcattgcttctgcaaaaactgtatgaggactcagatgacctaaagaactggatcaacaagaagaaaaagttggcagatgatgaagattacaaggacatacagaacttgaagagcagggttcaaaagcagcaagtctttgaaaaggagttggcagttaataagacccagctggaaaacatacagaaaactggccaagagatgattgagggtggtcactatgcctctgacaatgtgaccactcgtctgagtgaagttgccagcctctgggaggagttgctggaggctacaaaacagaaagggacccagttgcatgaggccaaccagcagctgcaatttgaaaataatgcagaagatttgcagcgctggctggaggatgttgagtggcaagtcacctctgaggattatgggaaaggcctggccgaggtacagaatcgactcaggaaacacggcctcctggagtcggctgtggctgctcgtcaggatcaggtggatatccttacagacctggctgcatattttgaagaaataggccatcctgattctaaggatataagggcaaggcaagagtccttggtatgccgatttgaagctctgaaagagccactggccaccagaaagaagaagctcttagaacttctccatctgcagctgatttgtagagacacagaggatgaggaagcctggatccaagagactgaaccctcagctacttccacctaccttggaaaggacctgattgcttccaaaaagcttctgaataggcatagagtcatcctggacaacattgccagccatgaaccacgcattcaagagataacagaaaggggaaacaaaatggtagaggaaggacactttgctgcagaagatgtggcctctagggtcaagagtttgaaccagaatatggagtctctccgtgctcgagctgctaggcgacaaaatgatcttgaagccaatgtccagttccagcagtacctggctgacctgcatgaagcagaaacatggatcagagagaaggaacctattgtagataatactaactatggtgctgatgaagaagcagctggggctcttctaaagaagcatgaggcctttctattagatctcaattcatttggagacagtatgaaagctctgcggaatcaggcaaacgcctgccagcaacaacaggctgcaccagtggagggagttgctggagaacaaagggtcatggctttatatgacttccaggcccgcagcccccgagaagtcaccatgaagaaaggtgatgtcttaacgctgctcagttccatcaataaggactggtggaaggtggaagctgctgatcatcagggcattgtcccagctgtctatgtcagaagactggcccacgatgagttcccgatgctcccacagcggcgacgagaagagccaggaaacatcacccagcgccaggagcagattgagaaccaataccgctccctcttggatcgggcagaagaacgcagacgtcgtctattgcaacgttataatgaatttttattggcctatgaggcaggagacatgctggaatggattcaagagaaaaaggcagaaaacactggagtggaactagatgatgtttgggagctgcagaaaaagtttgatgagttccaaaaggatttgaataccaatgagcctcggctaagggatatcaacaaggtagctgatgatctactatttgaaggacttctaacaccagaaggagctcaaatccggcaggaattgaatgcccgctggggttctttgcagaggcttgcagatgaacagcggcagctgctgggcagtgcccatgctgttgaagtgtttcacagagaagcagatgacacgaaggagcagattgagaagaaatgccaggccctcagtgctgcagaccctggctcagatctgttcagtgttcaggctcttcagcgacggcatgagggctttgaaagggacctcgtacccctgggagataaggtgaccatactgggggagacagcagagcggctcagtgagtcccatccagatgccactgaggacctgcagagacagaaaatggagctgaatgaggcctgggaagacctgcaggggcgtacaaaggatcgtaaggagagcctaaatgaggcccagaaattctacctgttcctcagcaaggccagggatctgcagaactggatcagtagcattggtggcatggtatcatcacaggagctggccgaagacttaactggcatagagatcttgctggagagacatcaggagcaccgtgctgacatggaggcagaggctcccaccttccaggccttagaggacttcagtgcagaacttatcgacagtgggcaccatgctagccctgaaattgaaaaaaagcttcaagctgtcaagctagagagagatgatttggagaaggcttgggaaaaacgcaagaagatcctagaccagtgcctggagttgcagatgttccaggggaactgtgatcaagttgagagccggatggtggcacgtgagaattccctgaggtcagatgacaaaagttccttagacagtctggaggctttgatgaagaaacgggacgatttggacaaagcaatcactgcccaggaagggaagatcactgacctagaacattttgctgagagcctcattgctgatgaacactatgccaaagaagagattgctacgcggctccaacgtgtactagacaggtggaaggctctcaaagcacaactgattgatgagcggacaaagcttggagactatgccaacctaaaacaattctaccgagaccttgaggagctggaagaatggatcagtgagatgctgcccacagcctgtgatgaatcctacaaagacgccactaacattcagaggaaatacctgaaacaccagacctttgcacatgaagtcgatggccgatctgagcaggtgcatggcgtcatcaacctggggaactccctgattgagcgtagttgtgatggcaatgaagaggccatgaaggagcaactggaacagctgaaggaacattgggatcatctgcttgagagaacaaatgacaaagggaagaagctcaatgaggccagtcgtcaacagaggttcaacacaagcatccgggactttgagttctggctctcagaggcagagacattgctggccatgaaagatcaggccagggacttggcttcagcaggaaacctactcaagaagcatcagctattggagagagagatgttggctcgagaggtaagtagtgttggcatccctctcctctgggcagaatagaaatatttctggctcttctccctcccatgttaggagaccatttgaaaacatagccttgcaaaattgttcttagtgttctcaaccagcagtcattttaattaggtaaaattaacgggctgtgaagacattaaaactgtcactgataatcaattatccctaaactatagactttaagattccagaaagtggacctgggaaactatcttttttatcttttactgatgcatacatataagccaattgtctttaagctatatatttgatctggtatttgaaagaaagtggaagtttactttatagaattacaaacaaaa

SEQ ID NO: 76163 - DNA, 385 bp, Homo sapiens
gtaataattataactctaaaaagcagtgctgctttaaaacccactcactaaacttctaagtctattactatggtggaaccatagtataatcttttttcgtgagatggagacaatgtgccaatagaaaattaggttttttagtagtatgattctcacttcacaaacaggatactcccagacaactagcttcaattttctaaagcctaggcttgggccttggaacataattagtagtctatatatgtttccatgaaaatgaataacacttaggctgagggcagtggctcacagctgtaatcccagcactttgggtggccgaggcaggaggattgctttaggccgagagttgtagaccaacctgggcaacaaagcaagacattgtctc

SEQ ID NO: 76164 - DNA, 854 bp, Homo sapiens
cgcgagcggcgcgagcggccgctcgcgtcagcactgggaaaaccagtctatgcaccaaaaatgtctaaaactggaaccaagattactttctatgaagacaaaaattttcaaggccgtcgctatgactgtgattgcgactgtgcagatttccacacatacctaagtcgctgcaactccattaaagtggaaggaggcacctgggctgtttatgaaaggcccaactttgctgggtacatgtacatcttaccacagggagagtaccctgaataccagcgttggatgggcctcaacgaccgcctcagctcctgcagagctgttcatctgcctagtggaggccagtataagattcagatctttgagaaaggggattttagtggtcagatgtatgaaaccaccgaagattgcccttccatcatggagcaatttcacatgcgagagatccactcctgtaaggtgctggagggtgtctggattttctatgagctacccaactaccgtggcaggcagtacctcctggacaagaaggagtaccggaagcccatcgattggggtgcagcctccccagctgtccagtctttccgccgcattgtggagtaatgacatgaatggggccatattcttcctggggcccaaatgctggctggccttgtggtccaaataggcatcatcaataaaacagttggcatgcatcccactgctgactataatgcctctccttaaatgcttctagggaccagcaatacagtgctcgccacagtgggcagtcacacaaagctacccatctgccagatcaccaatctagatctttgtgccaaacaaaatgagatctcattaaaaggttagaaagtcatact

SEQ ID NO: 76165 - DNA, 693 bp, Homo sapiens
cgcgagcggcgcgagcggccgctcgcgtcagcactgggaaaaccagtctatgcaccaaaaatgtctaaaactggaaccaagattactttctatgaagacaaaaattttcaaggccgtcgctatgactgtgattgcgactgtgcagatttccacacatacctaagtcgctgcaactccattaaagtggaaggaggcacctgggctgtttatgaaaggcccaactttgctgggtacatgtacatcttaccacagggagagtaccctgaataccagcgttggatgggcctcaacgaccgcctcagctcctgcagagctgttcatctgcctagtggaggccagtataagattcagatctttgagaaaggggattttagtggtcagatgtatgaaaccaccgaagattgcccttccatcatggagcaatttcacatgcgagagatccactcctgtaaggtgctggagggtgtctggattttctatgagctacccaactaccgtggcaggcagtacctcctggacaagaaggagtaccggaagcccatcgattggggtgcagcctccccagctgtccagtctttccgccgcattgtggagtaatgacatgaatggggccatattcttcctggggcccaaatgctggctggccttgtggtccaaataggcatcatcaataaaacagttggcatgcatccc

SEQ ID NO: 76166 - DNA, 2626 bp, Homo sapiens
ccccttggaccctcagagcataccgtctgcaagagacactatcatcctgttttgccaatgaagagctgtagagaaaggttcattgccctgtccaaggtcacgtagcaagaaagcagtagtattgagacttttcttttttttcttcatccgtaaactgaggtaccatatatctaaatctgtactgtgctaagatgggaagggaactgaaacacataaagaaatttgggcaggggataaaggagaggaagtagatgatttaggggtgggaaggaaaagggacccttttagggaacaggaaagagaataattgagataaatgggaagggaagggaaagattaaggtggagggaaacaattattagtatattagtatctagatagaaagaactacccaggatagaggagaatgagattttatagctttttatgagtcattcttcgtttcttcctctcattccctccatctaattagtcaccaaatcctgaagttctttactgttttctcatcatcattcacattggagttgccttttggttggccctcatcatctctcacctggcccacagcagccatccgtttctaggcacacactactaagtccaactcactcataatcaccaaagggattccagcatgattctggtgtcatttttctggctttattttctagtacttcaccacatattcaatatgtactggacttaatgaactacttattgtccctataatgggccatgttctttcactttattcttttaaacatgtttgttccttttcatttgcctctggaaaacacctacttatccttcaatgctcagctcaaagatcctctcaagacagtatccggctctgctcctttcatctgaaatgactcacatagttttcgcccgtgaaatccataaagtaaatcagccacaaggtggcggcataatgccaggtaattaacggttcgaagcatgacacctgtggtttcagtttataacctagcattgatctgaaattccatcttaaaaaaaaaaaagatgaaaagattgtggaattattgaataacaagggacaagctctgtagctcatttgtagttttcatcgtggttttcaggaactgcttggtgaatccttgggagttcctaggaactctgtctcctgtttcagccagaaaagctctgagagttgttttaaagccagaacttccagtctgctgtagtcttcaaataggaagctgaagctcagagaggtggctggatgaagatagtaaggctaattgtagagagggagctctgtagtccagacttactgtttctgctttcacagggctgcatatttttcagtgccatcagagacttaccccaggcattgtggtagaaacttgataagcgttggaggcaaagaggattcttatcattttgttactttgcaactactctgttggcaataaactaataataaagaacatgatatgatacattttcatgtatgaaagctctacatctatctaaaataagctctgtaaagctaaggttcatgctttatttttctctatgtatcctccatatcacctaggagtcatcttcatgaaacaattattgaagtcaagtgatgggcacagaggattgatagctcaaataaggcttggtacttgcccttggaaaaagtatgctaggattctggtgggaggggtagacatataaatggataatttataatatgatgtaagtacagagagctgtgggaacataaaggaaggaaaatgaacttgagtctgagactgctcacttctattagagccctcttctgttttgcttcatgttcagccttcaggaagaactcatttctgttgttgacaactgaagttgtctgtcagaaagcaatgttgtaaggtgacgtacagctacatatttttcctcaaaattgaggtgaaaggaatttctaaagtaggcattatgttcttaatttttatctgtgaattaagccacccagctcctcagctctttctctgttggccctctacttcagattactttctatgaagacaaaaattttcaaggccgtcgctatgactgtgattgcgactgtgcagatttccacacatacctaagtcgctgcaactccattaaagtggaaggaggcacctgggctgtttatgaaaggcccaactttgctgggtacatgtacatcttaccacagggagagtaccctgaataccagcgttggatgggcctcaacgaccgcctcagctcctgcagagctgttcatctgcctagtggaggccagtataagattcagatctttgagaaaggggattttagtggtcagatgtatgaaaccaccgaagattgcccttccatcatggagcaatttcacatgcgagagatccactcctgtaaggtgctggagggtgtctggattttctatgagctacccaactaccgtggcaggcagtacctcctggacaagaaggagtaccggaagcccatcgattggggtgcagcctccccagctgtccagtctttccgccgcattgtggagtaatgacatgaatggggccatattcttcctggggcccaaatgctggctggccttgtggtccaaataggcatcatcaataaaacagttggcatgcatccc

SEQ ID NO: 76167 - DNA, 2365 bp, Homo sapiens
attaaaatgttttctgattgtcccagcagtgtctttatagtgacttttttccccaaacacaagatcatgcattgcatttagttgtcatgtaagttttgttgcgtttagaacatgtcacttctgtccagaaatagaggtagtcttctgactcttacctctcacaagctttgttgaagaaaaaggacattaggaatttcaaagaggctgcttaaaaaaaaaaagagagactcttttgttcttaatttttacaactttgtctgggttttggtttcttgactcagcaaagtctgtaatgcagccctgcttggtaagcattaaaggcggtactgaagctttcctttattttataatcccagttgttttttctagaaaccatcaatagcgtctaaatgactgactcaatttttggatcctattctcatgactaagcaaatgtttgactgaaaccagcccatataaatgtcactgtgcctctaactctctgtagccattcctgaatttctttcagcactgggaaaaccagtctatgcaccaaaaatgtctaaaactggaaccaagctcaaagatcctctcaagacagtatccggctctgctcctttcatctgaaatgactcacatagttttcgcccgtgaaatccataaagtaaatcagccacaaggtggcggcataatgccaggtaattaacggttcgaagcatgacacctgtggtttcagtttataacctagcattgatctgaaattccatcttaaaaaaaaaaaagatgaaaagattgtggaattattgaataacaagggacaagctctgtagctcatttgtagttttcatcgtggttttcaggaactgcttggtgaatccttgggagttcctaggaactctgtctcctgtttcagccagaaaagctctgagagttgttttaaagccagaacttccagtctgctgtagtcttcaaataggaagctgaagctcagagaggtggctggatgaagatagtaaggctaattgtagagagggagctctgtagtccagacttactgtttctgctttcacagggctgcatatttttcagtgccatcagagacttaccccaggcattgtggtagaaacttgataagcgttggaggcaaagaggattcttatcattttgttactttgcaactactctgttggcaataaactaataataaagaacatgatatgatacattttcatgtatgaaagctctacatctatctaaaataagctctgtaaagctaaggttcatgctttatttttctctatgtatcctccatatcacctaggagtcatcttcatgaaacaattattgaagtcaagtgatgggcacagaggattgatagctcaaataaggcttggtacttgcccttggaaaaagtatgctaggattctggtgggaggggtagacatataaatggataatttataatatgatgtaagtacagagagctgtgggaacataaaggaaggaaaatgaacttgagtctgagactgctcacttctattagagccctcttctgttttgcttcatgttcagccttcaggaagaactcatttctgttgttgacaactgaagttgtctgtcagaaagcaatgttgtaaggtgacgtacagctacatatttttcctcaaaattgaggtgaaaggaatttctaaagtaggcattatgttcttaatttttatctgtgaattaagccacccagctcctcagctctttctctgttggccctctacttcagattactttctatgaagacaaaaattttcaaggccgtcgctatgactgtgattgcgactgtgcagatttccacacatacctaagtcgctgcaactccattaaagtggaaggaggcacctgggctgtttatgaaaggcccaactttgctgggtacatgtacatcttaccacagggagagtaccctgaataccagcgttggatgggcctcaacgaccgcctcagctcctgcagagctgttcatctgcctagtggaggccagtataagattcagatctttgagaaaggggattttagtggtcagatgtatgaaaccaccgaagattgcccttccatcatggagcaatttcacatgcgagagatccactcctgtaaggtgctggagggtgtctggattttctatgagctacccaactaccgtggcaggcagtacctcctggacaagaaggagtaccggaagcccatcgattggggtgcagcctccccagctgtccagtctttccgccgcattgtggagtaatgacatgaatggggccatattcttcctggggcccaaatgctggctggccttgtggtccaaataggcatcatcaataaaacagttggcatgcatccc

SEQ ID NO: 76168 - DNA, 1289 bp, Homo sapiens
attaaaatgttttctgattgtcccagcagtgtctttatagtgacttttttccccaaacacaagatcatgcattgcatttagttgtcatgtaagttttgttgcgtttagaacatgtcacttctgtccagaaatagaggtagtcttctgactcttacctctcacaagctttgttgaagaaaaaggacattaggaatttcaaagaggctgcttaaaaaaaaaaagagagactcttttgttcttaatttttacaactttgtctgggttttggtttcttgactcagcaaagtctgtaatgcagccctgcttggtaagcattaaaggcggtactgaagctttcctttattttataatcccagttgttttttctagaaaccatcaatagcgtctaaatgactgactcaatttttggatcctattctcatgactaagcaaatgtttgactgaaaccagcccatataaatgtcactgtgcctctaactctctgtagccattcctgaatttctttcagcactgggaaaaccagtctatgcaccaaaaatgtctaaaactggaaccaagctcaaagatcctctcaagacagtatccggctctgctcctttcatctgaaatgactcacatagttttcgcccgtgaaatccataaagtaaatcagccacaaggtggcggcataatgccagattactttctatgaagacaaaaattttcaaggccgtcgctatgactgtgattgcgactgtgcagatttccacacatacctaagtcgctgcaactccattaaagtggaaggaggcacctgggctgtttatgaaaggcccaactttgctgggtacatgtacatcttaccacagggagagtaccctgaataccagcgttggatgggcctcaacgaccgcctcagctcctgcagagctgttcatctgcctagtggaggccagtataagattcagatctttgagaaaggggattttagtggtcagatgtatgaaaccaccgaagattgcccttccatcatggagcaatttcacatgcgagagatccactcctgtaaggtgctggagggtgtctggattttctatgagctacccaactaccgtggcaggcagtacctcctggacaagaaggagtaccggaagcccatcgattggggtgcagcctccccagctgtccagtctttccgccgcattgtggagtaatgacatgaatggggccatattcttcctggggcccaaatgctggctggccttgtggtccaaataggcatcatcaataaaacagttggcatgcatccc

SEQ ID NO: 76169 - DNA, 612 bp, Homo sapiens
cagattggagcaaaagattctccttgttagcttgatggaataaacagatatgttgagaaaactgaccttacaaggaactgagcatagcttttggaatctgagggtggcttccagctgataaaacagcaaaacaccaaggccttcagtcacataacctcaagaaaatgaattctgcccaaacctgaataaacttggaagcccattcttccctagtaacctcccattgagagagcatcctggccaacaccttgaaggtaacgtggggagatcctgagcagaggacccagttatgccatgcctggactactgacacacagaaacagtgagataataaatgtatattgttttaaactgctaagcttgtggtaatttgttatcagcaatagtaaactactactactatttgttattgttatataacaattatattaattatatgtttgattatattaattacataacataatatgatattatataatttataattacattatatacaatatattaaaatataattatgtattaaagaattagataacaatgtataataaatatgtaatatactacatatgatatgttatctgttataataaaattatatataatatt

SEQ ID NO: 76170 - DNA, 501 bp, Homo sapiens
gtcgcgaatggtgtcccttctgaggcactgactgaaggcagtgtagggagggtcccaataggctgaatagccgattttgcatttatagtgctaaggaaaaagatgaaagccctcagcaacctactcaagatctgttatcctttgaagacagtggaaattttcaaagttctgtgcaagacacaaatgttttacatagatatataatcctagtttatatgtataggatacacacatactcatacatatatgggattagttatgtaatctaggattgctttcagaggacatttacgataattgcagaaaacccttccgtgggaaaggatactgggagtggagtcgtcctcttgctttcaaaagacttaatgttcagttagcatataaaggacaggttttcttgttctatcccagtaagccaagcaaattcctgtgaagctagctgtttccctttcctactgcattttccccaagataaaggtatagaatgcatcacagcccttt

SEQ ID NO: 76171 - DNA, 184 bp, Homo sapiens
  misc_feature (49)..(49): n is a, c, g, or t
  misc_feature (109)..(109): n is a, c, g, or t
gcaaaatggaaccatgggcttaggggaggagaacggcacattggtgtanaaagttgcagagaggaacaaaaaggctacctgcctcgctcccaggccaagtaacacaggnaggaaagaaaatatccacatatgcgagggctaaaggaaagaggtgttctcaagctgaagcaggaggtgggactca

SEQ ID NO: 76172 - DNA, 507 bp, Homo sapiens
gccagtcagttgtgttcaaattatattcaaataaggcaaacactaacctgtaaccaatccagctgtttctgtcctcacttctgttttctgtatgtcactttcctttttctgttcataaatcttcttccaccatgtggctgcgctggagtctctgaacctactctggctcgggaggctgcctgattcatgaattgttcattgctcaattaaactcctttaaatttaattcagctgatgtttttcttttatcatgtctaaaggatatacttcagaaagaatgcaattcattcatccaacaaatatatactgagccaggcacatttctctgtgctggagatacatccgtgaacaaaatagatgaaaaaaatcttgccctaataaagcttacattttaatagtccaaataacaaagtagtggcaaaaaccacaattatttttgcaccaacctaataaattagtaaaatacatggtatgtctggtagcatgctgtgaagcctttaacaactg

SEQ ID NO: 76173 - DNA, 750 bp, Homo sapiens
acagaaaaaatgagcaacttgtataagatggcacagctgtaaaaggtagagccagcgttcaaggccaggctatctggctctgccatcggtgctcttggccgctgtgttacagtgcctataaaaggaaacatccactgaaaggagacttgaatctatgagtctctgattacaaatgatctattctaccaacttagctgaatttcttataaggcagttttaaggcattaagtgagaagtcatgtaagaaagagatttgagaaatgaataccttgttcactacagactctaagcatatttatgtttccttcttttcctgttgccctgtaagtgaagtgacggactgcaaaaaaagaggattctgggagaagcatttaattccagaccaatatctaaaccagagtgtgttaatgatatcagaaagctcctcagacacataaaagagaatcacttgagcgcctgcatattatgcactttcaaaaagacaccttcctttttaaaagtctcttcacccatgctgttttgggttggggaatgggaagcttatttaactctggcattatcatcccctgaagatcaagggtgtacaatatcaaagtctagctgttcactctgtgtgatctgaaggtccttgtttaaaaagatgctattaatgcctcttgccatactggaaccaggacagtcgaatgcaaagggcacaggatcacagtacctgtggtatagcttgtgggccttttctgttcgctcttcctc

SEQ ID NO: 76174 - DNA, 642 bp, Homo sapiens
tactactactaaattcgcggccgcgtcgatacggtgttgggcatcacgttttggcatggagcaggcactcttttctttgcccccaggtgggactaagccaccacaagccttccctggtgtgtgcagtgggtgatgaatgcttgcctgctcagcacccacttcctggtgggctgggtcacattactatgactcccccttgagcttcagtccgcgcctggttggagattattgactcaacccggggatccagaggtgggatgtagctctggcctggccagaggaccgaggatgctgcatgccatggctacagctactggttcagctttgggctcatgtcctagtcagagccaatgagatgtaatcttgggatatctgctgggctgttgggaaggggacaggctgccctgcacatccccattcctgatgctgagggatctgagaaaatcacttgtaaaatttgggggtgtttggaagaaggggagattgatgtctctttctctctacagacatctgatcagctacagagcttgactaacctacccagaggcagaatgatatggtggttaaaagtgtgctctgggccgagattttgccactgcacttcagcctgggtgacagagtgagactccatctcaaaaaaaa

SEQ ID NO: 76175 - DNA, 460 bp, Homo sapiens
cctagatgaccataacaatatctttcatcctacctctcttctagaattttaccacactccatcaagagtaaagtataatttttctcttcttgacttttaggggattgtgagtcacctgtaaccagtataatgcagcagaagagatgctgtgtggctttccagttaggacatgaaaagtgatgaaataacctctgccttgctagctgttaagttttattcttggaacctaagtcttcacataagaagctcagctactttcaggccacagtgctaggaggaagccaagctatgtggagaggcatgagtagtgggcagttctagcttttgagtcctccaagtccaggagccagaaatatgagtgaatgagcattgagatgaatctagtcccagccattgacttctcctcagactttgggttgtttcagcagatgccccttcactctccagatactgtaggagc

SEQ ID NO: 76176 - DNA, 685 bp, Homo sapiens
  misc_feature (679)..(685): n is a, c, g, or t
gaaattcatcaattagaactgcttcttgctgccgccatatgaagaaggacgtgttcgcttccccttcctccatgattgtaagtttcctgagacctcgccagccatgctgaactgttataaacatcttgagagcaaggactaaatcttacttatctttattaagaactaacagtggaacacacagaaaatccatggatatactgtcagactgtcaccaaatatacattcaacatttttcttacttgtgagactgattttgagaaaatttgctatcacagaatcactaaactttagagcaggtaaagactcctgcaatgattttatttacttgctatattttaccaataagaaaaccgaggcatagagaagttgagactttctacacaccagtgcctagtcttcatgatgcttatgcccaaccctgagtcctttcctctatataatcctgcctcattacatttctgaaagacggagaagttttataacaacaagatgaaagactttggaagtttacagaggctatcaggctatcttctcatagacccatcatttgtccagcagaaagagactaaaaaggcttataagaatatcaagaccccaatgttgtacttatggtttgactttatatctctgactaattacagaatttgattattaaaaaaggttttttatatcaaannnnnnn

SEQ ID NO: 76177 - DNA, 542 bp, Homo sapiens
ggcacgagcgccccaagtggctggaatcccacctgctactatcactgtgaattataagagcatctgtgttgtcatttgcatttgcagtgttcccaaacattttcagtctctaacttgaacctaccaactctcttccaatttgctcattgacattcccagcccaaatgcgtttttatatttgcctatgcacactaatcatcacggctaaactttccattgtggacattgcttgatagtttgaaaaacagatttgcacatgttattcatttaatccacacaggaaccttaggtacatgagtattgctatgcccattttacagatgagggtagtaaggcaaagaggttgaatgacttcccccaaggctacacctgatgagaggcagaactgagaactgaatgtacacctttcttgactccaaagcttgcttttagatcatgctgttctttacctgagggttgctctattgtttcaccagcagcaagacacatgctttaagtagtttttgcaaaaacaatgatctgtttgagccaagtcatctgta

SEQ ID NO: 76178 - DNA, 428 bp, Homo sapiens
aagcagtttgattaagataagaccttgtatagttttctcttttacatattgttctactttatttagtttcttgcatctgcatgcttatagttctcatcaaatttgaataataatgacatacatagtcttacctatggcatatacaatatattatatttggcatatatacatcaaatatatataatgtatattctattctttctctctatcttctccttcaaagactccagttatatttatattagctgctttgaaattttaccacagctgactaatggtctgttcatttttgttgtatcttttctttctctctgtttctttctatttccatgtcttggaattgattaatctttcttcagcagcatctaatctgctgttaatcctatccagtgtattttcatctcagactttatttttcatctaaattt

SEQ ID NO: 76179 - DNA, 587 bp, Homo sapiens
ttgatggtcacaagagaagtgctattggcatacaggcaatagaggctaaggatgctgctaaccatctgaaaacaggaaagccccctacaacaaagaattgtctggacaaaatgtcaatagtgtcagtgctccagaggcttgtatcatcaagttttttttttttttttagccaggagacacttgataagtaatatcctgttcttctattcagatacatacctgtctgtttcattttcactgctgtcactttacctgctcttgggctcttgattcctaatagaccctatccacaagctccagagacatgagggacactggccaagtgcaaaactttatttctggataaagcgcttgtgtcctatcctggtgaacccaattacacttcaacatttattgaccatccacaacgtgcaggatacaacagcccaggagaagatgcagagcctatgaggaaacaaaggcaagtagtctagagactgggcaaactagaaagaaacctcttgtcactgcataccctaaccatggaacaagcaagatgacaacctcctctttctttactattcctccccacctagccaaatatccca

SEQ ID NO: 76180 - DNA, 747 bp, Homo sapiens
tcccatatacctgcctccaagtgtggtacagagaacttgggcctgctgggggcgcttagccttactctctccaccacctctcccaccaacccccagatgaactgcaggtagacgtttcttccttgcttggagccccagtttttgcatttcattttcattaaaatgaaaggtggtttggttttggttctaaggagctctacagtttaacagagagagggaccttaggggccaagaaagcaggggcctaccaagtatctccacttttgaaaattgtaattactgataaaaaattttttaaaggcaggtttattgaagcataatttataaacaataaaatttactctttttagtgtatagttctttgggctttgacaaaaacatacaattgtgccactaccacattccagacattgaacatcttcaccaccacccagaattcctttgtgctctcttgtggttaacccctcctcaaccccagtccgtggaaaccactggtttgttttctatcctctatccatcacctcaccatttccagaaatagtgtgcagctgtttgcacgtggctgcttttactgaacatgatgcattggagtcatccatattgcctgtgtagagtgcttttttgcaccgagtagcattccattgtatggatggagccatttgtttatccgttcacccatggcagggtatttgggcattttcagtatgggcaactatgattaaagctgccatcactgtgtatcaacta

SEQ ID NO: 76181 - DNA, 563 bp, Homo sapiens
taaaaaagaatgtttttctgaatcttagggcatacagccacttttaccatttttatttgaatttgagttcaggtaaacttaggcaaatagaaaagtgggagagggtgggaagagacaaggtgagcctgcttttcccaatactgggaaaatgaattaaactagacgggggacgtcagagaacagaatgccttgcctttggtctgctttttaatatattttatgatcccaaattttacagaaagtctcaagggtttctgtgttttttaaatggtcaaatatgtgacatacatgtgtacatagatcacagagccccactgtagttttttaaatgagccacatttaccttggggaagagcccctccccccccgccatcataatattgtgaatgtaaagagagattggttcacaatgagaatgtacagtaggctcctataagggtgacaggattatatgcagaatgactttgaagagccaaaattgatttatttatgttaagtagtgctaagaaggaatatttgtcccggagtgaggcatttgagatagagggggaaaagcaaaaaaa

SEQ ID NO: 76182 - DNA, 371 bp, Homo sapiens
tcgaacaattcagctcggtacccctccataatggtgcctagaacacataattgtttaataaatgttagctattgtgatttggcttcacaataactgttaggtaaacagtgccaatattagtattttattgataaggaagccaaggatcaaaaagactcagtgactttccctctgtcgtatgctgacaacaatgactttactattccatgctcatactcttcctaaaattctctatgccttaaggatccactataaagaacagagagaaactaaaataggccaggagcctgtaatcccagcactttggaatgccaagatgggtgatagattgagcctagaggttcgagaccagcctgggcaacatggtgaaa

SEQ ID NO: 76183 - DNA, 379 bp, Homo sapiens
ctgaaattaaagttaataaagcatgcaaagctcttaacatggtgcctagaacacataattgtttaataaatgttagctattgtgatttggcttcacaataactgttaggtaaacagtgccaatattagtattttattgataaggaagccaaggatcaaaaagactcagtgactttccctctgtcgtatgctgacaacaatgactttactattccatgctcatactcttcctaaaattctctatgccttaaggatccactataaagaacagagagaaactaaaataggccaggagcctgtaatcccagcactttggaatgccaagatgggtgatagattgagcctagaggttcgagaccagcctgggcaacatggtgaaa

SEQ ID NO: 76184 - DNA, 525 bp, Homo sapiens
taaaaaaaaaaaaaaaaaagagacaagtttctccctaatctgtgcatgccaaaaatggcaaagaagcaggaagcctccacagacctctgtgaggccagggcaggtgtgtaacaggcaccagcgccttggtgggtcatggttctgctcacctgttcctgggagaaggaaaaacccttttactggtgagaacactgagactcagagtgtacttgccctgatcacctatctagaaggtggcagaaagggcctttgcatgcaagcctgtctgaatctgaagcagatcctttcccattgcagtggaggtgttctttcagaaccaaagacttcttgtacttcctcccctacctacctatacaggagtgggaggcagggcctgccagccgcagggtgatctttgtgtctcttggtgtagagcataagtgtactttactgggggcagaacagagcatgccctattccaacaggaccacaagtgtcaggcaactgaaggctgggtgtatctgcagtcatctccatgccgagtca

SEQ ID NO: 76185 - DNA, 409 bp, Homo sapiens
ttggtaatatataatttatatgaaccttataaagtagatttctctcccctttctttacaggggttgaagggggagttccttaagcttttctacttttgacagctttagtgaactccaagtgattcgttatcaacttagagcactttaatgtagcccatttacagtgagacccatccatgactgcacgtcatatacagtaaccactaactgcaggtggctactgaggacttgaaatgcagctaatcctaactgagatgtgctgcaggtgtaaaacacacaacagatttctaagaattactgtccaaagaaagaatataaactctttgcaatgatattaataattaattttgttattacacgttgaaatattttggatatattgggttaaataaaatatattataaaaatt

SEQ ID NO: 76186 - DNA, 2305 bp, Homo sapiens
caaccctgaatgtcatagttagctactttcaactggaagctacaacatggatttatggaatctgtcttggtttctgttcttggatgctcttctcgtgatttctggcttggcaactccagaaaactttgatgtagatggcggaatggaccaggacatatttgatatcaatgaaggtttgggactggatctttttgagggtgacatcagacttgatagggcacaaattagaaattccatcattggagaaaagtatagatggcctcataccattccatatgttctagaagatagcttggaaatgaatgctaagggagttatcctcaatgcatttgaacgttatcgccttaaaacatgtattgactttaagccttgggctggagaaacaaactatatatcagtgttcaagggcagtggctgctggtcttcagtaggaaataggcgggttgggaagcaagaactttccatcggggcaaactgtgaccgaatagcaacagttcaacacgagttcctccacgctctgggattctggcatgagcagtcgcgttctgaccgggatgactatgtcaggataatgtgggacagaattctgtcaggcagagagcacaattttaacacctatagtgacgatatatcagattccctgaatgttccctatgattacacttcagtaatgcactacagtaaaactgcattccaaaatggaacagagccgacaattgtcacaagaatctcagactttgaggatgtgatcggccaacgaatggatttcagtgactctgatctcctaaagttgaatcaactgtataactgctcctcttccttgagttttatggactcatgcagttttgaactggaaaatgtgtgtggcatgatccaaagttcaggagataatgctgactggcaacgggtttcacaggttcccagggggccagagagtgatcactccaacatgggccagtgccaaggttctggtttcttcatgcatttcgatagcagctctgtaaatgtgggggccacagcagtgctggaaagtagaacgctgtaccctaaaagaggatttcagtgcctgcaattttacttatataacagtggcagtgaaagtgatcaactgaacatctatatcagggagtattctgcagacaatgtggatggcaatttaacccttgtggaagaaataaaagaaatacccactgggagctggcaactttatcatgtaacattgaaagtgaccaagaagtttagagtggtgtttgaaggacgcaaaggctctggtgcatcactgggtggtctgtctattgatgacatcaatctttcggaaacacggtgccctcatcatatctggcatataaggaatttcacacagttcattggcagcccaaatggaactctgtatagccctccattttactcttctaaaggttatgcctttcagatttacttaaatctagcccatgtgactaatgcagggatatatttccacttgatctctggagccaatgatgatcaattacagtggccatgtccttggcaacaagccacaatgacacttttggatcaaaatcctgacattcgacagcgtatgtccaatcagcggagtataactacagacccatttatgaccaccgataatggaaactatttctgggacaggccttctaaagtgggaacagtggctttgttctctaatggaactcagtttagaagaggtgggggctatggaaccagtgcctttataacccacgaaaggctgaaaagcagagattttataaaaggagatgatgtttatatcctactgacagtggaagacatatctcacctcaactctacacaaatccagctaacaccagcccctagtgttcaagacctctgctcaaaaaccacctgtaaaaatgacggtgtctgcactgttcgagatggcaaagctgagtgcaggtgccagtcaggggaagactggtggtacatgggagaaaggtgtgaaaagagaggctccacccgagacaccatagtcattgctgtttcatctactgttgctgtgtttgccttgatgctgatcatcacccttgtcagtgtctattgcaccaggaagaaatatcgtgaaaggatgagctcaaatcgaccaaatttgactctgcaaaatcatgctttttgaagattaactcgacaatatggccagctaatgaaattaaaaaggattcttcatcatggatttcgcctaagtgatattacagccacctcattcttctaaaagtggatatttttctgtaaatagctggaaatattataaatcactattttggtcaaagtc

SEQ ID NO: 76187 - DNA, 477 bp, Homo sapiens
ctgcgagttcgattacttgcggaagaggagaaaatcccagactttgagtccggtcaccagcagctcagtcgcatctcagagctgcctgagaaagaggatgccctggtacctctcagtcatccacgagaaggtactggcggagggggtgcaaatcccggccccccacccctctctctgcgtccggctgggaggacagccctgctccctgacaggctctggttctagtatctggttagctgcatcaagcaggtccccatggcctaaaatgacctccagaccccctgctttgacaaagctcctcacccctgtccatcctcaccccagtgggtggcagttacgccggcatggaactcagactcaccggcacgcatgacttccaaccgtccacacatctttgcacccacagtatctgcttcagagaatgtattctaaataataaaaatcataacaggaataaccagcttgatttatgcacaa

SEQ ID NO: 76188 - DNA, 550 bp, Homo sapiens
ccctcagtttctcattatccctctgcctagtgtcaatacgatttaatcataatcatcccactccaccgtccttgtaggtgttgttactctcagacctttccagtgtttgaatcatctcactggcaagggcattcatctccaccaggcttttccccaagttaccaacagtgtaatcattagcaatgagtccatgactttgggccaggcaccctccttgccccacatttcaccctgtatgtggctcttccttccagctgggcagtgagtgatgaggatcccaaaaactcatctcagtctatgtccttgctatgtatgtacaaaaatgagaaatgtaaattgtgtttaaaaaccttatctcattacatactttctcaaaccactctttgagtgtcatttttgggtcctccaagaagctgagataaaaatggaatttgatgtgcaagatatttactgcggaaagtacctgaggatgatcaagaggagaggagaggagaaggaagagaagtaggcagagagagccttctgatcactaggtgagtctgacatcaca

SEQ ID NO: 76189 - DNA, 1321 bp, Homo sapiens
aattgcagtttttcccattattttaattgcgaaaacagcaattacctttgcaccaacctgatggagtcccccttgccatgcttctctctgtgaaaaaccccaagccgaagtcagcataacatccacaggactctatgtttgcaaaagccagcttagctatattacatgtataagcacattttttcaatgagtcagccttagcttactgtaactttttaactttataaacttagtattttaactttttaaacttttttgttgaaaactaagacacaaaaacacatgttagcctagatccacacagggtcagggtcatcagtatcactgtcttccacctccacattttgtctctctggaaggtcttcaggggcaataacacacatggagctgtcatcgcctgtggtaacaatgccttctacagtacttcccaaagggcctgctagttcacttaattcttttatagagagaaggagtacactctaaaacactgatcaatagtatattatagtaaatacataaaccaggaacacatttattatcattatcacgtattgtgtattgtacagaatggtgtgtgctgtgctatccaggaacacatttattatcattatcaagtattgtgtactgtacagaatggtgtgcgctgtgcttttatgcaagtggcagcacagtagctttacacgagcatcactagacacatgagtagcattgcactcggcaacaggaattttttcaggcccattattataatcttatgggaccgcatcctatatgcagtttgtcattgaccaaaatgtccttatgcgatgcatgactatatttgcaaaggactagtatctagaatacatttaaaagtcttaaaatagtaacaaaacaaagaatgcaattagaacatgagcaaaagatacaaagcaacatttcactggagaagatatacagattgcaaataagcacatgaaaagatgtttgataccattagggaaacgcttctttaaaccaggagatatcaccacgtgttagaatcaacaaaataaggccaggcatggtggctcacacctgtaatcccaacactttgggaggctggggcaggcagatcacatgagatcaggaattcaagaccaacctggccaacatggcaaaaccctgtctctgctgaaaacacaaaaattagccaggtgtggtggcacacgcctgtagtcctagcaccttgggaggctgaggcaagataattgcttaaacccaggagacggaggttgcagtaagctgagatcatgccactgcgctccagcctgggcgacagagcaagattatgtctcaaaaa

SEQ ID NO: 76190 - DNA, 1039 bp, Homo sapiens
aattgcagtttttcccattattttaattgcgaaaacagcaattacctttgcaccaacctgatggagtcccccttgccatgcttctctctgtgaaaaaccccaagccgaagtcagcataacatccacaggactctatgtttgcaaaagccagcttagctatattacatgtataagcacattttttcaatgagtcagccttagcttactgtaactttttaactttataaacttagtattttaactttttaaacttttttgttgaaaactaagacacaaaaacacatgttagcctagatccacacagggtcagggtcatcagtatcactgtcttccacctccacattttgtctctctggaaggtcttcaggggcaataacacacatggagctgtcatcgcctgtggtaacaatgccttctacagtacttcccaaagggcctgctagttcacttaattcttttatagagagaaggagtacactctaaaacactgatcaatagtatattatagtaaatacataaaccaggaacacatttattatcattatcacgtattgtgtattgtacagaatggtgtgtgctgtgctatccaggaacacatttattatcattatcaagtattgtgtactgtacagaatggtgtgcgctgtgcttttatgcaagtggcagcacagtagctttacacgagcatcactagacacatgagtagcattgcactcggcaacaggaattttttcaggcccattattataatcttatgggaccgcatcctatatgcagtttgtcattgaccaaaatgtccttatgcgatgcatgactatatttgcaaaggactagtatctagaatacatttaaaagtcttaaaatagtaacaaaacaaagaatgcaattagaacatgagcaaaagatacaaagcaacatttcactggagaagatatacagattgcaaataagcacatgaaaagatgtttgataccattagggaaacgcttctttaaaccaggagatatcaccacggtgtataacggggggcctctagagt

SEQ ID NO: 76191 - DNA, 863 bp, Homo sapiens
actgatcaatagtatattatagtaaatacataaaccagtaacacatttattatcattatcaagtattatgtactgtacagaatggtgtgtgctgtgctatccaggaacacatttattatcattatcaagtattgtgtactgtacagaatgatgtgtgctgtgctatccaggaacacatttattatcattatcaagtattgtgtactgtacagaatgatgtgcgctgtgctatccaggaacacatttattatcattatcaagtattgtgtactgtacagaatggtgtgcgctgtgctatccaggaacacatttattatcattatcaagtattgtgtactgtacagaatggtgtgcgctgtgctatccagggaacacatttattatcattatcacgtattgtgtattgtacagaatggtgtgtgctgtgctatccaggaacacatttattatcattatcaagtattgtgtactgtacagaatggtgtgcgctgtgcttttatgcaagtggcagcacagtagctttacacgagcatcactagacacatgagtagcattgcactcggcaacaggaattttttcaggcccattattataatcttatgggaccgcatcctatatgcagtttgtcattgaccaaaatgtccttatgcgatgcatgactatatttgcaaaggactagtatctagaatacatttaaaagtcttaaaatagtaacaaaacaaagaatgcaattagaacatgagcaaaagatacaaagcaacatttcactggagaagatatacagattgcaaataagcacatgaaaagatgtttgataccattagggaaacgcttctttaaaccaggagatatcaccacgtgtt

SEQ ID NO: 76192 - DNA, 477 bp, Homo sapiens
cattttttattttttaaatgttgatttttttatgagtagttgctgtgtgggatctggatataaagattaaattctcatcagagagggagtgagtgatacattatgttctttgctgaaagaccatgtgtctcggaggctgaagcaaaggaaataaacacactctcctggtgtttatggggtttcctcattgttccctgatataattcagtttaagagttggtgacagaagcagatgccctatattcatgggatgttccatctcacttcatgacttactggaatcctaatttttaaaattttcacagtggaattaagacataatggatgactctagccagacatgctgacacatgcctgtagtccagctgcttcagaggctgaggcaagaggatcatgagcccaggaggtcaaggctgcagtgagctgtgatggcaccactgcatcccagcctgggtgatagagtgagacactgcctca

SEQ ID NO: 76193 - DNA, 405 bp, Homo sapiens
ctacctaaattcgcggccgcgtcgaccattatgttctttgctgaaagaccatgtgtctcggaggctgaagcaaaggaaataaacacactctcctggtgtttatggggtttcctcattgttccctgatataattcagtttaagagttggtgacagaagcagatgccctatattcatgggatgttccatctcacttcatgacttactggaatcctaatttttaaaattttcacagtggaattaagacataatggatgactctagccagacatgctgacacatgcctgtagtccagctgcttcagaggctgaggcaagaggatcatgagcccaggaggtcaaggctgcagtgagctgtgatggcaccactgcatcccagcctgggtgatagagtgagacactgcctca

SEQ ID NO: 76194 - DNA, 869 bp, Homo sapiens
aactatcacctctctaatttaaaatgcatgaaaattaatactttgtttttgttttttttttggaaacagtctcactctgtcacccaggctggagggcacaatctctgctcactgcaacctccacctcctgggctcaagcctcaagcaattctcctgcctcagcctcccaagtagctgggattacaggaacccaccaccacgcccagctaatttttgtatttttagtagatggggtttcatcatgttggccaggctggttttgaactcctgacttcaaatgatccacccacatccacctgccagagtgctgagattacaggcgtgagccaccgcacctggccaatgttcttttatatactcatgttttctaacaaaacagctttggatttataatgctgccagatgtcattacaattttttttctaaattcaaaggtaattattctaaacaataaaagggcacctggaattttcagaacattaaaaaactgaaaccacttagaagaaaagaagaaacctaaatgtctgtggaagtgatcagtattaagtgggtgatggctctttcatcttccttatccctaaagatacttccaacatattgttagagtaagtattaaaagaaaaagtaggtttgctgaaaaacattactaaatgacttggagctctccagtcaaagaaacaaagctaattgaaataatgtacatttggttcagtctgtcaggcaagtacaaatccataacaaaaaaaattaatagtatgctctttgctttggaatctctaatttacggtcatgccctaagtcacaggatgattattagggaaatgtcattgacacctgaaaattacctatcctgtaaaaagactggtgaa

SEQ ID NO: 76195 - DNA, 451 bp, Homo sapiens
cattgtgattgatcttgtaatgaacgtcagaattcattctacaccatccctgaatattgttcctgactctggtacttagtaatatttaggtacttcatcaatatttgttgcatagatgaatatcttttattaatgacaaagatactagcaataagtaaattagaaattatgaaaaaaaaaccaacctgaataatcaattcagattcattaaattgggtgcaagacatagagtgactggtaattttgctgcagcaaaaaaattaaattgacatagacaaagatgctagtttgtatgaatgccattttactagtgaaagcagctaacaaattgtgcagagtctgcatctcaacaaggtttcatattatccattcaatttcatacatgcaataacacaaatgtatttttgtgagaaaaatgttaagtccggagaaaaaaaaagaaatctgtaaa

SEQ ID NO: 76196 - DNA, 405 bp, Homo sapiens
aattgcattgtaatctcaccatgtaaacatggatttggggtgaaataagaaactttaaaatgatcctcccttagagattgttgttatattgtccctaaacttaatgaaaacaattttaaactttagagtactaagaatgcaaatgctgggattacaggtgcgagccactgcgcctggctgattcttcagtctttcttatgaatacattttctgcattgaaatcattttgtgtctttcagtggcaccagcctgtcagcttcgggagtatgtgcctgtaggcttcttgggctccaaaatccttgggaggagtggtctctcagttgtcgatcagtgtttatcacataagtcatcttgtatgttgtccaccaagaacttcaaataaattttctgattgaaaaagtacca

SEQ ID NO: 76197 - DNA, 429 bp, Homo sapiens
aattgcattgtaatctcaccatgtaaacatggatttggggtgaaataagaaactttaaaatgatcctcccttagagattgttgttatattgtccctaaacttaatgaaaacaattttaaactttagagtactaagaatgcaaagtacagaaagtagggcccgatgtgtgctgggattacaggtgcgagccactgcgcctggctgattcttcagtctttcttatgaatacattttctgcattgaaatcattttgtgtctttcagtggcaccagcctgtcagcttcgggagtatgtgcctgtaggcttcttgggctccaaaatccttgggaggagtggtctctcagttgtcgatcagtgtttatcacataagtcatcttgtatgttgtccaccaagaacttcaaataaattttctgattgaaaaagtacca

SEQ ID NO: 76198 - DNA, 615 bp, Homo sapiens
gatccattgagtaaaacaggatattggaaaataatcgtgacgttgttctaaatcctggttctgcacagtatcaagtaaataaccaagttttctggttttagatgagtgattgttaggttaactccctgactgtccttcgtacagcctgcatttgatcttcctatttcatactttacccaggtacttgattaaacatgggatctttgaactgagatccagcaatatctatcacattgtaaggtttttctcttcatgtatattgattgcagagtactttccacaaaccagaacaaactgtatttgaaaaaaagatttgtcacctttatccctggaaaggagagagggagacagtattggccacggcacagcagataaacatgtttattgttatggttcttcaggttgccatgggtgaaccaatgcacataaaacctgtagcacacatcaggaaatgttgtcattattatagtgtcttgtatctgataacaccgctttttaaaatgtgtttaaaagtcattagctagaaagtgttttaaaactcttgctataattagatagtaaatgcctgtgggtgcataattgcagtgctgggtaatagactgacttgagatagct

SEQ ID NO: 76199 - DNA, 274 bp, Homo sapiens
atagaagttacattaaatctgaggtatgttgttttaatttgcatttaaaaaataaataatggggctaacttttttcaaatgtttgttaacagttttagtttcttctgcaaattcatatcatttctgtaagccaggaaatccctgacaccctcctgtcaagctaaaaaacaagaaacacaatagagctgggcatggtggctcatgcatgtaatctcagtactttgggaagccgaggtgggaggatcacttgagcctaggagttcgagaccagcct

SEQ ID NO: 76200 - DNA, 1038 bp, Homo sapiens
agctgggactagagggatgcgccaccaggcctggctaatttttgtatttttagtagagatggggtttcaccatgttggccaggctggtctcgaactcctgaaatattatcccccccattccccagtttttttagataactcgtttttagtgtgacttcagaagagactgggcatgacacagattattttttgtagcttttttgtgtaggtgggtgattggtgtaaggtttaggagaacaaaaaaggacaggtaaatcaatattaacagggagctcggtacccctgcttctagaatttgaccaacaaagtgaaatttacaagtagtttgctggtttattatcaaattaacctgtgtttactaatgggtagtgtcatgtagctttgatctcaattctcaaaacggttttgtagactctggttggaatcccactttttctcaagtaatgagctttctaggtctgttgttctgaatcagattttgataccttttggtttagtaggtgtctgctaccaggtgagttaatttctcttccttgggtcctgggtttccttttttgtctgtttctttcctaaccttcgatgtgtatagggttgcaagtcatgtaagcataatactctttacatcctgggatagtatttgcttctttgtacttggttgtgcacagttgagaatacagtgtgggtgtggaacacctgtccaggtgcccagttcatgcctgacagttttgaaaggtagtctcattagaatccagttattaagcctgtctgttgtatacatgagaaactaatttagtctctgcttttactattttagtgcttgggaaagtttctttttgtaattaagactagtactttaaacgtatgtttagggcctttgaggtattaggaattttggaaactggaaagatacaatctttctatcacagtatttgtgttgatcctgaaatgtctgagtttattttgtttggagtgagtttaacctgaaatgtcaaaacctagatccataatatagcatcacatctcaataaatttatttgg

SEQ ID NO: 76201 - DNA, 709 bp, Homo sapiens
agcgggaaagatccaaggctgtgagcaaacactggacaaatacctgagtccagaagactgcctcagtggctcatactggcatacctcccagcaggtatctgcatgggtcggatagattcctgactgcaatgagacgggttggggttgagactgagacccctcagaatatgctgtggaaatgaggttggtggaactgttttattggcccagattgttaggtaccacccagcaggttcctgcaaaagctggataggtagattcttgattgcaacaggggaggccagagctgggactggtgcctcttggaatctgctgtgggatggagattggtgagcctatcagggtggctcagattcccgggctgcaagatataggtgagactccctttggatgcttgtgcaggtagctatgagcagggagctcagctgagggcacactggagctgagtcacaaggcaactttcaagttttttcctgtgactgctaccaatggacagagaagcctttctgccaaggcactagtgtgtgtgattctttctggactctttggcagatggttttggttgcaggttcaaggcaaacaggcttctagccattccccttagagaactaggctgcttctgagcttcagcctgggagcaagcttggaggattagtgactcaagtattggtctgcattctcaaaatgatccttcaaggacttggattcc

SEQ ID NO: 76202 - DNA, 2111 bp, Homo sapiens
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctc

SEQ ID NO: 76203 - DNA, 881 bp, Homo sapiens
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcaggacacagatgcgcagcctggggtgagctgctacactgtgagtgggaccgagcc

SEQ ID NO: 76204 - DNA, 418 bp, Homo sapiens
atagatcgagtcgtaccagatcccctttccatccctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacacctccccggccctaccagcgcccgctgggctgagcccctaccccacaccaggccgtcctcccgggccctcccttggaaacctgccctgcctgagggcccctagccccagctgacatggaaatacagttgttggcctccggcctcccctc

SEQ ID NO: 76205 - DNA, 187 bp, Homo sapiens
  misc_feature (65)..(65): n is a, c, g, or t
tcgcgggggactctagagagatcccccgggcgccgctagaggcctgaggatgagctggaaggagngagagggggattgggggctggtgccagccttcctctgcagctgacctctgttgtcctccccttgggcggctgagagccccagctgacatggaaatacagttgttggcctccggcctcccctc

SEQ ID NO: 76206 - DNA, 300 bp, Homo sapiens
ctagaaaagtccctgaaaaaaagaattgttaagaagtataataaccttgtcaaaacccacaatgcagcttagttttcctttatttatttgtggtcatgaagactatccccatttctccataaaatcctccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgagtccctctgggg

SEQ ID NO: 76207 - DNA, 2061 bp, Homo sapiens
taggtcgaggccgggtgtgaatcggccgagggcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctc

SEQ ID NO: 76208 - DNA, 2631 bp, Homo sapiens
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctcaaaaaaaaaaaaaaaaaaaaaaaaaaaaaaaaaaaaaaaaaaaaaaaaaaaaaagggggggggcaaaaaaatcccccggggggcccaagccaactatgcgcccccaccacgagtctttgtgcgagaaacgaggggcgccccataaaaatgggaggcgctatatattaaaaatccagccagagcgagagaggggccggctagataaaaccacacacggccggcgcaggacgccgggagaaaaacagccgggcaagaggaggcaacatctggggggggagaaggagaccccacaaacctaccgggggcggggcgagagacacgaaaatgaggggacggaacacatcaccccagcgcaagagaaataaaggacccgctcacgcaaggggaacaaaccaaaacccagtagcgcgcagagaagatgcgtgcgtgggcacccacaccgacgcggtaatcggccgcgcgggactgaaaaaatgtgcccgcccgaggaatgatagtcacgagcaacaaattacccgcg

SEQ ID NO: 76209 - DNA, 2194 bp, Homo sapiens
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctcgatatacaaaggtgtcaaatcggtaccttgaaggtaaatgcggaaaatccgaaaaaatacaggatggagccagtcggcatccg

SEQ ID NO: 76210 - DNA, 2131 bp, Homo sapiens
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctcaaaaaaaaaaaaaaaaaaaa

SEQ ID NO: 76211 - DNA, 2584 bp, Homo sapiens
  misc_feature (2113)..(2113): n is a, c, g, or t
  misc_feature (2118)..(2118): n is a, c, g, or t
  misc_feature (2136)..(2136): n is a, c, g, or t
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctcanaaaanaaacaactacacccccgnagcgtccccgacgttacgctcatgctccatcgcgccacgcatcgcgcggacggaccccgccgaacctctcataatacaaaacacttgggggggccccgtgcccatttgcgcgccgcgccgcgccgatacatattagtgcccgtgctaacaacttgggacgggaaaacctgggttccccagtaaccgctgggagacatcctctcccatgggctaatacaaacgggccacccgacgcctttccaaactcgcaactcaatgggaacggcattgcagcgcaaattttgtgaaaacggctgaaccttggaaaccactccttctaacacagggccaatcgggcacctctttaacaaaactcgggcgaaaccgcttacggggggcctctctgccctccctcaacctttggcggggcgccaaacactaccgctcagaggcgcccttagtccgggct

SEQ ID NO: 76212 - DNA, 1973 bp, Homo sapiens
  misc_feature (15)..(15): n is a, c, g, or t
tgaggctgtgcagtngtgaggctggaatttgggatctggaggctagagccatcggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctc

SEQ ID NO: 76213 - DNA, 1951 bp, Homo sapiens
ggcccattttgacccaaaaccaaaaaaaatgcgatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctc

SEQ ID NO: 76214 - DNA, 1960 bp, Homo sapiens
tcggtaccccttgaataggagctcctattcaagggtccgctgatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctc

SEQ ID NO: 76215 - DNA, 2458 bp, Homo sapiens
  misc_feature (1987)..(1987): n is a, c, g, or t
  misc_feature (1992)..(1992): n is a, c, g, or t
  misc_feature (2010)..(2010): n is a, c, g, or t
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctcanaaaanaaacaactacacccccgnagcgtccccgacgttacgctcatgctccatcgcgccacgcatcgcgcggacggaccccgccgaacctctcataatacaaaacacttgggggggccccgtgcccatttgcgcgccgcgccgcgccgatacatattagtgcccgtgctaacaacttgggacgggaaaacctgggttccccagtaaccgctgggagacatcctctcccatgggctaatacaaacgggccacccgacgcctttccaaactcgcaactcaatgggaacggcattgcagcgcaaattttgtgaaaacggctgaaccttggaaaccactccttctaacacagggccaatcgggcacctctttaacaaaactcgggcgaaaccgcttacggggggcctctctgccctccctcaacctttggcggggcgccaaacactaccgctcagaggcgcccttagtccgggct

SEQ ID NO: 76216 - DNA, 2157 bp, Homo sapiens
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcaggacccagatgcgcagcctgggggtgagctgatgctgggtggcacagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctc

SEQ ID NO: 76217 - DNA, 1763 bp, Homo sapiens
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtccattcaacgcctccgcggaggcgttgaatggcttgggatgggacatcccggaggcctcgcaacggc

SEQ ID NO: 76218 - DNA, 1758 bp, Homo sapiens
atacgaatcgagcctataccagatatgcagagaccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctc

SEQ ID NO: 76219 - DNA, 1582 bp, Homo sapiens
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggtgcggccgtggaccctcaagagacagccatgacgatgg

SEQ ID NO: 76220 - DNA, 1493 bp, Homo sapiens
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacatccgtactgcccgggatcctctagatcacccagcaa

SEQ ID NO: 76221 - DNA, 1485 bp, Homo sapiens
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcctgcaataaaatagtagcatcggca

SEQ ID NO: 76222 - DNA, 1745 bp, Homo sapiens
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgc

SEQ ID NO: 76223 - DNA, 5072 bp, Homo sapiens
  misc_feature (2337)..(2337): n is a, c, g, or t
  misc_feature (4552)..(4552): n is a, c, g, or t
  misc_feature (5047)..(5048): n is a, c, g, or t
  misc_feature (5072)..(5072): n is a, c, g, or t
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggcccagggccccggccagtgcccagccccgctgggagacccggccagcaccacggacggcgcccaggaagcccgagtccccctggacggggccttctggattccgaggcccccggcaggttcgcccaagggctgcttcgcttgcgtgtccaagccccctgccctgcaggctccggcggcccctgcccctgagccctcggcctctcccccgatggcgcccacactgttccccatggagtccaagagcagcaagaccgacagcgtgcgggctgccggcgcgccccctgcctgcaagcacctagccgagaagaagacgatgaccaaccccacgaccgtcatcgaggtctacccggacaccaccgaggtgaacgactattacctgtggtccatcttcaacttcgtctacctcaacttctgctgcctgggcttcatcgccttggcctactccctcaaagtgcgagacaagaagcttctcaatgacctgaatggagccgtggaggatgcaaagacggcccggctgttcaacatcaccagttctgccctggcagcctcctgcatcatcctcgtcttcatcttcctgcggtaccccctcaccgactactaaggcccgccaggcacggctgctggcggagacaagcactgagacatgtttattctcatggtccctgaaacgcaggatcccatgaggttggggcagggcagggcttcttgtcctggggcccccttgagctgtgaactgggcagcaaggccatcagaagctgagtacagcaagggggcagtgagcttggccctcagtccaccccctccgcctcctggcctccaccctgcctgtgtctggggcctgggggcttctcccctcgctgctgcaccctggcttccagcgtctgtgtccctgccctcacgtgccccttcccaggctcctggggccccttggacctgacacctagcaggaagggcttatgcaaaattgtcccaggttgggaggactcactctgtgctccccgaccctgcctcctccacgatgtgaccccgctcagagcccttgtgtctgtgaactttcaatgaaatacccatgcagctccagcccagccttctactttgtgtccctggcagggcctggagaagtctggaggctttgcaancctccctcaggaactgcctggcggtcagggccccgggtgctgtgtcccaacagactgcaggggacggtctgctccatcacagctgtgccagacagtgaatgggaagggggggcatttggtggaggtaccccaaactcgagtcacttagagggtcaggcagcctcctggggggacggaagggggtggggcacagcctcagctgcctgcattggccaaatcagagcaaaggaaaccacaaattcactcggaaggaagcagcaggcagagacgatagacgcctggctaacccctgtccctcctggagggctctgggacctggacaggcccctttacctctctcgtgcccatctccttagctgtaaaataggaaaatggcctttcacttctataatcactgtgaaaatgaacggaagatgcctttcaaaggccgaggccagcgccctgacggcccatggcatgtgcagtccacaatgtgggaggcaggatgcagggatgggctctgtccccttggaactcaggcacagtcatgggggtgccggtcagccctgaagacaagctgatgagggtgcactaggaaaagtgcagggcatcggcgaggcacacgaaggaggtggggaggtgaagatggagaagaagccgaggcagtggccatgggtgtggagcttcgcgctgtgggtgcccagctggtctgggaaaccgcaggaaatcccgcagctcaggtgcgcagtgggaaggacttgctattccgtgggaaggcaggcaaaccttcccagggaaggggcatggccgtgcgcctcatgttttgggaagctcgtgccctctggggtagcgaggccagcttggaggggagtccagtggacagaggtggatgcaagtggagggagctgagcctgggctggggctggcagcagagggctggacagcagggcgcctgcgtggcagctgtgcagtcagtggggttgactggtttggaaggtaaggtgggggagaagcccggaggattcctgtcccttgacttggacagcccagtggagagggctgtgtaccaagggcaggaaaccagggagaagaagatgttgactttaagataccaagcagagaagggaagagccttctgggctggagacgtggggtgcctcagaagggaggaccttgagctagcagcagatgggacaaacgcaggggacagggcacagccgtggcaggagtgcagcgagcaagattctggtcacagtcctgacccagaaacctgcagaggaagggagggtggccagcacctgcccgtgggcctggggtgcagcccaggcagaggtggatggagggggtgctcagggaagaggggaggggagtgtgtgacctcaaaatgggagggcttgggggtcagagtcgagagaggggacagggtggggaccatgtgggactcttgagcactgacccttgaacccaggcagtggtgggatgggagggcaggaggcggcgggctgcgaggctgatgcggggctgcacggagctgtcattgagcctcttggaggatggtgggagaagtgccaggggcggctgaaagccttgccgagactgtgggcagcctggttgtgggcacttcggatgcttgcaccattagacccagaggcttcctggacaagcctgggctggaagaggatggcagaggctgctgggccttggaagagagagggtcctggcttctagttcctggggcagctaaggccaaccccagtgtccaggtgtcttccatgttatgcctgggagggaagaaagtagaggggcaaatgctttctttgcctattttccttaaacatttggtggcagtgctggtggctgcctgggacaggggccaggaggaaacacccctgcattagggaagccctcagccagcttttccctgggatgttcctgcgcctggctgaagctttctgagttcatgttggggaaatggaacggtcaccttccagccagtaaaggcacccctagctcttgggatgtttgtatccaactccgggcaatgtggggctacaaaggcccctggcttccataccctggggaccgggggagggctggtgctcccgcggtgggtgtccacggtgaggtcaggcccccacagcaggtgcattctcgccctcagcaggcaggcaagcaggcatcagctccggcgctggtctctggcttcgaagtctgtgtctttgcctgtctgtactcntgcctgacctgctggcgctccctgtccactgcactcctcccacctcatttttatgtgattttgcacagtgcctggcagacatttgacattcaataaacattgtacgaacgaaagaatcaatccccctctcactctctctgtccttctccctgtgtgcctccatatatttgtgcatctttggggagtcaggtgactttccctaccctcccctctccccatgctgccctggtcactgcccttgggaccccagcccaacaggccagtttaaaaggattggggcttggctcagtggctcatgcttataatcccagtgctttgggagactgaggcaggaggattgcttgtgcccaggagctcaaggctgcagtgagccgtgattgcaccactgcactccagcctgggtgacagagtgagaccctgtctcaataaataaataaataaaggatcaagactgaaagggggattgattctttcgttcgtacaatgtttgtcgannggccgcgaatttagtagtagtagn

SEQ ID NO: 76224 - DNA, 2547 bp, Homo sapiens
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggcccagggccccggccagtgcccagccccgctgggagacccggccagcaccacggacggcgcccaggaagcccgagtccccctggacggggccttctggattccgaggcccccggcaggttcgcccaagggctgcttcgcttgcgtgtccaagccccctgccctgcaggctccggcggcccctgcccctgagccctcggcctctcccccgatggcgcccacactgttccccatggagtccaagagcagcaagaccgacagcgtgcgggctgccggcgcgccccctgcctgcaagcacctagccgagaagaagacgatgaccaaccccacgaccgtcatcgaggtctacccggacaccaccgaggtgaacgactattacctgtggtccatcttcaacttcgtctacctcaacttctgctgcctgggcttcatcgccttggcctactccctcaaagtgcgagacaagaagcttctcaatgacctgaatggagccgtggaggatgcaaagacggcccggctgttcaacatcaccagttctgccctggcagcctcctgcatcatcctcgtcttcatcttcctgcggtaccccctcaccgactactaaggcccgccaggcacggctgctggcggagacaagcactgagacatgtttattctcatggtccctgaaacgcaggatcccatgaggttggggcagggcagggcttcttgtcctggggcccccttgagctgtgaactgggcagcaaggccatcagaagctgagtacagcaagggggcagtgagcttggccctcagtccaccccctccgcctcctggcctccaccctgcctgtgtctggggcctgggggcttctcccctcgctgctgcaccctggcttccagcgtctgtgtccctgccctcacgtgccccttcccaggctcctggggccccttggacctgacacctagcaggaagggcttatgcaaaattgtcccaggttgggaggactcactctgtgctccccgaccctgcctcctccacgatgtgaccccgctcagagcccttgtgtctgtgaactttcaatgaaatacccatgcagcaaaaaaaaaaaaaaaaaaaaaaaaaaaaaaaaaaaaaaaaaaaaaaaaaaaaaaaaaaaaaaaaaaaaaaacaaaaaaaaaactataaaaaaaaaataacatttaaatatcataaactcatactttattacatcttccactacctttcaaacccccacccttccctttccaacctctcctacactcctcttatttatcaccctcccctacacttttttaaacttcctctacccccatcttatacaacatctctaatcctatccccccaaacca

SEQ ID NO: 76225 - DNA, 1314 bp, Homo sapiens
ggcggtaaggccatgcccaggatgccatcgaggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctc

SEQ ID NO: 76226 - DNA, 1166 bp, Homo sapiens
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatctccttgtgagaaggtcacacaggttatttccgcaggtcacagactgaaacatggtgtctgt

SEQ ID NO: 76227 - DNA, 1087 bp, Homo sapiens
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcctcccttggggccgggttcagggcgcactggcaagcacgcgcggcccttataggggtataaccgtgcaggcc

SEQ ID NO: 76228 - DNA, 1697 bp, Homo sapiens
ctggcactcacttccttgtctgccgctagccttgaccctgatgtctggctgaaccttggctcctgagcagaccaggagaacctgagggttgaggaaaacctcttctgggccaggctgggcccacgcagagcagccctaccccgggaagaagggagtctgtccctcctcctgccttctgggcctttccatccctgcagtttcagaaaggcccctccttcaggaagctctccctgattgccacattcaccctcttactcctgacctggcactcttgtgcttggggggtggcgtggcagctgactcctcccttttcctcctagggggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgaggtgagcgccgggggctggggctggggctggggctggcagggggagccccaaggccaccactaccaccctgacactgctgtgacccctcttagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctc

SEQ ID NO: 76229 - DNA, 963 bp, Homo sapiens
  misc_feature (47)..(47): n is a, c, g, or t
ttaaggctaggtacgagactgcggtgaaattcggccgagggctcaangtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctc

SEQ ID NO: 76230 - DNA, 973 bp, Homo sapiens
  misc_feature (13)..(13): n is a, c, g, or t
ggctaccgctccntgctgggaggcaaggctacagctgtccagagactacacgctcaagtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctc

SEQ ID NO: 76231 - DNA, 923 bp, Homo sapiens
atagatcgagtcgtaccagatcccctttccatccctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctc

SEQ ID NO: 76232 - DNA, 809 bp, Homo sapiens
ccgcacgatcagtggtggggcacgaggcagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctc

SEQ ID NO: 76233 - DNA, 4203 bp, Homo sapiens
  misc_feature (1468)..(1468): n is a, c, g, or t
  misc_feature (3683)..(3683): n is a, c, g, or t
  misc_feature (4178)..(4179): n is a, c, g, or t
  misc_feature (4203)..(4203): n is a, c, g, or t
actttttgccccttcctgtcttcctctctttccattctccttcccttcctcatcctagaacttggtttcttcttacagcaaacacgcacatatttgtggatgtgatagaaggaaagagtgctgaggaggggagggccctataattcattctgaatgaaggttgcctcttggaaatgagtccagctcagtccactgcctccccaagacttcctgagtgccagcccactcctttcgccttaatattcctccccaaaggccctgtggactgctgtctctcctgccaatgcacaacgctcatcctcaaggcatcccagttaattttaaacgaggcagaaccaatcaaattaggagacagttgtgtcgccccatcctccaattatatcctctctgaggccaacttcttttattttaatcatttaaaacttgcaaaaagaaaaaacaaggaatttctttatatccttcacccagttgccccaattttttaacattttaccatatttgcttttctctatatatataaatacatctcacctactttataaaccagttgagggctgagaggtttcagacatgacgcccccgtgccccaagttcatccgtgtacagtgccccagggcagagacatgttcctctagaaccatcgttcattcgtcagctctcggaaacaaagcactggtactgtgctgagcactgtggcaccggctctgctgggctcctggatgctccaaggccctgctccctggctgactgcccatttcctgtcctcctcccggcttcaggtgcgagacaagaagcttctcaatgacctgaatggagccgtggaggatgcaaagacggcccggctgttcaacatcaccagttctgccctggcagcctcctgcatcatcctcgtcttcatcttcctgcggtaccccctcaccgactactaaggcccgccaggcacggctgctggcggagacaagcactgagacatgtttattctcatggtccctgaaacgcaggatcccatgaggttggggcagggcagggcttcttgtcctggggcccccttgagctgtgaactgggcagcaaggccatcagaagctgagtacagcaagggggcagtgagcttggccctcagtccaccccctccgcctcctggcctccaccctgcctgtgtctggggcctgggggcttctcccctcgctgctgcaccctggcttccagcgtctgtgtccctgccctcacgtgccccttcccaggctcctggggccccttggacctgacacctagcaggaagggcttatgcaaaattgtcccaggttgggaggactcactctgtgctccccgaccctgcctcctccacgatgtgaccccgctcagagcccttgtgtctgtgaactttcaatgaaatacccatgcagctccagcccagccttctactttgtgtccctggcagggcctggagaagtctggaggctttgcaancctccctcaggaactgcctggcggtcagggccccgggtgctgtgtcccaacagactgcaggggacggtctgctccatcacagctgtgccagacagtgaatgggaagggggggcatttggtggaggtaccccaaactcgagtcacttagagggtcaggcagcctcctggggggacggaagggggtggggcacagcctcagctgcctgcattggccaaatcagagcaaaggaaaccacaaattcactcggaaggaagcagcaggcagagacgatagacgcctggctaacccctgtccctcctggagggctctgggacctggacaggcccctttacctctctcgtgcccatctccttagctgtaaaataggaaaatggcctttcacttctataatcactgtgaaaatgaacggaagatgcctttcaaaggccgaggccagcgccctgacggcccatggcatgtgcagtccacaatgtgggaggcaggatgcagggatgggctctgtccccttggaactcaggcacagtcatgggggtgccggtcagccctgaagacaagctgatgagggtgcactaggaaaagtgcagggcatcggcgaggcacacgaaggaggtggggaggtgaagatggagaagaagccgaggcagtggccatgggtgtggagcttcgcgctgtgggtgcccagctggtctgggaaaccgcaggaaatcccgcagctcaggtgcgcagtgggaaggacttgctattccgtgggaaggcaggcaaaccttcccagggaaggggcatggccgtgcgcctcatgttttgggaagctcgtgccctctggggtagcgaggccagcttggaggggagtccagtggacagaggtggatgcaagtggagggagctgagcctgggctggggctggcagcagagggctggacagcagggcgcctgcgtggcagctgtgcagtcagtggggttgactggtttggaaggtaaggtgggggagaagcccggaggattcctgtcccttgacttggacagcccagtggagagggctgtgtaccaagggcaggaaaccagggagaagaagatgttgactttaagataccaagcagagaagggaagagccttctgggctggagacgtggggtgcctcagaagggaggaccttgagctagcagcagatgggacaaacgcaggggacagggcacagccgtggcaggagtgcagcgagcaagattctggtcacagtcctgacccagaaacctgcagaggaagggagggtggccagcacctgcccgtgggcctggggtgcagcccaggcagaggtggatggagggggtgctcagggaagaggggaggggagtgtgtgacctcaaaatgggagggcttgggggtcagagtcgagagaggggacagggtggggaccatgtgggactcttgagcactgacccttgaacccaggcagtggtgggatgggagggcaggaggcggcgggctgcgaggctgatgcggggctgcacggagctgtcattgagcctcttggaggatggtgggagaagtgccaggggcggctgaaagccttgccgagactgtgggcagcctggttgtgggcacttcggatgcttgcaccattagacccagaggcttcctggacaagcctgggctggaagaggatggcagaggctgctgggccttggaagagagagggtcctggcttctagttcctggggcagctaaggccaaccccagtgtccaggtgtcttccatgttatgcctgggagggaagaaagtagaggggcaaatgctttctttgcctattttccttaaacatttggtggcagtgctggtggctgcctgggacaggggccaggaggaaacacccctgcattagggaagccctcagccagcttttccctgggatgttcctgcgcctggctgaagctttctgagttcatgttggggaaatggaacggtcaccttccagccagtaaaggcacccctagctcttgggatgtttgtatccaactccgggcaatgtggggctacaaaggcccctggcttccataccctggggaccgggggagggctggtgctcccgcggtgggtgtccacggtgaggtcaggcccccacagcaggtgcattctcgccctcagcaggcaggcaagcaggcatcagctccggcgctggtctctggcttcgaagtctgtgtctttgcctgtctgtactcntgcctgacctgctggcgctccctgtccactgcactcctcccacctcatttttatgtgattttgcacagtgcctggcagacatttgacattcaataaacattgtacgaacgaaagaatcaatccccctctcactctctctgtccttctccctgtgtgcctccatatatttgtgcatctttggggagtcaggtgactttccctaccctcccctctccccatgctgccctggtcactgcccttgggaccccagcccaacaggccagtttaaaaggattggggcttggctcagtggctcatgcttataatcccagtgctttgggagactgaggcaggaggattgcttgtgcccaggagctcaaggctgcagtgagccgtgattgcaccactgcactccagcctgggtgacagagtgagaccctgtctcaataaataaataaataaaggatcaagactgaaagggggattgattctttcgttcgtacaatgtttgtcgannggccgcgaatttagtagtagtagn

SEQ ID NO: 76234 - DNA, 4110 bp, Homo sapiens
  misc_feature (1375)..(1375): n is a, c, g, or t
  misc_feature (3590)..(3590): n is a, c, g, or t
  misc_feature (4085)..(4086): n is a, c, g, or t
  misc_feature (4110)..(4110): n is a, c, g, or t
aagggttcagagtcaggcacaggcaggcagacaggaccccaagcaggactggccttccagacaggaaagagggttgcggagacacaggaggccagttgagagtggcagaggagaaaggagtttcatgggaggatggggcttggagagagatgagggagggaaaacgggggccgccatgcatcctcagcttccgggggactttggagagggtcgaggctcagtgggagctggaggcccagggccccggccagtgcccagccccgctgggagacccggccagcaccacggacggcgcccaggaagcccgagtccccctggacggggccttctggattccgaggcccccggcaggttcgcccaagggctgcttcgcttgcgtgtccaagccccctgccctgcaggctccggcggcccctgcccctgagccctcggcctctcccccgatggcgcccacactgttccccatggagtccaagagcagcaagaccgacagcgtgcgggctgccggcgcgccccctgcctgcaagcacctagccgagaagaagacgatgaccaaccccacgaccgtcatcgaggtctacccggacaccaccgaggtgaacgactattacctgtggtccatcttcaacttcgtctacctcaacttctgctgcctgggcttcatcgccttggcctactccctcaaagtgcgagacaagaagcttctcaatgacctgaatggagccgtggaggatgcaaagacggcccggctgttcaacatcaccagttctgccctggcagcctcctgcatcatcctcgtcttcatcttcctgcggtaccccctcaccgactactaaggcccgccaggcacggctgctggcggagacaagcactgagacatgtttattctcatggtccctgaaacgcaggatcccatgaggttggggcagggcagggcttcttgtcctggggcccccttgagctgtgaactgggcagcaaggccatcagaagctgagtacagcaagggggcagtgagcttggccctcagtccaccccctccgcctcctggcctccaccctgcctgtgtctggggcctgggggcttctcccctcgctgctgcaccctggcttccagcgtctgtgtccctgccctcacgtgccccttcccaggctcctggggccccttggacctgacacctagcaggaagggcttatgcaaaattgtcccaggttgggaggactcactctgtgctccccgaccctgcctcctccacgatgtgaccccgctcagagcccttgtgtctgtgaactttcaatgaaatacccatgcagctccagcccagccttctactttgtgtccctggcagggcctggagaagtctggaggctttgcaancctccctcaggaactgcctggcggtcagggccccgggtgctgtgtcccaacagactgcaggggacggtctgctccatcacagctgtgccagacagtgaatgggaagggggggcatttggtggaggtaccccaaactcgagtcacttagagggtcaggcagcctcctggggggacggaagggggtggggcacagcctcagctgcctgcattggccaaatcagagcaaaggaaaccacaaattcactcggaaggaagcagcaggcagagacgatagacgcctggctaacccctgtccctcctggagggctctgggacctggacaggcccctttacctctctcgtgcccatctccttagctgtaaaataggaaaatggcctttcacttctataatcactgtgaaaatgaacggaagatgcctttcaaaggccgaggccagcgccctgacggcccatggcatgtgcagtccacaatgtgggaggcaggatgcagggatgggctctgtccccttggaactcaggcacagtcatgggggtgccggtcagccctgaagacaagctgatgagggtgcactaggaaaagtgcagggcatcggcgaggcacacgaaggaggtggggaggtgaagatggagaagaagccgaggcagtggccatgggtgtggagcttcgcgctgtgggtgcccagctggtctgggaaaccgcaggaaatcccgcagctcaggtgcgcagtgggaaggacttgctattccgtgggaaggcaggcaaaccttcccagggaaggggcatggccgtgcgcctcatgttttgggaagctcgtgccctctggggtagcgaggccagcttggaggggagtccagtggacagaggtggatgcaagtggagggagctgagcctgggctggggctggcagcagagggctggacagcagggcgcctgcgtggcagctgtgcagtcagtggggttgactggtttggaaggtaaggtgggggagaagcccggaggattcctgtcccttgacttggacagcccagtggagagggctgtgtaccaagggcaggaaaccagggagaagaagatgttgactttaagataccaagcagagaagggaagagccttctgggctggagacgtggggtgcctcagaagggaggaccttgagctagcagcagatgggacaaacgcaggggacagggcacagccgtggcaggagtgcagcgagcaagattctggtcacagtcctgacccagaaacctgcagaggaagggagggtggccagcacctgcccgtgggcctggggtgcagcccaggcagaggtggatggagggggtgctcagggaagaggggaggggagtgtgtgacctcaaaatgggagggcttgggggtcagagtcgagagaggggacagggtggggaccatgtgggactcttgagcactgacccttgaacccaggcagtggtgggatgggagggcaggaggcggcgggctgcgaggctgatgcggggctgcacggagctgtcattgagcctcttggaggatggtgggagaagtgccaggggcggctgaaagccttgccgagactgtgggcagcctggttgtgggcacttcggatgcttgcaccattagacccagaggcttcctggacaagcctgggctggaagaggatggcagaggctgctgggccttggaagagagagggtcctggcttctagttcctggggcagctaaggccaaccccagtgtccaggtgtcttccatgttatgcctgggagggaagaaagtagaggggcaaatgctttctttgcctattttccttaaacatttggtggcagtgctggtggctgcctgggacaggggccaggaggaaacacccctgcattagggaagccctcagccagcttttccctgggatgttcctgcgcctggctgaagctttctgagttcatgttggggaaatggaacggtcaccttccagccagtaaaggcacccctagctcttgggatgtttgtatccaactccgggcaatgtggggctacaaaggcccctggcttccataccctggggaccgggggagggctggtgctcccgcggtgggtgtccacggtgaggtcaggcccccacagcaggtgcattctcgccctcagcaggcaggcaagcaggcatcagctccggcgctggtctctggcttcgaagtctgtgtctttgcctgtctgtactcntgcctgacctgctggcgctccctgtccactgcactcctcccacctcatttttatgtgattttgcacagtgcctggcagacatttgacattcaataaacattgtacgaacgaaagaatcaatccccctctcactctctctgtccttctccctgtgtgcctccatatatttgtgcatctttggggagtcaggtgactttccctaccctcccctctccccatgctgccctggtcactgcccttgggaccccagcccaacaggccagtttaaaaggattggggcttggctcagtggctcatgcttataatcccagtgctttgggagactgaggcaggaggattgcttgtgcccaggagctcaaggctgcagtgagccgtgattgcaccactgcactccagcctgggtgacagagtgagaccctgtctcaataaataaataaataaaggatcaagactgaaagggggattgattctttcgttcgtacaatgtttgtcgannggccgcgaatttagtagtagtagn

SEQ ID NO: 76235 - DNA, 825 bp, Homo sapiens
  misc_feature (532)..(532): n is a, c, g, or t
  misc_feature (557)..(557): n is a, c, g, or t
  misc_feature (578)..(578): n is a, c, g, or t
  misc_feature (605)..(605): n is a, c, g, or t
  misc_feature (613)..(613): n is a, c, g, or t
  misc_feature (616)..(616): n is a, c, g, or t
  misc_feature (622)..(622): n is a, c, g, or t
  misc_feature (654)..(654): n is a, c, g, or t
  misc_feature (663)..(663): n is a, c, g, or t
  misc_feature (670)..(670): n is a, c, g, or t
  misc_feature (672)..(672): n is a, c, g, or t
  misc_feature (688)..(688): n is a, c, g, or t
  misc_feature (695)..(695): n is a, c, g, or t
  misc_feature (704)..(704): n is a, c, g, or t
  misc_feature (740)..(740): n is a, c, g, or t
  misc_feature (750)..(750): n is a, c, g, or t
  misc_feature (761)..(761): n is a, c, g, or t
  misc_feature (808)..(808): n is a, c, g, or t
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggaatccaaccaacaaagtaacaaacaagcgaacaaagtccaagcaaccataacgntggaaagaaatgggtaccctccgtnttgaacaatcccacctaatgngcctcgggcgcaagccctcatcccggngataaccntgnaagccnaagagaacaacccggtgctctgggtgcacccntgcccaagntcaagcngntcgctcaagcccatcntgccccntgtgggcgnggtgctcaaaaaggtgtgaagaagggcaagggctcnttttgggggnaaggccaaccnaaagcaagccaaaggcaaatcaaccttttcaatcgcaagccaaaagnttctgaatgggcaatcc

SEQ ID NO: 76236 - DNA, 3691 bp, Homo sapiens
  misc_feature (956)..(956): n is a, c, g, or t
  misc_feature (3171)..(3171): n is a, c, g, or t
  misc_feature (3666)..(3667): n is a, c, g, or t
  misc_feature (3691)..(3691): n is a, c, g, or t
aagggttcagagtcaggcacaggcaggcagacaggaccccaagcaggactggccttccagacaggaaagagggttgcggagacacaggaggccagttgagagtggcagaggagaaaggagtttcatgggaggatggggcttggagagagatgagggagggaaaacgggggccgccatgcatcctcagcttccgggggactttggagagggtcgaggctcagtgggagctggaggttggtgaagaggacccagctcagggaacctgcgtggtgaagtgggggacttggagggagggagggaaggctggagttttctccatggggaggaactcatggggactgttatggggatggaagatcagctggcgtcaagcataccgtgagagtgaggatgtggtggggtagcggaggcggctgaggctgggaggacaggcattggtcaggaaaaatgattcacagggaacaaagtatcctcaggggaccaggctcagaagggctggtagggatcacagagaggctgtgggcaggtgagtaaaccagcctccagggagacaagtgtccttagcagccaggacctcagcacaggaccagagctcggaacgggacactttgccctgcgagcagatggagcatgacctggggtctgcgcaggagaggccacattttctcccctcgctgctgcaccctggcttccagcgtctgtgtccctgccctcacgtgccccttcccaggctcctggggccccttggacctgacacctagcaggaagggcttatgcaaaattgtcccaggttgggaggactcactctgtgctccccgaccctgcctcctccacgatgtgaccccgctcagagcccttgtgtctgtgaactttcaatgaaatacccatgcagctccagcccagccttctactttgtgtccctggcagggcctggagaagtctggaggctttgcaancctccctcaggaactgcctggcggtcagggccccgggtgctgtgtcccaacagactgcaggggacggtctgctccatcacagctgtgccagacagtgaatgggaagggggggcatttggtggaggtaccccaaactcgagtcacttagagggtcaggcagcctcctggggggacggaagggggtggggcacagcctcagctgcctgcattggccaaatcagagcaaaggaaaccacaaattcactcggaaggaagcagcaggcagagacgatagacgcctggctaacccctgtccctcctggagggctctgggacctggacaggcccctttacctctctcgtgcccatctccttagctgtaaaataggaaaatggcctttcacttctataatcactgtgaaaatgaacggaagatgcctttcaaaggccgaggccagcgccctgacggcccatggcatgtgcagtccacaatgtgggaggcaggatgcagggatgggctctgtccccttggaactcaggcacagtcatgggggtgccggtcagccctgaagacaagctgatgagggtgcactaggaaaagtgcagggcatcggcgaggcacacgaaggaggtggggaggtgaagatggagaagaagccgaggcagtggccatgggtgtggagcttcgcgctgtgggtgcccagctggtctgggaaaccgcaggaaatcccgcagctcaggtgcgcagtgggaaggacttgctattccgtgggaaggcaggcaaaccttcccagggaaggggcatggccgtgcgcctcatgttttgggaagctcgtgccctctggggtagcgaggccagcttggaggggagtccagtggacagaggtggatgcaagtggagggagctgagcctgggctggggctggcagcagagggctggacagcagggcgcctgcgtggcagctgtgcagtcagtggggttgactggtttggaaggtaaggtgggggagaagcccggaggattcctgtcccttgacttggacagcccagtggagagggctgtgtaccaagggcaggaaaccagggagaagaagatgttgactttaagataccaagcagagaagggaagagccttctgggctggagacgtggggtgcctcagaagggaggaccttgagctagcagcagatgggacaaacgcaggggacagggcacagccgtggcaggagtgcagcgagcaagattctggtcacagtcctgacccagaaacctgcagaggaagggagggtggccagcacctgcccgtgggcctggggtgcagcccaggcagaggtggatggagggggtgctcagggaagaggggaggggagtgtgtgacctcaaaatgggagggcttgggggtcagagtcgagagaggggacagggtggggaccatgtgggactcttgagcactgacccttgaacccaggcagtggtgggatgggagggcaggaggcggcgggctgcgaggctgatgcggggctgcacggagctgtcattgagcctcttggaggatggtgggagaagtgccaggggcggctgaaagccttgccgagactgtgggcagcctggttgtgggcacttcggatgcttgcaccattagacccagaggcttcctggacaagcctgggctggaagaggatggcagaggctgctgggccttggaagagagagggtcctggcttctagttcctggggcagctaaggccaaccccagtgtccaggtgtcttccatgttatgcctgggagggaagaaagtagaggggcaaatgctttctttgcctattttccttaaacatttggtggcagtgctggtggctgcctgggacaggggccaggaggaaacacccctgcattagggaagccctcagccagcttttccctgggatgttcctgcgcctggctgaagctttctgagttcatgttggggaaatggaacggtcaccttccagccagtaaaggcacccctagctcttgggatgtttgtatccaactccgggcaatgtggggctacaaaggcccctggcttccataccctggggaccgggggagggctggtgctcccgcggtgggtgtccacggtgaggtcaggcccccacagcaggtgcattctcgccctcagcaggcaggcaagcaggcatcagctccggcgctggtctctggcttcgaagtctgtgtctttgcctgtctgtactcntgcctgacctgctggcgctccctgtccactgcactcctcccacctcatttttatgtgattttgcacagtgcctggcagacatttgacattcaataaacattgtacgaacgaaagaatcaatccccctctcactctctctgtccttctccctgtgtgcctccatatatttgtgcatctttggggagtcaggtgactttccctaccctcccctctccccatgctgccctggtcactgcccttgggaccccagcccaacaggccagtttaaaaggattggggcttggctcagtggctcatgcttataatcccagtgctttgggagactgaggcaggaggattgcttgtgcccaggagctcaaggctgcagtgagccgtgattgcaccactgcactccagcctgggtgacagagtgagaccctgtctcaataaataaataaataaaggatcaagactgaaagggggattgattctttcgttcgtacaatgtttgtcgannggccgcgaatttagtagtagtagn

SEQ ID NO: 76237 - DNA, 881 bp, Homo sapiens
aagggttcagagtcaggcacaggcaggcagacaggaccccaagcaggactggccttccagacaggaaagagggttgcggagacacaggaggccagttgagagtggcagaggagaaaggagtttcatgggaggatggggcttggagagagatgagggagggaaaacgggggccgccatgcatcctcagcttccgggggactttggagagggtcgaggctcagtgggagctggaggttgggccgctgggaggcggatcagtggacagacagcggcccgcgggacggcggaaggacgcgcgcaccgaggctcagggggtccggccgcgcgccgaggagtcgcttgtaggtgaggaggcgccgtccggggggctgcggcagacccggatggggctgggggctgcagagcctcggccgcagaccccccggcgagcgccgcacgggagctgggaacgcggggtggcgcagagcgcgagcgacttggtgcctcgttggagaagtgttcatttcacagcctgttattgtgcgtctatgtatggcccgggggtgcgtggctccgggcaagtgtgcgcgcttggggtccccaggttggaggtggggggcggtgcgcacgagttggagaccccgcacctgtgccggttcttggtgctcgtggctgagcctgcatcgccttgtgtggggagttgtttactcgtcaatggctctgagcgcgcccgcgggtgcgccccggggtctggagagcccgcggtgcagcccgcggtggagcccgtggcggtgcccgtggcggtatcgggtgtccgcgggcgccgtgggcaggtgctttggccgctctgctagctctgccggttggcggctgaggcagcgtcgctgtgggtccggcgcccc

SEQ ID NO: 76238 - DNA, 1159 bp, Homo sapiens
ctttggccgggtgggacggtgtctggggccttgtgcttttctgcttgcgggggtcgtgtttaccgcggtattccggggggttgcgggcttatctcgttatcgtcgccgttttgtcgtgaccgttggggtgtcggtgtgcgtcttggcggtgttcccctcgtggtgttggacgttcgatgtggtgtgccgtgtagtcccggggggaacctgtgtccgtgggtgcagcttagtgagttgcttgggtgtgtggtgcgttgacggtgaggtcctgccagggcctgctcgaggtttggttttcggtccgagtcgcccctcccgaagtgttagagcacgtttgtagtttaggaccgctgggtttgttagtaactgtttgcatgtaataagttgaagctccatagggtcttctcgtctgcctgtgttatgcccgcctcttcacgcggcaggtcaatttcactggttaaaagtaaggcctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctc

SEQ ID NO: 76239 - DNA, 536 bp, Homo sapiens
aagcagctggtcccggccgcagtcgttagcatgcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctc

SEQ ID NO: 76240 - DNA, 2185 bp, Homo sapiens
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctcaaaaaaaaaaaaaaaaaaaaaaaaaaaaaaaaaaaaaaaaaaaaaaaaaaaaaaaaaaaaaaaaaaaaaaaaaa

SEQ ID NO: 76241 - DNA, 2160 bp, Homo sapiens
  misc_feature (2129)..(2129): n is a, c, g, or t
  misc_feature (2134)..(2135): n is a, c, g, or t
  misc_feature (2144)..(2145): n is a, c, g, or t
  misc_feature (2148)..(2148): n is a, c, g, or t
  misc_feature (2151)..(2151): n is a, c, g, or t
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctcaaaaaaaaaacacaaaanaacannacaacacannacnacnaaacaacaa

SEQ ID NO: 76242 - DNA, 2044 bp, Homo sapiens
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggtgagctgaggtgagctgaggtggagggggaaaccacctgtggactgggggtggggacccgggtttgcgggggtgatgggggaccccgcgactgccctggggcgccgggagggcgcccaaaaagggggttggggccatgggttagggggtctctggctggtttgtttccttctgc

SEQ ID NO: 76243 - DNA, 2129 bp, Homo sapiens
tcgcttcctgggtttagaactcaggaccccgatctcagtctggagctccctcctgcaccctggctggcggtgtgctgggtgacaggactctggaggggtaccctgagtgcagctgtcggaggaggcagggcggtggggggggcagcacagaagcctctaaggccccaggtgcagtcctggacctcgtggagccgcatggagtgaggagaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctc

SEQ ID NO: 76244 - DNA, 1909 bp, Homo sapiens
tggtgactctgtaggatccccggcagcccccgcaagacggggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctc

SEQ ID NO: 76245 - DNA, 1790 bp, Homo sapiens
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacggccagccatgcactccggccagccattgaataccggcagccatgc

SEQ ID NO: 76246 - DNA, 1902 bp, Homo sapiens
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccaccaagctctgcggaaatcaacaggcccagagcacttggagggaggaagaaagggagcggcgtcaggctatgacaggtctgctacgcaaaacatttttcaggtaaaatagtagagatgttgtcttgcaaaacaaacaacaaaaacaagtaaaaaaccaac

SEQ ID NO: 76247 - DNA, 1968 bp, Homo sapiens
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtccaggaggtcctcccggctacaggcggtggtgggcctaccagaacaggcgtctccgggactaccttggacctgcgtgctagggccttagcagtgggcagtgggccgcacctactgtaggccggcgtagatagccataagcgaacaccgacagagagcgaacccttggaggcagggggaacgcaggattaccatgggggtatacgcacccagacagcagaagagacatcagtggcaccaaaggagcacgcactatgtcctctggacgaagacg

SEQ ID NO: 76248 - DNA, 2077 bp, Homo sapiens
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctc

SEQ ID NO: 76249 - DNA, 1653 bp, Homo sapiens
  misc_feature (12)..(12): n is a, c, g, or t
tgctgtgtttgngtgttgtacttgtggtggatccagcaagcgacgtccagcagtttgcagtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctc

SEQ ID NO: 76250 - DNA, 1905 bp, Homo sapiens
  misc_feature (1874)..(1874): n is a, c, g, or t
  misc_feature (1879)..(1880): n is a, c, g, or t
  misc_feature (1889)..(1890): n is a, c, g, or t
  misc_feature (1893)..(1893): n is a, c, g, or t
  misc_feature (1896)..(1896): n is a, c, g, or t
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctcaaaaaaaaaacacaaaanaacannacaacacannacnacnaaacaacaa

SEQ ID NO: 76251 - DNA, 1823 bp, Homo sapiens
gctcggtaccccaggcgcttgttgggaggctgagaatctcctcgttgcttagctgatgttctggggtttttcctttctccctcatctgtgttatagttctctgtcttttcatttttataggtttttggtgtggtgacctttttacagatgatagatctgtagcctctcttagttctggtgtctgccccccttgtggcagagatcagtatgggggcttgctgtgggcttcctgatgggaggagctgatgcccacccactggtaggtggagctgattctaatccctctggtgggtggtgcttagtcccagtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctc

SEQ ID NO: 76252 - DNA, 1540 bp, Homo sapiens
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgcgaccagcgtaaagatcctctagagcag

SEQ ID NO: 76253 - DNA, 1527 bp, Homo sapiens
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacatcttccagctgttttccggcaaagatcacctctgctggttaggatgctgtcgggaccgagctcgattgta

SEQ ID NO: 76254 - DNA, 1463 bp, Homo sapiens
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggccagttagcagctcgcccctgagttggggaacctctagaggcgg

SEQ ID NO: 76255 - DNA, 1508 bp, Homo sapiens
  misc_feature (12)..(12): n is a, c, g, or t
tgctgtgtttgngtgttgtacttgtggtggatccagcaagcgacgtccagcagtttgcagtggatggaggggacccacaggtttggaggagcccgtgtcgaagacgactgtgaagcactgggggggcgtcccgatgccaatctccacatccgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctc

SEQ ID NO: 76256 - DNA, 1324 bp, Homo sapiens
  misc_feature (29)..(29): n is a, c, g, or t
gaatatgtctagtagatgctggtgttaantcggacgaggcaggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctc

SEQ ID NO: 76257 - DNA, 1310 bp, Homo sapiens
tcatcagctcggtccatggttagcagaggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctc

SEQ ID NO: 76258 - DNA, 1164 bp, Homo sapiens
  misc_feature (1086)..(1086): n is a, c, g, or t
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggctgctgtttcatctgttcctgctgccgctggaatcgtggaggtaaagacttctnaaactgtttgaaatagccagataatacagccggccgaggttgagaccctggattcttggttctgtttcatgcaccact

SEQ ID NO: 76259 - DNA, 1080 bp, Homo sapiens
cggcgtcatcccggctataagcgcacggctcggcgaacctctccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctc

SEQ ID NO: 76260 - DNA, 952 bp, Homo sapiens
ccccgggctgcaggaattcggcacggcacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctc

SEQ ID NO: 76261 - DNA, 1004 bp, Homo sapiens
  misc_feature (19)..(19): n is a, c, g, or t
  misc_feature (33)..(33): n is a, c, g, or t
  misc_feature (54)..(54): n is a, c, g, or t
  misc_feature (71)..(71): n is a, c, g, or t
cgttcttaaggatagggtntcccggcctgcganaccttgagcgtgtagtctctngggacagcttgtagccntgcctcccagcttcagtgtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctc

SEQ ID NO: 76262 - DNA, 1104 bp, Homo sapiens
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctc

SEQ ID NO: 76263 - DNA, 4222 bp, Homo sapiens
  misc_feature (1487)..(1487): n is a, c, g, or t
  misc_feature (3702)..(3702): n is a, c, g, or t
  misc_feature (4197)..(4198): n is a, c, g, or t
  misc_feature (4222)..(4222): n is a, c, g, or t
aagggttcagagtcaggcacaggcaggcagacaggaccccaagcaggactggccttccagacaggaaagagggttgcggagacacaggaggccagttgagagtggcagaggagaaaggagtttcatgggaggatggggcttggagagagatgagggagggaaaacgggggccgccatgcatcctcagcttccgggggactttggagagggtcgaggctcagtgggagctggaggttgggccgctgggaggcggatcagtggacagacagcggcccgcgggacggcggaaggacgcgcgcaccgaggctcagggggtccggccgcgcgccgaggagtcgcttgtaggcccagggccccggccagtgcccagccccgctgggagacccggccagcaccacggacggcgcccaggaagcccgagtccccctggacggggccttctggattccgaggcccccggcaggttcgcccaagggctgcttcgcttgcgtgtccaagccccctgccctgcaggctccggcggcccctgcccctgagccctcggcctctcccccgatggcgcccacactgttccccatggagtccaagagcagcaagaccgacagcgtgcgggctgccggcgcgccccctgcctgcaagcacctagccgagaagaagacgatgaccaaccccacgaccgtcatcgaggtctacccggacaccaccgaggtgaacgactattacctgtggtccatcttcaacttcgtctacctcaacttctgctgcctgggcttcatcgccttggcctactccctcaaagtgcgagacaagaagcttctcaatgacctgaatggagccgtggaggatgcaaagacggcccggctgttcaacatcaccagttctgccctggcagcctcctgcatcatcctcgtcttcatcttcctgcggtaccccctcaccgactactaaggcccgccaggcacggctgctggcggagacaagcactgagacatgtttattctcatggtccctgaaacgcaggatcccatgaggttggggcagggcagggcttcttgtcctggggcccccttgagctgtgaactgggcagcaaggccatcagaagctgagtacagcaagggggcagtgagcttggccctcagtccaccccctccgcctcctggcctccaccctgcctgtgtctggggcctgggggcttctcccctcgctgctgcaccctggcttccagcgtctgtgtccctgccctcacgtgccccttcccaggctcctggggccccttggacctgacacctagcaggaagggcttatgcaaaattgtcccaggttgggaggactcactctgtgctccccgaccctgcctcctccacgatgtgaccccgctcagagcccttgtgtctgtgaactttcaatgaaatacccatgcagctccagcccagccttctactttgtgtccctggcagggcctggagaagtctggaggctttgcaancctccctcaggaactgcctggcggtcagggccccgggtgctgtgtcccaacagactgcaggggacggtctgctccatcacagctgtgccagacagtgaatgggaagggggggcatttggtggaggtaccccaaactcgagtcacttagagggtcaggcagcctcctggggggacggaagggggtggggcacagcctcagctgcctgcattggccaaatcagagcaaaggaaaccacaaattcactcggaaggaagcagcaggcagagacgatagacgcctggctaacccctgtccctcctggagggctctgggacctggacaggcccctttacctctctcgtgcccatctccttagctgtaaaataggaaaatggcctttcacttctataatcactgtgaaaatgaacggaagatgcctttcaaaggccgaggccagcgccctgacggcccatggcatgtgcagtccacaatgtgggaggcaggatgcagggatgggctctgtccccttggaactcaggcacagtcatgggggtgccggtcagccctgaagacaagctgatgagggtgcactaggaaaagtgcagggcatcggcgaggcacacgaaggaggtggggaggtgaagatggagaagaagccgaggcagtggccatgggtgtggagcttcgcgctgtgggtgcccagctggtctgggaaaccgcaggaaatcccgcagctcaggtgcgcagtgggaaggacttgctattccgtgggaaggcaggcaaaccttcccagggaaggggcatggccgtgcgcctcatgttttgggaagctcgtgccctctggggtagcgaggccagcttggaggggagtccagtggacagaggtggatgcaagtggagggagctgagcctgggctggggctggcagcagagggctggacagcagggcgcctgcgtggcagctgtgcagtcagtggggttgactggtttggaaggtaaggtgggggagaagcccggaggattcctgtcccttgacttggacagcccagtggagagggctgtgtaccaagggcaggaaaccagggagaagaagatgttgactttaagataccaagcagagaagggaagagccttctgggctggagacgtggggtgcctcagaagggaggaccttgagctagcagcagatgggacaaacgcaggggacagggcacagccgtggcaggagtgcagcgagcaagattctggtcacagtcctgacccagaaacctgcagaggaagggagggtggccagcacctgcccgtgggcctggggtgcagcccaggcagaggtggatggagggggtgctcagggaagaggggaggggagtgtgtgacctcaaaatgggagggcttgggggtcagagtcgagagaggggacagggtggggaccatgtgggactcttgagcactgacccttgaacccaggcagtggtgggatgggagggcaggaggcggcgggctgcgaggctgatgcggggctgcacggagctgtcattgagcctcttggaggatggtgggagaagtgccaggggcggctgaaagccttgccgagactgtgggcagcctggttgtgggcacttcggatgcttgcaccattagacccagaggcttcctggacaagcctgggctggaagaggatggcagaggctgctgggccttggaagagagagggtcctggcttctagttcctggggcagctaaggccaaccccagtgtccaggtgtcttccatgttatgcctgggagggaagaaagtagaggggcaaatgctttctttgcctattttccttaaacatttggtggcagtgctggtggctgcctgggacaggggccaggaggaaacacccctgcattagggaagccctcagccagcttttccctgggatgttcctgcgcctggctgaagctttctgagttcatgttggggaaatggaacggtcaccttccagccagtaaaggcacccctagctcttgggatgtttgtatccaactccgggcaatgtggggctacaaaggcccctggcttccataccctggggaccgggggagggctggtgctcccgcggtgggtgtccacggtgaggtcaggcccccacagcaggtgcattctcgccctcagcaggcaggcaagcaggcatcagctccggcgctggtctctggcttcgaagtctgtgtctttgcctgtctgtactcntgcctgacctgctggcgctccctgtccactgcactcctcccacctcatttttatgtgattttgcacagtgcctggcagacatttgacattcaataaacattgtacgaacgaaagaatcaatccccctctcactctctctgtccttctccctgtgtgcctccatatatttgtgcatctttggggagtcaggtgactttccctaccctcccctctccccatgctgccctggtcactgcccttgggaccccagcccaacaggccagtttaaaaggattggggcttggctcagtggctcatgcttataatcccagtgctttgggagactgaggcaggaggattgcttgtgcccaggagctcaaggctgcagtgagccgtgattgcaccactgcactccagcctgggtgacagagtgagaccctgtctcaataaataaataaataaaggatcaagactgaaagggggattgattctttcgttcgtacaatgtttgtcgannggccgcgaatttagtagtagtagn

SEQ ID NO: 76264 - DNA, 3927 bp, Homo sapiens
  misc_feature (1192)..(1192): n is a, c, g, or t
  misc_feature (3407)..(3407): n is a, c, g, or t
  misc_feature (3902)..(3903): n is a, c, g, or t
  misc_feature (3927)..(3927): n is a, c, g, or t
gtgctggccggtaggccgggcccagcttgctctcactttctcctctccaggcccagggccccggccagtgcccagccccgctgggagacccggccagcaccacggacggcgcccaggaagcccgagtccccctggacggggccttctggattccgaggcccccggcaggttcgcccaagggctgcttcgcttgcgtgtccaagccccctgccctgcaggctccggcggcccctgcccctgagccctcggcctctcccccgatggcgcccacactgttccccatggagtccaagagcagcaagaccgacagcgtgcgggctgccggcgcgccccctgcctgcaagcacctagccgagaagaagacgatgaccaaccccacgaccgtcatcgaggtctacccggacaccaccgaggtgaacgactattacctgtggtccatcttcaacttcgtctacctcaacttctgctgcctgggcttcatcgccttggcctactccctcaaagtgcgagacaagaagcttctcaatgacctgaatggagccgtggaggatgcaaagacggcccggctgttcaacatcaccagttctgccctggcagcctcctgcatcatcctcgtcttcatcttcctgcggtaccccctcaccgactactaaggcccgccaggcacggctgctggcggagacaagcactgagacatgtttattctcatggtccctgaaacgcaggatcccatgaggttggggcagggcagggcttcttgtcctggggcccccttgagctgtgaactgggcagcaaggccatcagaagctgagtacagcaagggggcagtgagcttggccctcagtccaccccctccgcctcctggcctccaccctgcctgtgtctggggcctgggggcttctcccctcgctgctgcaccctggcttccagcgtctgtgtccctgccctcacgtgccccttcccaggctcctggggccccttggacctgacacctagcaggaagggcttatgcaaaattgtcccaggttgggaggactcactctgtgctccccgaccctgcctcctccacgatgtgaccccgctcagagcccttgtgtctgtgaactttcaatgaaatacccatgcagctccagcccagccttctactttgtgtccctggcagggcctggagaagtctggaggctttgcaancctccctcaggaactgcctggcggtcagggccccgggtgctgtgtcccaacagactgcaggggacggtctgctccatcacagctgtgccagacagtgaatgggaagggggggcatttggtggaggtaccccaaactcgagtcacttagagggtcaggcagcctcctggggggacggaagggggtggggcacagcctcagctgcctgcattggccaaatcagagcaaaggaaaccacaaattcactcggaaggaagcagcaggcagagacgatagacgcctggctaacccctgtccctcctggagggctctgggacctggacaggcccctttacctctctcgtgcccatctccttagctgtaaaataggaaaatggcctttcacttctataatcactgtgaaaatgaacggaagatgcctttcaaaggccgaggccagcgccctgacggcccatggcatgtgcagtccacaatgtgggaggcaggatgcagggatgggctctgtccccttggaactcaggcacagtcatgggggtgccggtcagccctgaagacaagctgatgagggtgcactaggaaaagtgcagggcatcggcgaggcacacgaaggaggtggggaggtgaagatggagaagaagccgaggcagtggccatgggtgtggagcttcgcgctgtgggtgcccagctggtctgggaaaccgcaggaaatcccgcagctcaggtgcgcagtgggaaggacttgctattccgtgggaaggcaggcaaaccttcccagggaaggggcatggccgtgcgcctcatgttttgggaagctcgtgccctctggggtagcgaggccagcttggaggggagtccagtggacagaggtggatgcaagtggagggagctgagcctgggctggggctggcagcagagggctggacagcagggcgcctgcgtggcagctgtgcagtcagtggggttgactggtttggaaggtaaggtgggggagaagcccggaggattcctgtcccttgacttggacagcccagtggagagggctgtgtaccaagggcaggaaaccagggagaagaagatgttgactttaagataccaagcagagaagggaagagccttctgggctggagacgtggggtgcctcagaagggaggaccttgagctagcagcagatgggacaaacgcaggggacagggcacagccgtggcaggagtgcagcgagcaagattctggtcacagtcctgacccagaaacctgcagaggaagggagggtggccagcacctgcccgtgggcctggggtgcagcccaggcagaggtggatggagggggtgctcagggaagaggggaggggagtgtgtgacctcaaaatgggagggcttgggggtcagagtcgagagaggggacagggtggggaccatgtgggactcttgagcactgacccttgaacccaggcagtggtgggatgggagggcaggaggcggcgggctgcgaggctgatgcggggctgcacggagctgtcattgagcctcttggaggatggtgggagaagtgccaggggcggctgaaagccttgccgagactgtgggcagcctggttgtgggcacttcggatgcttgcaccattagacccagaggcttcctggacaagcctgggctggaagaggatggcagaggctgctgggccttggaagagagagggtcctggcttctagttcctggggcagctaaggccaaccccagtgtccaggtgtcttccatgttatgcctgggagggaagaaagtagaggggcaaatgctttctttgcctattttccttaaacatttggtggcagtgctggtggctgcctgggacaggggccaggaggaaacacccctgcattagggaagccctcagccagcttttccctgggatgttcctgcgcctggctgaagctttctgagttcatgttggggaaatggaacggtcaccttccagccagtaaaggcacccctagctcttgggatgtttgtatccaactccgggcaatgtggggctacaaaggcccctggcttccataccctggggaccgggggagggctggtgctcccgcggtgggtgtccacggtgaggtcaggcccccacagcaggtgcattctcgccctcagcaggcaggcaagcaggcatcagctccggcgctggtctctggcttcgaagtctgtgtctttgcctgtctgtactcntgcctgacctgctggcgctccctgtccactgcactcctcccacctcatttttatgtgattttgcacagtgcctggcagacatttgacattcaataaacattgtacgaacgaaagaatcaatccccctctcactctctctgtccttctccctgtgtgcctccatatatttgtgcatctttggggagtcaggtgactttccctaccctcccctctccccatgctgccctggtcactgcccttgggaccccagcccaacaggccagtttaaaaggattggggcttggctcagtggctcatgcttataatcccagtgctttgggagactgaggcaggaggattgcttgtgcccaggagctcaaggctgcagtgagccgtgattgcaccactgcactccagcctgggtgacagagtgagaccctgtctcaataaataaataaataaaggatcaagactgaaagggggattgattctttcgttcgtacaatgtttgtcgannggccgcgaatttagtagtagtagn

SEQ ID NO: 76265 - DNA, 553 bp, Homo sapiens
ggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtccgtcgtccgagcggaccggtccgctcggaggaagaaaggcagccaggagaaaggaggggacgacaagccagcagaagttcattgtttacgtccctgtttccctcgcagcaagagattgaggaaggcactggtccgagcggaccg

SEQ ID NO: 76266 - DNA, 396 bp, Homo sapiens
cttctctaactcttcgacctcctgattagaagtaaaatttctcagtttacttttagctgagattcaggctcaaggatatagaggcctgaaatgtcagtagagatgggtttagtactctcaaagagttatttattgtactgtctggcagtgcttgtagtaggcaaataattttgttctacttggattctaattctaaaatactatttgaaaaatgtcctaaattcaaattatattgtggtttgggttcatgagactagaattaagaatattaagaatattgggccgggtgcaatggctcacacctgtaatcccagcactttgggaggccgagagcggatcacgaggtcaggagtttgagaccagcctgaccaatatggtgaaaccccgtctctactt

SEQ ID NO: 76267 - DNA, 366 bp, Homo sapiens
ccaacacatctttaataagatattgttcgtgcctttgccatatgctacagagcagcctctcactcggtgggccttttgattcctctcaataagattatttcaaatactctaatcctgaatcattgacatgaatacaaaagcctagtgacatctaatagatgcctcttagctttgcttttcctcttgttcctttcctttttcttctctttttacctgacaaaaagctcatagacacttgggctctgtctctcagtagcagcatggggggctcctcatgaaatataaagggggaaaaaggactgacagaggcccgataagctacagagtgaagggccatagattaaaagtaaatgccagtaaatccta

SEQ ID NO: 76268 - DNA, 2786 bp, Homo sapiens
agcgggttccgggaggcgcccggtgagcccacgtctgttgcggcggagcgagggaaacggactcggcggcgccggcatgaggagctgagcgtctcgggcgaggcgggctgacggcagcaccatgcaggcggcagtggctgtgtccgtgcccttcttgctgctctgtgtcctggggacctgccctccggcgcgctgcggccaggcaggagacgcctcattgatggagctagagaagaggaaggaaaaccgcttcgtggagcgccagagcatcgtgccactgcgcctcatctaccgctcgggcggcgaagacgaaagtcggcacgacgcgctcgacacgcgggtgcggggcgacctcggtggcccgcagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagagacagttaccccagggagattatgtaaaaaagcctggagatggtgactctttttatagcgacattcctcccggagtcagcacaaactcagcatctagttctaagaagaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagtaagtctgaacctctaatggaaaaaggcactccaaggtcctgtgcaaatagtgtcaaaagtaaattaagcagatagtcaaagaactgt

SEQ ID NO: 76269 - DNA, 2759 bp, Homo sapiens
agcggactcgctggctccccccgccagcggaagcgtccgcgaagcacaatgcagcactgagccgcggtggaggttgcagcgctacggccgccgcagcaccggccggggctgggtggaggtggccgcggggaccccgggggcgcggagcgagggaaacggactcggcggcgccggcatgaggagctgagcgtctcgggcgaggcgggctgacggcagcaccatgcaggcggcagtggctgtgtccgtgcccttcttgctgctctgtgtcctggggacctgccctccggcgcgctgcggccaggcaggagacgcctcattgatggagctagagaagaggaaggaaaaccgcttcgtggagcgccagagcatcgtgccactgcgcctcatctaccgctcgggcggcgaagacgaaagtcggcacgacgcgctcgacacgcgggtgcggggcgacctcggtggcccgcagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataagtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagtaagtctgaacctctaatggaaaaaggcactccaaggtcctgtgcaaatagtgtcaaaagtaaattaagcagatagtcaaagaactgt

SEQ ID NO: 76270 - DNA, 4108 bp, Homo sapiens
agcggactcgctggctccccccgccagcggaagcgtccgcgaagcacaatgcagcactgagccgcggtggaggttgcagcgctacggccgccgcagcaccggccggggctgggtggaggtggccgcggggaccccgggggcgcggagcgagggaaacggactcggcggcgccggcatgaggagctgagcgtctcgggcgaggcgggctgacggcagcaccatgcaggcggcagtggctgtgtccgtgcccttcttgctgctctgtgtcctggggacctgccctccggcgcgctgcggccaggcaggagacgcctcattgatggagctagagaagaggaaggaaaaccgcttcgtggagcgccagagcatcgtgccactgcgcctcatctaccgctcgggcggcgaagacgaaagtcggcacgacgcgctcgacacgcgggtgcggggcgacctcggtggcccgcagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagagacagttaccccagggagattatgtaaaaaagcctggagatggtgactctttttatagcgacattcctcccggagtcagcacaaactcagcatctagttctaagaagaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagactttatctcctgccaagtctccttcttcatcaactgggtctattgcctccagcagaaaatacccttacccaatgcctccacttcctgatgaggacaagaaagtgaaccgacaaagtgccaggctatgggagacatccatttaagatcaactgtttacatgtgatacatcgaaaactgtttacttcaacttttatagaaacccaggctcatggaatcactgcaaatctatctgctcttcagacaatacgaagaccctctgagatgctacagaggagaggaagcggagtttcacatctggttaccattttctttttgtcattggcttaggatttaactaaccatgaaaagaactactgaaatattacactataacatggaacaataaaggtactggtatgttaatggataatccgcatgacagataatatgtagaaatattcataaagttaactcacatgacccaaatgtagcaagtttcctaaggtacaatagtggattcagaacttgacgttctgaggcacatcctcactgtaaacagtaatgctatatgcatgaagcttctgtttattgttttccatatttaaggaaacaacatcccataatagaaatgagcatgcagggctaaggcatataggatttttctgcaggactttaaagctttgaaaggccaatatcccataggctaactttaaacatgtatttttatttttgttttgttttttacttttcatatttatattagcatacaaggacaattgtatatatgtaacatttttaaaattttaaaaaaatgcagctgttacacacaagtgtattttgccaaatgcctaaaaattccgtcacaatcacatcatcgtcatccatccagtgatcttcaaagactataagcaggtaatgtaaatatagtggtcaatgctgtaaatgtgtctctccataattcgtatttgtccaaaacatgtgatatccctttaacctgtgcacagtctggaggcagttttattgagtgagtagttgagtgagagaacaaaatgcccagcaaaacttctggcctccacagtttgctgatgcaggagcccactctgctgccgatgggctgctccctggaaatcatctatcccatccgtccatcccatctcatcccagtgagccagcccctcagcagtgtgtgctgctgagattaagcaagtgcaccaaagacacatgagacaacgtactgccagtgagctggtagcttctggtttgccaatactctaaccctttgtggcctgaagttttgttccttggcaaaactttgtagtcacccttatctg

SEQ ID NO: 76271 - DNA, 4000 bp, Homo sapiens
agcggactcgctggctccccccgccagcggaagcgtccgcgaagcacaatgcagcactgagccgcggtggaggttgcagcgctacggccgccgcagcaccggccggggctgggtggaggtggccgcggggaccccgggggcgcggagcgagggaaacggactcggcggcgccggcatgaggagctgagcgtctcgggcgaggcgggctgacggcagcaccatgcaggcggcagtggctgtgtccgtgcccttcttgctgctctgtgtcctggggacctgccctccggcgcgctgcggccaggcaggagacgcctcattgatggagctagagaagaggaaggaaaaccgcttcgtggagcgccagagcatcgtgccactgcgcctcatctaccgctcgggcggcgaagacgaaagtcggcacgacgcgctcgacacgcgggtgcggggcgacctcggtggcccgcagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagactttatctcctgccaagtctccttcttcatcaactgggtctattgcctccagcagaaaatacccttacccaatgcctccacttcctgatgaggacaagaaagtgaaccgacaaagtgccaggctatgggagacatccatttaagatcaactgtttacatgtgatacatcgaaaactgtttacttcaacttttatagaaacccaggctcatggaatcactgcaaatctatctgctcttcagacaatacgaagaccctctgagatgctacagaggagaggaagcggagtttcacatctggttaccattttctttttgtcattggcttaggatttaactaaccatgaaaagaactactgaaatattacactataacatggaacaataaaggtactggtatgttaatggataatccgcatgacagataatatgtagaaatattcataaagttaactcacatgacccaaatgtagcaagtttcctaaggtacaatagtggattcagaacttgacgttctgaggcacatcctcactgtaaacagtaatgctatatgcatgaagcttctgtttattgttttccatatttaaggaaacaacatcccataatagaaatgagcatgcagggctaaggcatataggatttttctgcaggactttaaagctttgaaaggccaatatcccataggctaactttaaacatgtatttttatttttgttttgttttttacttttcatatttatattagcatacaaggacaattgtatatatgtaacatttttaaaattttaaaaaaatgcagctgttacacacaagtgtattttgccaaatgcctaaaaattccgtcacaatcacatcatcgtcatccatccagtgatcttcaaagactataagcaggtaatgtaaatatagtggtcaatgctgtaaatgtgtctctccataattcgtatttgtccaaaacatgtgatatccctttaacctgtgcacagtctggaggcagttttattgagtgagtagttgagtgagagaacaaaatgcccagcaaaacttctggcctccacagtttgctgatgcaggagcccactctgctgccgatgggctgctccctggaaatcatctatcccatccgtccatcccatctcatcccagtgagccagcccctcagcagtgtgtgctgctgagattaagcaagtgcaccaaagacacatgagacaacgtactgccagtgagctggtagcttctggtttgccaatactctaaccctttgtggcctgaagttttgttccttggcaaaactttgtagtcacccttatctg

SEQ ID NO: 76272 - DNA, 4046 bp, Homo sapiens
agcggactcgctggctccccccgccagcggaagcgtccgcgaagcacaatgcagcactgagccgcggtggaggttgcagcgctacggccgccgcagcaccggccggggctgggtggaggtggccgcggggaccccgggggcgcggagcgagggaaacggactcggcggcgccggcatgaggagctgagcgtctcgggcgaggcgggctgacggcagcaccatgcaggcggcagtggctgtgtccgtgcccttcttgctgctctgtgtcctggggacctgccctccggcgcgctgcggccaggcaggagacgcctcattgatggagctagagaagaggaaggaaaaccgcttcgtggagcgccagagcatcgtgccactgcgcctcatctaccgctcgggcggcgaagacgaaagtcggcacgacgcgctcgacacgcgggtgcggggcgacctcggtggcccgcagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagtatttaaacccatggttcaaaagagactataatgtagctaagtgggtagaagatgtgaataaaaacactgaagaaccatactttaggactttatctcctgccaagtctccttcttcatcaactgggtctattgcctccagcagaaaatacccttacccaatgcctccacttcctgatgaggacaagaaagtgaaccgacaaagtgccaggctatgggagacatccatttaagatcaactgtttacatgtgatacatcgaaaactgtttacttcaacttttacttcagacaatacgaagaccctctgagatgctacagaggagaggaagcggagtttcacatctggttaccattttctttttgtcattggcttaggatttaactaaccatgaaaagaactactgaaatattacactataacatggaacaataaaggtactggtatgttaatggataatccgcatgacagataatatgtagaaatattcataaagttaactcacatgacccaaatgtagcaagtttcctaaggtacaatagtggattcagaacttgacgttctgaggcacatcctcactgtaaacagtaatgctatatgcatgaagcttctgtttattgttttccatatttaaggaaacaacatcccataatagaaatgagcatgcagggctaaggcatataggatttttctgcaggactttaaagctttgaaaggccaatatcccataggctaactttaaacatgtatttttatttttgttttgttttttacttttcatatttatattagcatacaaggacaattgtatatatgtaacatttttaaaattttaaaaaaatgcagctgttacacacaagtgtattttgccaaatgcctaaaaattccgtcacaatcacatcatcgtcatccatccagtgatcttcaaagactataagcaggtaatgtaaatatagtggtcaatgctgtaaatgtgtctctccataattcgtatttgtccaaaacatgtgatatccctttaacctgtgcacagtctggaggcagttttattgagtgagtagttgagtgagagaacaaaatgcccagcaaaacttctggcctccacagtttgctgatgcaggagcccactctgctgccgatgggctgctccctggaaatcatctatcccatccgtccatcccatctcatcccagtgagccagcccctcagcagtgtgtgctgctgagattaagcaagtgcaccaaagacacatgagacaacgtactgccagtgagctggtagcttctggtttgccaatactctaaccctttgtggcctgaagttttgttccttggcaaaactttgtagtcacccttatctg

SEQ ID NO: 76273 - DNA, 4051 bp, Homo sapiens
agcggactcgctggctccccccgccagcggaagcgtccgcgaagcacaatgcagcactgagccgcggtggaggttgcagcgctacggccgccgcagcaccggccggggctgggtggaggtggccgcggggaccccgggggcgcggagcgagggaaacggactcggcggcgccggcatgaggagctgagcgtctcgggcgaggcgggctgacggcagcaccatgcaggcggcagtggctgtgtccgtgcccttcttgctgctctgtgtcctggggacctgccctccggcgcgctgcggccaggcaggagacgcctcattgatggagctagagaagaggaaggaaaaccgcttcgtggagcgccagagcatcgtgccactgcgcctcatctaccgctcgggcggcgaagacgaaagtcggcacgacgcgctcgacacgcgggtgcggggcgacctcggtggcccgcagattcagatgtttttgaagtcagaatcccagaagaccatataccagatacagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagactttatctcctgccaagtctccttcttcatcaactgggtctattgcctccagcagaaaatacccttacccaatgcctccacttcctgatgaggacaagaaagtgaaccgacaaagtgccaggctatgggagacatccatttaagatcaactgtttacatgtgatacatcgaaaactgtttacttcaacttttatagaaacccaggctcatggaatcactgcaaatctatctgctcttcagacaatacgaagaccctctgagatgctacagaggagaggaagcggagtttcacatctggttaccattttctttttgtcattggcttaggatttaactaaccatgaaaagaactactgaaatattacactataacatggaacaataaaggtactggtatgttaatggataatccgcatgacagataatatgtagaaatattcataaagttaactcacatgacccaaatgtagcaagtttcctaaggtacaatagtggattcagaacttgacgttctgaggcacatcctcactgtaaacagtaatgctatatgcatgaagcttctgtttattgttttccatatttaaggaaacaacatcccataatagaaatgagcatgcagggctaaggcatataggatttttctgcaggactttaaagctttgaaaggccaatatcccataggctaactttaaacatgtatttttatttttgttttgttttttacttttcatatttatattagcatacaaggacaattgtatatatgtaacatttttaaaattttaaaaaaatgcagctgttacacacaagtgtattttgccaaatgcctaaaaattccgtcacaatcacatcatcgtcatccatccagtgatcttcaaagactataagcaggtaatgtaaatatagtggtcaatgctgtaaatgtgtctctccataattcgtatttgtccaaaacatgtgatatccctttaacctgtgcacagtctggaggcagttttattgagtgagtagttgagtgagagaacaaaatgcccagcaaaacttctggcctccacagtttgctgatgcaggagcccactctgctgccgatgggctgctccctggaaatcatctatcccatccgtccatcccatctcatcccagtgagccagcccctcagcagtgtgtgctgctgagattaagcaagtgcaccaaagacacatgagacaacgtactgccagtgagctggtagcttctggtttgccaatactctaaccctttgtggcctgaagttttgttccttggcaaaactttgtagtcacccttatctg

SEQ ID NO: 76274 - DNA, 2211 bp, Homo sapiens
aatgtccatcagtgatagactggattaagaaaatgtggcacatatacaccatggaatactatgcagccataaaaaatgatgagttcatgtcatttgtagggacatggatgaagctggaaaccatcattctgagcaaactatcacaaggacagaaaaccagacaccgcatgttctcactcataggtgggaattgaataatgagaacatatggacacaggggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagactttatctcctgccaagtctccttcttcatcaactgggtctattgcctccagcagaaaatacccttacccaatgcctccacttcctgatgaggacaagaaagtgaaccgacaaagtgccaggctatgggagacatccatttaagatcaactgtttacatgtgatacatcgaaaactgtttacttcaacttttatagaaacccaggctcatggaatcactgcaaatctatctgctcttcagacaatacgaagaccctctgagatgctacagaggagaggaagcggagtttcacatctggttaccattttctttttgtcattggcttaggatttaactaaccatgaaaagaactactgaaatattacactataacatggaacaataaaggtactggtatgttaatggataatccgcatgacagataatatgtagaaatattcataaagttaactcacatgacccaaatgtagcaagtttcctaaggtacaatagtggattcagaacttgacgttctgaggcacatcctcactgtaaacagtaatgctatatgcatgaagcttctgtttattgttttccatatttaaggaaacaacatcccataatagaaatgagcatgcagggctaaggcatataggatttttctgcaggactttaaagctttgaaaggccaatatcccataggctaactttaaacatgtatttttatttttgttttgttttttacttttcatatttatattagcatacaaggacaattgtatatatgtaacatttttaaaattttaaaaaaatgcagctgttacacacaagtgtattttgccaaatgcctaaaaattccgtcacaatcacatcatcgtcatccatccagtgatcttcaaagactataagcaggtaatgtaaatatagtggtcaatgctgtaaatgtgtctctccataattcgtatttgtccaaaacatgtgatatccctttaacctgtgcacagtctggaggcagttttattgagtgagtagttgagtgagagaacaaaatgcccagcaaaacttctggcctccacagtttgctgatgcaggagcccactctgctgccgatgggctgctccctggaaatcatctatcccatccgtccatcccatctcatcccagtgagccagcccctcagcagtgtgtgctgctgagattaagcaagtgcaccaaagacacatgagacaacgtactgccagtgagctggtagcttctggtttgccaatactctaaccctttgtggcctgaagttttgttccttggcaaaactttgtagtcacccttatctg

SEQ ID NO: 76275 - DNA, 460 bp, Homo sapiens
ccctgtatttagtgcacagatctttttttcaagccaaaggtggaaatgtaagggacattggctgctttctccatcagggcttctggcccatgtctctctgttatagaaagtgatgtgcaaccaggatgggagaggcctcttgtcatcctagttgataaaatgattccttacaaaaaatggtctagaaaaaaaaaagagtaacaaatttaaaaagaatttttttaaaacctcaaaccgtaccaccaggtgtcactataacccaaagcactgctggtaatttttccattcaattgtaaagaaatgcaaaaactccacattttaagtaaatgagtactgtcttacaaggctttccctgtcagtaacttacgttgccatacagttactaaactgaatattctaaacagatgagaaaaggcacaagccttattttttttaaaaaattgtaaatagtgattaatga

SEQ ID NO: 76276 - DNA, 421 bp, Homo sapiens
aactgggttctaaccaaaacaacaacaacactcgctgacttcaaaggtctgttgactcgaggagataaatctcccagtcctagttggttcttttcagagaggtgcagaaaagaccccctagaatggagctgttgagccaatcacctttccacagcaagacataaagcggagcatctggggagagaaataaagcttacaaacaaaactcggggaaaggagaaagagaaaggtcattcgtccttttcaaagatgcttacttacactgttgattttattatattcaaaactacccaaatatcagacatccagtctgactgctcttttcttttaatcacttggagctcatttctgaaaatagcactctggtcctcagtgagccagattttgcaaactgcccatacattcccgttatcacatttta

SEQ ID NO: 76277 - DNA, 424 bp, Homo sapiens
gccagatgtccttaagtggataaatggttaaacaaactgtggtacatccataccgtggaatactcagaacaagaacttaaactattgatacaacaatctgaatagtctccagagaactatgctgagttagaaagtcattccctaggccagacacagtggctcacgcctataatccaagcactttgggaggccgaggcaggcggatcacgaggtcaagagatcgagaccatcctggccaacatggtgaaatcccatctctactaaaaatacaaaaattagctgggcatggtggcgcacacctgtagtcccagctacttgggcagctgaggcaggagaatcgcttgaactcaggaggtgaaggttgcagtgagccgagattgcactattgcactccagcctggtgacagacggagactctgtctca

SEQ ID NO: 76278 - DNA, 725 bp, Homo sapiens
gctagggccagaagagagaggtaggcagggctgctggccaggcactcttcaccaagacaaggcaagaggaggggcatgattgaggcagtgatacagaaagcagacagtagaggtcgtggcaagtgtgccgttacttgctacctgtggttgatgggagagtcacaccacatttaggaggagagaatccatttgccacttctgacaatgccacaagaatcacatatttcatccagaggttgaatttggcccatgctgagctttaaaatacagagctgtcttggaacaatggctcagtacattcatttggtgtccaacaaagcctgcctctgttgccttccctctctctgtgtgcccttcaagatcttcattgtgctttggggagagaaagagaaaatgtcatatcagggtagctcaccccatgtgtcctggactcaggaaaagagtatcttatcaccttactcttttgttattataaaaaataaagttgaacgtcttcaaataaaataaagaagtatagaaaaaattttaaattaacctgttatgattctacctagagaaccattgtcaacatcttggtatatgtacttccagatactttcctatgaatatatacattgtagattttttaatattaaaaggctatcatgctgctttgtatacaggctttctttactgatatgtaatataatacacagacaaatatacaaatcctaagccatcaactc

SEQ ID NO: 76279 - DNA, 815 bp, Homo sapiens
ttatctagagctgtaatctagatattttatagatctttgctgtgctgttttgaatttgtgttggagtagaacaatcagatgacaaaagctcatcccacatggaaaaatcaaagcattcattacagagagaattttgaaataaatgcatatataaaaaatatatatgcatatataatgcatatgtatatgcatataaaatatatatataaaatgggggttataaacaatgaaggaaatagtgatactatctatgtgggaacaatactagtatcctccctttggatgaatacagtagctacagatgcaattctggggactctgtttagcaatagcttaactattgcttggctacaagcatggataacttgttcaaagataatgaggagttgtaaatatttaaataaacaggatttgcaacataaaaagctttgtgactatgtgtctgaattcttagagttttctcccagcaagaccttggatgtggcagacttttctgtaattgtccatctcgcccctatttcatgaaaagccagagcttctctacttagtttgctaaccccaaatatataaattcaatagaagtactagcctgtttttactggtttatttgctttatctaaaaaaaacaaggcatagtttaaagtctgtttttgatagcataacaaaacaaaggttctcattttaataatgcatcacatatacacttggtaactattgcatagtaataatttaataacttgagaaatatatttatgcatgtatgtgtatatgttcatatatatgttatttttaattcagaagtaaaacaaatattg

SEQ ID NO: 76280 - DNA, 316 bp, Homo sapiens
ggcatattgcaaaataatatgttcatgtataatctcaatttagtttcattgatgtcataaacatcaatatacgtctacaaatataaaaaaagatcagaacaaggatctgaggggaaaaaattatttaaaagataaaatttaaaagctcaaaaatgtatacatcaaaatgttaacagtagtcaggtatagtggtgcacgcctgtggttccagctattccggaggctgaggcaggagatggcttgaggctgggagtttgaggctacagtgagctgtgatcgtgcctataaatagccactacactccagcctgagcaat

SEQ ID NO: 76281 - DNA, 504 bp, Homo sapiens
tttatcccccccatcacaaaactattataatttcaaaatagttacaagtacaatgtattccaagtggcttcttatttaagataattatattcacagagcagggaccgtttcaggtcctttaatgctgaaaggctaaataaagagaactttttattttttccatgttaatacatggatgatattaaccatgatgtttaatagctacagaatactgcatgaaatggatgtactataattcatttagcctttttcgtatttagagatttaagcagtagccaatttttcaccattacaagtggtgcaaggaccaatatcttcatgaatacagcattttctgtaaagcagaaattctttcttcaggattaatttccagatatctttctggtattagacacataccacttgcctaataacgttccaaaaggaattcattgtttacattgctattagaacatatgagattgcctgtttcattatgtccgtcccagcactgggtattatcat

SEQ ID NO: 76282 - DNA, 412 bp, Homo sapiens
taaaccagatgaaaatttattgaagcagaaaagtcatgatcatttaccggcaaaaaaaatcaggttacaaaacagtatgcacagtatgatctcattttctggagaaaattgacatataagcatggaaacagctctggaaaggtctgacagaagtgtcattgaggcgctgctgagagataggacacaatactttttattttgcttgtccctatttccagttttctgcaatgcatatccaccgcttctgtagtaatctcagagtatgcttttaaaagaaaaaaatcactgaccctccccgaaggtgggagaatccctggcttggcagaggtttctaaaacagatccctggaggtttcggtggccagaaacttaatatgagcagagtgcagtgccccattcagaggcagccccac

SEQ ID NO: 76283 - DNA, 513 bp, Homo sapiens
tatgcctttataaagttgatttcatcatcttaatttctccatactagcaattagcagctagaaaatgaaattcaataaaacataatagagattaatagccagaatcattacatgcttaacaatacatgcaatgaagcaggtacaaggcccctaaaagcaattggtgagaaaaattaaagaaggctaaataaatatatatcatgttcattgattggaagactcaattttgttagcatattacatcaacacaattctgattaatatttctagtaggagattttagagaaatttgaaagctagtttcaaaatgtatttgaaaatcaaagaacctagaataagcaagtcggtcttgaagaagcaataagttggaggacttactctgctagatttcaaacctgattttaaagctacagtaattttaaaacagtagtaatggtgtaagtattcataaatatatcaaagtaaaagaatacagattcaaacaatatgcccacatatgtacagttattgatt

SEQ ID NO: 76284 - DNA, 871 bp, Homo sapiens
gggttttttttttaaaaaaagaacaacctcagaaaacagtcttgttattcttatgtcagtttcacagctaacaataaataatgccaaattgttggcttaaaaacaagaagcattatttgtatggtttttacaaatggcaatgttgttctttacaaaaagtttaaaaccagagcattggtagtttttctaaatacttttattggcagtggtttagtagccagccctattaatctcaaggcaacaggagttcgtttttacagagataccaggccatatttgtccaagtgctcagtatgtgactcataagtgttcctgtgctattggatgacttccagatctttgccagaactaaccttcttagacatttgaatcaaattaaagttctttagctgagatcttagtggtgtagtctttccctaatacagtaatcctctccactcttaagcacaaacattaaaagattaccatgcaaactccacatgggtgaagacatctcttaattaaagcataataaatattgtagttcatagtatagttcaaataacgaatgtttatttctgttaggtatattaaaaattcaaatagttagaaaagtcagaattctttttaaaagaggtaataaaatggggacaattgaatttgggttgtgacaacttaaaaacaccaatacttttataccctgtttctctaggatggtctaaatcataaatgttctttgtcatcaataacttatagaataagaaccctcctcttttccaagacatgtttttaaaatagtaggtatttacggtatactacattccagctttaaaatacatttttccagatactaactcctttcctctcataataaattttgagaacttactaa

SEQ ID NO: 76285 - DNA, 491 bp, Homo sapiens
aaggggtccataataattattttagaaaatggaaaaatgaatataatctgagaagaaaaaacacagctgtttatcttagcacttttgaaaagcaagtagagaaagatagcactctacaaacctagatttaaatccaaaggtggctgttatcttattgttgttctcataggattttattatctgtattgagatgttcctcgctgccattgctcatcattacacattctcatataaaccatatgtccaagaagcagaagagggctcatgctttgattcctttcttgccatgtgggatgtctcagatattagagatgatatttctgaacaagtaaggcatgttggtaagtaccagctatttaattcaaccaaataggttgggtaggatattgaatttctcctactagggcaatttattatctatttagagatgaaaaaagactttaaagcagtaccacagtgcaggctcatcaactttggggagtgggagaggg

SEQ ID NO: 76286 - DNA, 5150 bp, Homo sapiens
agcttggtttggccttgggttccgctgtaggggaggtcccgtgcgaaagaatgaggagatcctggggccttacctactagcggaatcgactgaagagacgcctgccagtgcgggaggtaggaagctcgatccccaaagaaaagagcgagtgggcaggcagctgcgagacagaaccggagtgtgcagggtccctagaggccggttcctggtctgtgctgctctcctggaagccatggtacaggcagagctcagggcgatccccaggtgagggcagcggctctgcctgggattccaccgcagtacaaccgggtagatgcggggtggagaagaaaggatgttgcctgcactgctcgccaatagcaccctgagaggctacatttgcagaagcagcagcagcagaagacacagcgccggtccaggaggcggctcgagctgttcgtaaagtcgcccgacagctttttctccgtagtatgcgagttgacaaaacagccagagaacagggctccccattacaatcttttcgagatcttttcccttgctaaccggatctgatttgtgcgaaaacatgccttgcacttgtacctggaggaactggagacagtggattcgacctttagtagcggtcatctacctggtgtcaatagtggttgcggttcccctatgcgtgtgggaattacagaaactggaggttggaatacacaccaaggcttggtttattgctggaatctttttgctgttgactattcctatatcactgtgggtgatattgcaacacttagtgcattatacacaacctgaactacaaaaaccaataataaggattctttggatggtacctatttacagtttagatagttggatagctttgaaatatcccggaattgcaatatatgtggatacctgcagagaatgctatgaagcttatgtaatttacaactttatgggattccttaccaattatctaactaaccggtatccaaatctggtattaatccttgaagccaaagatcaacagaaacatttccctcctttatgttgctgtccaccatgggctatgggagaagtattgctgtttaggtgcaaactaggtgtattacagtacacagttgtcagacctttcaccaccatcgttgctttaatctgtgagctgcttggtatatatgacgaagggaactttagcttttcaaatgcttggacttatttggttataataaacaacatgtcacagttgtttgccatgtattgtctcctgctcttttataaagtactaaaagaagaactgagcccaatccaacctgttggcaaatttctttgtgtaaagctggtggtttttgtttctttttggcaagcagtagttattgctttgttggtaaaagttggcgttatttctgaaaagcatacgtgggaatggcaaactgtagaagctgtggccaccggactccaggattttattatctgtattgagatgttcctcgctgccattgctcatcattacacattctcatataaaccatatgtccaagaagcagaagagggctcatgctttgattcctttcttgccatgtgggatgtctcagatattagagatgatatttctgaacaagtaaggcatgttggacggacagtcaggggacatcccaggaaaaaattgtttcccgaggatcaagatcaaaatgaacatacaagtttattatcatcatcatcacaagatgcaatttccattgcttcttctatgccaccttcacccatgggtcactaccaagggtttggacacactgtgactccccagactacacctaccacagctaagatatctgatgaaatccttagtgatactataggagagaaaaaagaaccttcagataaatccgtggattcctgaacagtatggaaaagcaaactgtgcaactactacattatatcattacctggtatcccatggattttgtgcttgggacagaccataaatgatggaaaatgtcaacacaaaaatagctgaaagccaggtacaactactgcatttatatatgtaagttttgtatatcaaaaataattggtctaaatttcctagacttagacttgatttcttaacattagggtatcgcatactcaaatggtagacaatgaccccaactaaatcttcctgatgttacactgctttatcaagaggatggactttttttttttgagacagacagagtcttgctctgtcacccaggctggagtgcagtggcgcaatctcgggtcactgcaagctctgcctcccaagttcatgccattctcctgcctcagcctcccaagtagctgggactacaggcacctgccaccatgcccagctaattttttttttttcagtagagacagggtctcaccatgttagccaggatggtcttgatctgacctcgtgatccgccgacctcggcctcccaaagtgctggaattacaggcgtgagccactgcgcctggccaagaatggacattttttaaaaaaacatcagtacttcctaccactgctgcatgagtataatgctccggaattatcagaaagcataatgcagaaatacgaattagtggaacttaatcatgtgccatataagcttacctaacaaacagttatatccctattcctcaactgaatgtctttcaataaataagaatttatcatttattttctgcaacttttttatgtctcattctttaaacattaaaaacccttaatattttaacaaaaatttcttgattagaggcacagtgaaaaagaagtcaaaaaaaaaagttctacttttcatcagtgctattaaaggtggcagcaaatgtaaatcttggctgaatggtcttaattactcattaaaccacagtcagaaagacatataggtgctatttgggaaaactttttattacctaggatggggtttctctaattgctaatcacaaccccactgggtcatgtttgacattttataatgaaaataaaacagaaagtgccacagtatgttacagaaagcaaagatgagtattgtttctcaaagcctttgctttatgtatttatacacatactcattcatatctatctatatatatagagagagatagtggttcacagtaatcatacaaagtctttattccatccactattataaacatttctattaaaactaaaactgggctctatgtaaaaaccccaaagatacacacacaaaaaaaatctgtttgttagaactcaagtgaattcagtaaagttgcagaatacaaaatcaacatacaaaaagcattagcatttttatacataaataatgaaaataatgacctaactgaaaaattaagatgccatttatgatagcataaaaaaaatacttacttaggaataaatttaacaccaaggcagtaaaagatctgtatgtacactgaaaactatgaaacactgatgaaagaaagacacaaataaatggaaaggtatcccgtgctcatggatcagaataatactgttaaaatggtcacactacccaaagcaattcagaatcaatgcaatcctatcaaaattccaatggcattatttacacaaacagaaaaaaatcctaaaattcatatgtaacgataaaagaccctgaataggcaaaagaatactgaggaaaaaatgttggagacatcacatttcctaattataaattatactacaaaactatagtaatcaagacagtatggtactggtataaaaacacatacacaggccagtgggacagaagaaagagtccagatataaatccaaacatacacagtcaactaatttttgacaaagacaccaagaagacacatcggggaaagaacagtcttcattaagtgttcttaataaagatgctgggaaaactgcacttccacatgcaaaacaatgaaatcagacccttatcttagacctacacaacaatcaattcaaaatggataaaagacctaaatgtaagaccagaaactatagaagagaacataggagaaaagttcctggacactgacccttggcaatgattttttggatatcacaccaaaagctcagtcaacaaaaacaaaaacaaatgtgactacatcaaaccaaaaagcttctgacagtaaaagaaacagtcaacaaaatgaaacagtagcctacagattgagtaaaaaatatttgtaaggcatatatatggaaaagggttagtatccaaaatttataaagaattcatacaactcaattttaaaaatgggcaaaagacctgaaaagacatttctccgaagacgacacacagatggccaacaggtatataaaagggtgctcaacataattaatcatcaaggaaatgcatataaaaaccactcgaagtactacctctcaccagttaggctagctgttatcaaaaaaaacaaaagacaacaaatgttgtgatggtgtggaataaaaggaactctgtgcactgttggtgggaatgtagattggtacagccattatggaaaacagaatggaagtttctaaagaaaaataaaactaccatacgatccagcaatccctcttctgggcatatactcaaagtaaatgaaatcaccaccttgtaaatatatctgcagtccgtgttcattgcagcattattcatagtagccaacatggagacaactgaagtgtccgttgacagatgaataaagaaactgtgtatatatatgcctacacacaatggaatattattcatccctaaaaaaaaaaaaaccaacgatatcttgccatttgctacaacatggatgggcctgaaggacactgtgctaaatgaaataagccagacagaaaaaaagatactgcataatttcacatatatgtggaatctaaaaaaaaaatttaaatatataaagagcaaaactggttatagggggatagggagaaatggggaatgtaggtcaaaggattcaaggtagcagatatgtaggatgaataagtctagagatctattgtacaacatgaggattttaggtaacaaatttgtactgtatttgggattcatggtaaatgagtagatgtcagctgctgttgtcaaaaacaaaaaatatgtgggtaactgagatgatggatatgttaatttgcttcacattgtataccttaaatgtatgcaataaaatttattttaaaaataaaaaaaata

SEQ ID NO: 76287 - DNA, 5114 bp, Homo sapiens
agcttggtttggccttgggttccgctgtaggggaggtcccgtgcgaaagaatgaggagatcctggggccttacctactagcggaatcgactgaagagacgcctgccagtgcgggaggtaggaagctcgatccccaaagaaaagagcgagtgggcaggcagctgcgagacagaaccggagtgtgcagggtccctagaggccggttcctggtctgtgctgctctcctggaagccatggtacaggcagagctcagggcgatccccaggtgagggcagcggctctgcctgggattccaccgcagtacaaccgggtagatgcggggtggagaagaaaggatgttgcctgcactgctcgccaatagcaccctgagaggctacatttgcagaagcagcagcagcagaagacacagcgccggtccaggaggcggctcgagctgttcgtaaagtcgcccgacagctttttctccgtagtatgcgagttgacaaaacagccagagaacagggctccccattacaatcttttcgagatcttttcccttgctaaccggatctgatttgtgcgaaaacatgccttgcacttgtacctggaggaactggagacagtggattcgacctttagtagcggtcatctacctggtgtcaatagtggttgcggttcccctatgcgtgtgggaattacagaaactggaggttggaatacacaccaaggcttggtttattgctggaatctttttgctgttgactattcctatatcactgtgggtgatattgcaacacttagtgcattatacacaacctgaactacaaaaaccaataataaggattctttggatggtacctatttacagtttagatagttggatagctttgaaatatcccggaattgcaatatatgtggatacctgcagagaatgctatgaagcttatgtaatttacaactttatgggattccttaccaattatctaactaaccggtatccaaatctggtattaatccttgaagccaaagatcaacagaaacatttccctcctttatgttgctgtccaccatgggctatgggagaagtattgctgtttaggtgcaaactaggtgtattacagtacacagttgtcagacctttcaccaccatcgttgctttaatctgtgagctgcttggtatatatgacgaagggaactttagcttttcaaatgcttggacttatttggttataataaacaacatgtcacagttgtttgccatgtattgtctcctgctcttttataaagtactaaaagaagaactgagcccaatccaacctgttggcaaatttctttgtgtaaagctggtggtttttgtttctttttggcaagcagtagttattgctttgttggtaaaagttggcgttatttctgaaaagcatacgtgggaatggcaaactgtagaagctgtggccaccggactccaggattttattatctgtattgagatgttcctcgctgccattgctcatcattacacattctcatataaaccatatgtccaagaagcagaagagggctcatgctttgattcctttcttgccatgtgggatgtctcagatattagagatgatatttctgaacaagtaaggcatgttggacggacagtcaggggacatcccaggaaaaaattgtttcccgaggatcaagatcaaaatgaacatacaagtttattatcatcatcatcacaagatgcaatttccattgcttcttctatgccaccttcacccatgggtcactaccaagggtttggacacactgtgactccccagactacacctaccacagctaagatatctgatgaaatccttagtgatactataggagagaaaaaagaaccttcagataaatccgtggattcctgaacagtatggaaaagcaaactgtgcaactactacattatatcattacctggtatcccatggattttgtgcttgggacagaccataaatgatggaaaatgtcaacacaaaaatagctgaaagccaggtacaactactgcatttatatatgtaagttttgtatatcaaaaataattggtctaaatttcctagacttagacttgatttcttaacattagggtatcgcatactcaaatggtagacaatgaccccaactaaatcttcctgatgttacactgctttatcaagaggatggactttttttttttgagacagacagagtcttgctctgtcacccaggctggagtgcagtggcgcaatctcgggtcactgcaagctctgcctcccaagttcatgccattctcctgcctcagcctcccaagtagctgggactacaggcacctgccaccatgcccagctaattttttttttttcagtagagacagggtctcaccatgttagccaggatggtcttgatctgacctcgtgatccgccgacctcggcctcccaaagtgctggaattacaggcgtgagccactgcgcctggccaagaatggacattttttaaaaaaacatcagtacttcctaccactgctgcatgagtataatgctccggaattatcagaaagcataatgcagaaatacgaattagtggaacttaatcatgtgccatataagcttacctaacaaacagttatatccctattcctcaactgaatgtctttcaataaataagaatttatcatttattttctgcaacttttttatgtctcattctttaaacattaaaaacccttaatattttaacaaaaatttcttgattagaggcacagtgaaaaagaagtcaaaaaaaaaagttctacttttcatcagtgctattaaaggtggcagcaaatgtaaatcttggctgaatggtcttaattactcattaaaccacagtcagaaagacatataggtgctatttgggaaaactttttattacctaggatggggtttctctaattgctaatcacaaccccactgggtcatgtttgacattttataatgaaaataaaacagaaagtgccacagtatgttacagaaagcaaagatgagtattgtttctcaaagcctttgctttatgtatttatacacatactcattcatatctatctatatatatagagagagatagtggttcacagtaatcatacaaagtctttattccatccactattataaacatttctattaaaactaaaactgggctctatgtaaaaaccccaaagatacacacacaaaaaaaatctgtttgttagaactcaagtgaattcagtaaagttgcagaatacaaaatcaacatacaaaaagcattagcatttttatacataaataatgaaaataatgacctaactgaaaaattaagatgccatttatgatagcataaaaaaaatacttacttaggaataaatttaacaccaaggcagtaaaagatctgtatgtacactgaaaactatgaaacactgatgaaagaaagacacaaataaatggaaaggtatcccgtgctcatggatcagaataatactgttaaaatggtcacactacccaaagcaattcagaatcaatgcaatcctatcaaaattccaatggcattatttacacaaacagaaaaaaatcctaaaattcatatgtaacgataaaagaccctgaataggcaaaagaatactgaggaaaaaatgttggagacatcacatttcctaattataaattatactacaaaactatagtaatcaagacatgggacagaagaaagagtccagatataaatccaaacatacacagtcaactaatttttgacaaagacaccaagaagacacatcggggaaagaacagtcttcattaagtgttcttaataaagatgctgggaaaactgcacttccacatgcaaaacaatgaaatcagacccttatcttagacctacacaacaatcaattcaaaatggataaaagacctaaatgtaagaccagaaactatagaagagaacataggagaaaagttcctggacactgacccttggcaatgattttttggatatcacaccaaaagctcagtcaacaaaaacaaaaacaaatgtgactacatcaaaccaaaaagcttctgacagtaaaagaaacagtcaacaaaatgaaacagtagcctacagattgagtaaaaaatatttgtaaggcatatatatggaaaagggttagtatccaaaatttataaagaattcatacaactcaattttaaaaatgggcaaaagacctgaaaagacatttctccgaagacgacacacagatggccaacaggtatataaaagggtgctcaacataattaatcatcaaggaaatgcatataaaaaccactcgaagtactacctctcaccagttaggctagctgttatcaaaaaaaacaaaagacaacaaatgttgtgatggtgtggaataaaaggaactctgtgcactgttggtgggaatgtagattggtacagccattatggaaaacagaatggaagtttctaaagaaaaataaaactaccatacgatccagcaatccctcttctgggcatatactcaaagtaaatgaaatcaccaccttgtaaatatatctgcagtccgtgttcattgcagcattattcatagtagccaacatggagacaactgaagtgtccgttgacagatgaataaagaaactgtgtatatatatgcctacacacaatggaatattattcatccctaaaaaaaaaaaaaccaacgatatcttgccatttgctacaacatggatgggcctgaaggacactgtgctaaatgaaataagccagacagaaaaaaagatactgcataatttcacatatatgtggaatctaaaaaaaaaatttaaatatataaagagcaaaactggttatagggggatagggagaaatggggaatgtaggtcaaaggattcaaggtagcagatatgtaggatgaataagtctagagatctattgtacaacatgaggattttaggtaacaaatttgtactgtatttgggattcatggtaaatgagtagatgtcagctgctgttgtcaaaaacaaaaaatatgtgggtaactgagatgatggatatgttaatttgcttcacattgtataccttaaatgtatgcaataaaatttattttaaaaataaaaaaaata

SEQ ID NO: 76288 - DNA, 4720 bp, Homo sapiens
agcttggtttggccttgggttccgctgtaggggaggtcccgtgcgaaagaatgaggagatcctggggccttacctactagcggaatcgactgaagagacgcctgccagtgcgggaggtaggaagctcgatccccaaagaaaagagcgagtgggcaggcagctgcgagacagaaccggagtgtgcagggtccctagaggccggttcctggtctgtgctgctctcctggaagccatggtacaggcagagctcagggcgatccccaggtgagggcagcggctctgcctgggattccaccgcagtacaaccgggtagatgcggggtggagaagaaaggatgttgcctgcactgctcgccaatagcaccctgagaggctacatttgcagaagcagcagcagcagaagacacagcgccggtccaggaggcggctcgagctgttcgtaaagtcgcccgacagctttttctccgtagtatgcgagttgacaaaacagccagagaacagggctccccattacaatcttttcgagatcttttcccttgctaaccggatctgatttgtgcgaaaacatgccttgcacttgtacctggaggaactggagacagtggattcgacctttagtagcggtcatctacctggtgtcaatagtggttgcggttcccctatgcgtgtgggaattacagaaactggaggttggaatacacaccaaggcttggtttattgctggaatctttttgctgttgactattcctatatcactgtgggtgatattgcaacacttagtgcattatacacaacctgaactacaaaaaccaataataaggattctttggatggtacctatttacagtttagatagttggatagctttgaaatatcccggaattgcaatatatgtggatacctgcagagaatgctatgaagcttatgtaatttacaactttatgggattccttaccaattatctaactaaccggtatccaaatctggtattaatccttgaagccaaagatcaacagaaacatttccctcctttatgttgctgtccaccatgggctatgggagaagtattgctgtttaggtgcaaactaggtgtattacagtacacagttgtcagacctttcaccaccatcgttgctttaatctgtgagctgcttggtatatatgacgaagggaactttagcttttcaaatgcttggacttatttggttataataaacaacatgtcacagttgtttgccatgtattgtctcctgctcttttataaagtactaaaagaagaactgagcccaatccaacctgttggcaaatttctttgtgtaaagctggtggtttttgtttctttttggcaagcagtagttattgctttgttggtaaaagttggcgttatttctgaaaagcatacgtgggaatggcaaactgtagaagctgtggccaccggactccaggattttattatctgtattgagatgttcctcgctgccattgctcatcattacacattctcatataaaccatatgtccaagaagcagaagagggctcatgctttgattcctttcttgccatgtgggatgtctcagatattagagatgatatttctgaacaagtaaggcatgttggacggacagtcaggggacatcccaggaaaaaattgtttcccgaggatcaagatcaaaatgaacatacaagtttattatcatcatcatcacaagatgcaatttccattgcttcttctatgccaccttcacccatgggtcactaccaagggtttggacacactgtgactccccagactacacctaccacagctaagatatctgatgaaatccttagtgatactataggagagaaaaaagaaccttcagataaatccgtggattcctgaacagtatggaaaagcaaactgtgcaactactacattatatcattacctggtatcccatggattttgtgcttgggacagaccataaatgatggaaaatgtcaacacaaaaatagctgaaagccaggtacaactactgcatttatatatgtaagttttgtatatcaaaaataattggtctaaatttcctagacttagacttgatttcttaacattagggtatcgcatactcaaatggtagacaatgaccccaactaaatcttcctgatgttacactgctttatcaagaggatggactttttttttttgagacagacagagtcttgctctgtcacccaggctggagtgcagtggcgcaatctcgggtcactgcaagctctgcctcccaagttcatgccattctcctgcctcagcctcccaagtagctgggactacaggcacctgccaccatgcccagctaattttttttttttcagtagagacagggtctcaccatgttagccaggatggtcttgatctgacctcgtgatccgccgacctcggcctcccaaagtgctggaattacaggcgtgagccactgcgcctggccaagaatggacattttttaaaaaaacatcagtacttcctaccactgctgcatgagtataatgctccggaattatcagaaagcataatgcagaaatacgaattagtggaacttaatcatgtgccatataagcttacctaacaaacagttatatccctattcctcaactgaatgtctttcaataaataagaatttatcatttattttctgcaacttttttatgtctcattctttaaacattaaaaacccttaatattttaacaaaaatttcttgattagaggcacagtgaaaaagaagtcaaaaaaaaaagttctacttttcatcagtgctattaaaggtggcagcaaatgtaaatcttggctgaatggtcttaattactcattaaaccacagtcagaaagacatataggtgctatttgggaaaactttttattacctaggatggggtttctctaattgctaatcacaaccccactgggtcatgtttgacattttataatgaaaataaaacagaaagtgccacagtatgttacagaaagcaaagatgagtattgtttctcaaagcctttgctttatgtatttatacacatactcattcatatctatctatatatatagagagagatagtggttcacagtaatcatacaaagtctttattccatccactattataaacatttctattaaaactaaaactgggctctatgtaaaaaccccaaagatacacacacaaaaaaaatctgtttgttagaactcaagtgaattcagtaaagttgcagaatacaaaatcaacatacaaaaagcattagcatttttatacataaataatgaaaataatgacctaactgaaaaattaagatgccatttatgatagcataaaaaaaatacttacttaggaataaatttaacaccaaggcagtaaaagatctgtatgtacactgaaaactatgaaacactgatgaaagaaagacacaaataaatggaaaggtatcccgtgctcatggatcagaataatactgttaaaatggtcacactacccaaagcaattcagaatcaatgcaatcctatcaaaattccaatggcattatttacacaaacagaaaaaaatcctaaaattcatatgtaacgataaaagaccctgaataggcaaaagaatactgaggaaaaaatgttggagcatcaaaccaaaaagcttctgacagtaaaagaaacagtcaacaaaatgaaacagtagcctacagattgagtaaaaaatatttgtaaggcatatatatggaaaagggttagtatccaaaatttataaagaattcatacaactcaattttaaaaatgggcaaaagacctgaaaagacatttctccgaagacgacacacagatggccaacaggtatataaaagggtgctcaacataattaatcatcaaggaaatgcatataaaaaccactcgaagtactacctctcaccagttaggctagctgttatcaaaaaaaacaaaagacaacaaatgttgtgatggtgtggaataaaaggaactctgtgcactgttggtgggaatgtagattggtacagccattatggaaaacagaatggaagtttctaaagaaaaataaaactaccatacgatccagcaatccctcttctgggcatatactcaaagtaaatgaaatcaccaccttgtaaatatatctgcagtccgtgttcattgcagcattattcatagtagccaacatggagacaactgaagtgtccgttgacagatgaataaagaaactgtgtatatatatgcctacacacaatggaatattattcatccctaaaaaaaaaaaaaccaacgatatcttgccatttgctacaacatggatgggcctgaaggacactgtgctaaatgaaataagccagacagaaaaaaagatactgcataatttcacatatatgtggaatctaaaaaaaaaatttaaatatataaagagcaaaactggttatagggggatagggagaaatggggaatgtaggtcaaaggattcaaggtagcagatatgtaggatgaataagtctagagatctattgtacaacatgaggattttaggtaacaaatttgtactgtatttgggattcatggtaaatgagtagatgtcagctgctgttgtcaaaaacaaaaaatatgtgggtaactgagatgatggatatgttaatttgcttcacattgtataccttaaatgtatgcaataaaatttattttaaaaataaaaaaaata

SEQ ID NO: 76289 - DNA, 4929 bp, Homo sapiens
agcttggtttggccttgggttccgctgtaggggaggtcccgtgcgaaagaatgaggagatcctggggccttacctactagcggaatcgactgaagagacgcctgccagtgcgggaggtaggaagctcgatccccaatagcaccctgagaggctacatttgcagaagcagcagcagcagaagacacagcgccggtccaggaggcggctcgagctgttcgtaaagtcgcccgacagctttttctccgtagtatgcgagttgacaaaacagccagagaacagggctccccattacaatcttttcgagatcttttcccttgctaaccggatctgatttgtgcgaaaacatgccttgcacttgtacctggaggaactggagacagtggattcgacctttagtagcggtcatctacctggtgtcaatagtggttgcggttcccctatgcgtgtgggaattacagaaactggaggttggaatacacaccaaggcttggtttattgctggaatctttttgctgttgactattcctatatcactgtgggtgatattgcaacacttagtgcattatacacaacctgaactacaaaaaccaataataaggattctttggatggtacctatttacagtttagatagttggatagctttgaaatatcccggaattgcaatatatgtggatacctgcagagaatgctatgaagcttatgtaatttacaactttatgggattccttaccaattatctaactaaccggtatccaaatctggtattaatccttgaagccaaagatcaacagaaacatttccctcctttatgttgctgtccaccatgggctatgggagaagtattgctgtttaggtgcaaactaggtgtattacagtacacagttgtcagacctttcaccaccatcgttgctttaatctgtgagctgcttggtatatatgacgaagggaactttagcttttcaaatgcttggacttatttggttataataaacaacatgtcacagttgtttgccatgtattgtctcctgctcttttataaagtactaaaagaagaactgagcccaatccaacctgttggcaaatttctttgtgtaaagctggtggtttttgtttctttttggcaagcagtagttattgctttgttggtaaaagttggcgttatttctgaaaagcatacgtgggaatggcaaactgtagaagctgtggccaccggactccaggattttattatctgtattgagatgttcctcgctgccattgctcatcattacacattctcatataaaccatatgtccaagaagcagaagagggctcatgctttgattcctttcttgccatgtgggatgtctcagatattagagatgatatttctgaacaagtaaggcatgttggacggacagtcaggggacatcccaggaaaaaattgtttcccgaggatcaagatcaaaatgaacatacaagtttattatcatcatcatcacaagatgcaatttccattgcttcttctatgccaccttcacccatgggtcactaccaagggtttggacacactgtgactccccagactacacctaccacagctaagatatctgatgaaatccttagtgatactataggagagaaaaaagaaccttcagataaatccgtggattcctgaacagtatggaaaagcaaactgtgcaactactacattatatcattacctggtatcccatggattttgtgcttgggacagaccataaatgatggaaaatgtcaacacaaaaatagctgaaagccaggtacaactactgcatttatatatgtaagttttgtatatcaaaaataattggtctaaatttcctagacttagacttgatttcttaacattagggtatcgcatactcaaatggtagacaatgaccccaactaaatcttcctgatgttacactgctttatcaagaggatggactttttttttttgagacagacagagtcttgctctgtcacccaggctggagtgcagtggcgcaatctcgggtcactgcaagctctgcctcccaagttcatgccattctcctgcctcagcctcccaagtagctgggactacaggcacctgccaccatgcccagctaattttttttttttcagtagagacagggtctcaccatgttagccaggatggtcttgatctgacctcgtgatccgccgacctcggcctcccaaagtgctggaattacaggcgtgagccactgcgcctggccaagaatggacattttttaaaaaaacatcagtacttcctaccactgctgcatgagtataatgctccggaattatcagaaagcataatgcagaaatacgaattagtggaacttaatcatgtgccatataagcttacctaacaaacagttatatccctattcctcaactgaatgtctttcaataaataagaatttatcatttattttctgcaacttttttatgtctcattctttaaacattaaaaacccttaatattttaacaaaaatttcttgattagaggcacagtgaaaaagaagtcaaaaaaaaaagttctacttttcatcagtgctattaaaggtggcagcaaatgtaaatcttggctgaatggtcttaattactcattaaaccacagtcagaaagacatataggtgctatttgggaaaactttttattacctaggatggggtttctctaattgctaatcacaaccccactgggtcatgtttgacattttataatgaaaataaaacagaaagtgccacagtatgttacagaaagcaaagatgagtattgtttctcaaagcctttgctttatgtatttatacacatactcattcatatctatctatatatatagagagagatagtggttcacagtaatcatacaaagtctttattccatccactattataaacatttctattaaaactaaaactgggctctatgtaaaaaccccaaagatacacacacaaaaaaaatctgtttgttagaactcaagtgaattcagtaaagttgcagaatacaaaatcaacatacaaaaagcattagcatttttatacataaataatgaaaataatgacctaactgaaaaattaagatgccatttatgatagcataaaaaaaatacttacttaggaataaatttaacaccaaggcagtaaaagatctgtatgtacactgaaaactatgaaacactgatgaaagaaagacacaaataaatggaaaggtatcccgtgctcatggatcagaataatactgttaaaatggtcacactacccaaagcaattcagaatcaatgcaatcctatcaaaattccaatggcattatttacacaaacagaaaaaaatcctaaaattcatatgtaacgataaaagaccctgaataggcaaaagaatactgaggaaaaaatgttggagacatcacatttcctaattataaattatactacaaaactatagtaatcaagacagtatggtactggtataaaaacacatacacaggccagtgggacagaagaaagagtccagatataaatccaaacatacacagtcaactaatttttgacaaagacaccaagaagacacatcggggaaagaacagtcttcattaagtgttcttaataaagatgctgggaaaactgcacttccacatgcaaaacaatgaaatcagacccttatcttagacctacacaacaatcaattcaaaatggataaaagacctaaatgtaagaccagaaactatagaagagaacataggagaaaagttcctggacactgacccttggcaatgattttttggatatcacaccaaaagctcagtcaacaaaaacaaaaacaaatgtgactacatcaaaccaaaaagcttctgacagtaaaagaaacagtcaacaaaatgaaacagtagcctacagattgagtaaaaaatatttgtaaggcatatatatggaaaagggttagtatccaaaatttataaagaattcatacaactcaattttaaaaatgggcaaaagacctgaaaagacatttctccgaagacgacacacagatggccaacaggtatataaaagggtgctcaacataattaatcatcaaggaaatgcatataaaaaccactcgaagtactacctctcaccagttaggctagctgttatcaaaaaaaacaaaagacaacaaatgttgtgatggtgtggaataaaaggaactctgtgcactgttggtgggaatgtagattggtacagccattatggaaaacagaatggaagtttctaaagaaaaataaaactaccatacgatccagcaatccctcttctgggcatatactcaaagtaaatgaaatcaccaccttgtaaatatatctgcagtccgtgttcattgcagcattattcatagtagccaacatggagacaactgaagtgtccgttgacagatgaataaagaaactgtgtatatatatgcctacacacaatggaatattattcatccctaaaaaaaaaaaaaccaacgatatcttgccatttgctacaacatggatgggcctgaaggacactgtgctaaatgaaataagccagacagaaaaaaagatactgcataatttcacatatatgtggaatctaaaaaaaaaatttaaatatataaagagcaaaactggttatagggggatagggagaaatggggaatgtaggtcaaaggattcaaggtagcagatatgtaggatgaataagtctagagatctattgtacaacatgaggattttaggtaacaaatttgtactgtatttgggattcatggtaaatgagtagatgtcagctgctgttgtcaaaaacaaaaaatatgtgggtaactgagatgatggatatgttaatttgcttcacattgtataccttaaatgtatgcaataaaatttattttaaaaataaaaaaaata

SEQ ID NO: 76290 - DNA, 2668 bp, Homo sapiens
agcttggtttggccttgggttccgctgtaggggaggtcccgtgcgaaagaatgaggagatcctggggccttacctactagcggaatcgactgaagagacgcctgccagtgcgggaggtaggaagctcgatccccaaagaaaagagcgagtgggcaggcagctgcgagacagaaccggagtgtgcagggtccctagaggccggttcctggtctgtgctgctctcctggaagccatggtacaggcagagctcagggcgatccccaggtgagggcagcggctctgcctgggattccaccgcagtacaaccgggtagatgcggggtggagaagaaaggatgttgcctgcactgctcgccaatagcaccctgagaggctacatttgcagaagcagcagcagcagaagacacagcgccggtccaggaggcggctcgagctgttcgtaaagtcgcccgacagctttttctccgtagtatgcgagttgacaaaacagccagagaacagggctccccattacaatcttttcgagatcttttcccttgctaaccggatctgatttgtgcgaaaacatgccttgcacttgtacctggaggaactggagacagtggattcgacctttagtagcggtcatctacctggtgtcaatagtggttgcggttcccctatgcgtgtgggaattacagaaactggaggttggaatacacaccaaggcttggtttattgctggaatctttttgctgttgactattcctatatcactgtgggtgatattgcaacacttagtgcattatacacaacctgaactacaaaaaccaataataaggattctttggatggtacctatttacagtttagatagttggatagctttgaaatatcccggaattgcaatatatgtggatacctgcagagaatgctatgaagcttatgtaatttacaactttatgggattccttaccaattatctaactaaccggtatccaaatctggtattaatccttgaagccaaagatcaacagaaacatttccctcctttatgttgctgtccaccatgggctatgggagaagtattgctgtttaggtgcaaactaggtgtattacagtacacagttgtcagacctttcaccaccatcgttgctttaatctgtgagctgcttggtatatatgacgaagggaactttagcttttcaaatgcttggacttatttggttataataaacaacatgtcacagttgtttgccatgtattgtctcctgctcttttataaagtactaaaagaagaactgagcccaatccaacctgttggcaaatttctttgtgtaaagctggtggtttttgtttctttttggcaagcagtagttattgctttgttggtaaaagttggcgttatttctgaaaagcatacgtgggaatggcaaactgtagaagctgtggccaccggactccaggattttattatctgtattgagatgttcctcgctgccattgctcatcattacacattctcatataaaccatatgtccaagaagcagaagagggctcatgctttgattcctttcttgccatgtgggatgtctcagatattagagatgatatttctgaacaagtaaggcatgttggacggacagtcaggggacatcccaggaaaaaattgtttcccgaggatcaagatcaaaatgaacatacaagtttattatcatcatcatcacaagatgcaatttccattgcttcttctatgccaccttcacccatgggtcactaccaagggtttggacacactgtgactccccagactacacctaccacagctaagatatctgatgaaatccttagtgatactataggagagaaaaaagaaccttcagataaatccgtggattcctgaacagtatggaaaagcaaactgtgcaactactacattatatcattacctggtatcccatggattttgtgcttgggacagaccataaatgatggaaaatgtcaacacaaaaatagctgaaagccaggtacaactactgcatttatatatgtaagttttgtatatcaaaaataattggtctaaatttcctagacttagacttgatttcttaacattagggtatcgcatactcaaatggtagacaatgaccccaactaaatcttcctgatgttacactgctttatcaagaggatggactttttttttttgagacagacagagtcttgctctgtcacccaggctggagtgcagtggcgcaatctcgggtcactgcaagctctgcctcccaagttcatgccattctcctgcctcagcctcccaagtagctgggactacaggcacctgccaccatgcccagctaattttttttttttcagtagagacagggtctcaccatgttagccaggatggtcttgatctgacctcgtgatccgccgacctcggcctcccaaagtgctggaattacaggcgtgagccactgcgcctggccaagaatggacattttttaaaaaaacatcagtacttcctaccactgctgcatgagtataatgctccggaattatcagaaagcataatgcagaaatacgaattagtggaacttaatcatgtgccatataagcttacctaacaaacagttatatccctattcctcaactgaatgtctttcaataaataagaatttatcattta

SEQ ID NO: 76291 - DNA, 4566 bp, Homo sapiens
gcctgggcaccagagtgaaactctgtctcaaaaaaaaaaaaaaaaaagaatttagtaaagaggtgggtaataggggtcctagaaacaaatacaccaaatttaacaagctagaaacaatacaaaaagggaaaaagaaaaatccctgaaatcccaccacccagaaaagagtgattaacatcttggtaaacctgtgtcacatataaaactccagagaaagttccatactataaaaatttttggaattcgacaatgttcagtagtatattgtagatacagttctttgtcagtaaacagaaatattattttgttttgtggagggggtgatttttatttttatttttattttgcttagtattctgttatgtggatataactttttactaatctccttttgatattcaggttgttcctaatttttttaccattataagaaacactgaagtgaatattcttatgtatacaactatgaaagcatgtccatgtcattatttgctgtttaaattttacctggggccattatctctagatttgcttgaaatgctcagcttgactccctatcttgagacaaaactactagaaaaatgaatttgtaaagcaaattaatatatttaacatagagtttcttcagcaatatgctgtaaaggcagggtggtggtggtacacaggttgcactggatttttttttaatggcacatttttaaaactactgctcattttatgcttgatatagatttggcgtttaccttttcctaacatataggcaagcagtagttattgctttgttggtaaaagttggcgttatttctgaaaagcatacgtgggaatggcaaactgtagaagctgtggccaccggactccaggattttattatctgtattgagatgttcctcgctgccattgctcatcattacacattctcatataaaccatatgtccaagaagcagaagagggctcatgctttgattcctttcttgccatgtgggatgtctcagatattagagatgatatttctgaacaagtaaggcatgttggacggacagtcaggggacatcccaggaaaaaattgtttcccgaggatcaagatcaaaatgaacatacaagtttattatcatcatcatcacaagatgcaatttccattgcttcttctatgccaccttcacccatgggtcactaccaagggtttggacacactgtgactccccagactacacctaccacagctaagatatctgatgaaatccttagtgatactataggagagaaaaaagaaccttcagataaatccgtggattcctgaacagtatggaaaagcaaactgtgcaactactacattatatcattacctggtatcccatggattttgtgcttgggacagaccataaatgatggaaaatgtcaacacaaaaatagctgaaagccaggtacaactactgcatttatatatgtaagttttgtatatcaaaaataattggtctaaatttcctagacttagacttgatttcttaacattagggtatcgcatactcaaatggtagacaatgaccccaactaaatcttcctgatgttacactgctttatcaagaggatggactttttttttttgagacagacagagtcttgctctgtcacccaggctggagtgcagtggcgcaatctcgggtcactgcaagctctgcctcccaagttcatgccattctcctgcctcagcctcccaagtagctgggactacaggcacctgccaccatgcccagctaattttttttttttcagtagagacagggtctcaccatgttagccaggatggtcttgatctgacctcgtgatccgccgacctcggcctcccaaagtgctggaattacaggcgtgagccactgcgcctggccaagaatggacattttttaaaaaaacatcagtacttcctaccactgctgcatgagtataatgctccggaattatcagaaagcataatgcagaaatacgaattagtggaacttaatcatgtgccatataagcttacctaacaaacagttatatccctattcctcaactgaatgtctttcaataaataagaatttatcatttattttctgcaacttttttatgtctcattctttaaacattaaaaacccttaatattttaacaaaaatttcttgattagaggcacagtgaaaaagaagtcaaaaaaaaaagttctacttttcatcagtgctattaaaggtggcagcaaatgtaaatcttggctgaatggtcttaattactcattaaaccacagtcagaaagacatataggtgctatttgggaaaactttttattacctaggatggggtttctctaattgctaatcacaaccccactgggtcatgtttgacattttataatgaaaataaaacagaaagtgccacagtatgttacagaaagcaaagatgagtattgtttctcaaagcctttgctttatgtatttatacacatactcattcatatctatctatatatatagagagagatagtggttcacagtaatcatacaaagtctttattccatccactattataaacatttctattaaaactaaaactgggctctatgtaaaaaccccaaagatacacacacaaaaaaaatctgtttgttagaactcaagtgaattcagtaaagttgcagaatacaaaatcaacatacaaaaagcattagcatttttatacataaataatgaaaataatgacctaactgaaaaattaagatgccatttatgatagcataaaaaaaatacttacttaggaataaatttaacaccaaggcagtaaaagatctgtatgtacactgaaaactatgaaacactgatgaaagaaagacacaaataaatggaaaggtatcccgtgctcatggatcagaataatactgttaaaatggtcacactacccaaagcaattcagaatcaatgcaatcctatcaaaattccaatggcattatttacacaaacagaaaaaaatcctaaaattcatatgtaacgataaaagaccctgaataggcaaaagaatactgaggaaaaaatgttggagacatcacatttcctaattataaattatactacaaaactatagtaatcaagacagtatggtactggtataaaaacacatacacaggccagtgggacagaagaaagagtccagatataaatccaaacatacacagtcaactaatttttgacaaagacaccaagaagacacatcggggaaagaacagtcttcattaagtgttcttaataaagatgctgggaaaactgcacttccacatgcaaaacaatgaaatcagacccttatcttagacctacacaacaatcaattcaaaatggataaaagacctaaatgtaagaccagaaactatagaagagaacataggagaaaagttcctggacactgacccttggcaatgattttttggatatcacaccaaaagctcagtcaacaaaaacaaaaacaaatgtgactacatcaaaccaaaaagcttctgacagtaaaagaaacagtcaacaaaatgaaacagtagcctacagattgagtaaaaaatatttgtaaggcatatatatggaaaagggttagtatccaaaatttataaagaattcatacaactcaattttaaaaatgggcaaaagacctgaaaagacatttctccgaagacgacacacagatggccaacaggtatataaaagggtgctcaacataattaatcatcaaggaaatgcatataaaaaccactcgaagtactacctctcaccagttaggctagctgttatcaaaaaaaacaaaagacaacaaatgttgtgatggtgtggaataaaaggaactctgtgcactgttggtgggaatgtagattggtacagccattatggaaaacagaatggaagtttctaaagaaaaataaaactaccatacgatccagcaatccctcttctgggcatatactcaaagtaaatgaaatcaccaccttgtaaatatatctgcagtccgtgttcattgcagcattattcatagtagccaacatggagacaactgaagtgtccgttgacagatgaataaagaaactgtgtatatatatgcctacacacaatggaatattattcatccctaaaaaaaaaaaaaccaacgatatcttgccatttgctacaacatggatgggcctgaaggacactgtgctaaatgaaataagccagacagaaaaaaagatactgcataatttcacatatatgtggaatctaaaaaaaaaatttaaatatataaagagcaaaactggttatagggggatagggagaaatggggaatgtaggtcaaaggattcaaggtagcagatatgtaggatgaataagtctagagatctattgtacaacatgaggattttaggtaacaaatttgtactgtatttgggattcatggtaaatgagtagatgtcagctgctgttgtcaaaaacaaaaaatatgtgggtaactgagatgatggatatgttaatttgcttcacattgtataccttaaatgtatgcaataaaatttattttaaaaataaaaaaaata

SEQ ID NO: 76292 - DNA, 3875 bp, Homo sapiens
aaggggtccataataattattttagaaaatggaaaaatgaatataatctgagaagaaaaaacacagctgtttatcttagcacttttgaaaagcaagtagagaaagatagcactctacaaacctagatttaaatccaaaggtggctgttatcttattgttgttctcataggattttattatctgtattgagatgttcctcgctgccattgctcatcattacacattctcatataaaccatatgtccaagaagcagaagagggctcatgctttgattcctttcttgccatgtgggatgtctcagatattagagatgatatttctgaacaagtaaggcatgttggacggacagtcaggggacatcccaggaaaaaattgtttcccgaggatcaagatcaaaatgaacatacaagtttattatcatcatcatcacaagatgcaatttccattgcttcttctatgccaccttcacccatgggtcactaccaagggtttggacacactgtgactccccagactacacctaccacagctaagatatctgatgaaatccttagtgatactataggagagaaaaaagaaccttcagataaatccgtggattcctgaacagtatggaaaagcaaactgtgcaactactacattatatcattacctggtatcccatggattttgtgcttgggacagaccataaatgatggaaaatgtcaacacaaaaatagctgaaagccaggtacaactactgcatttatatatgtaagttttgtatatcaaaaataattggtctaaatttcctagacttagacttgatttcttaacattagggtatcgcatactcaaatggtagacaatgaccccaactaaatcttcctgatgttacactgctttatcaagaggatggactttttttttttgagacagacagagtcttgctctgtcacccaggctggagtgcagtggcgcaatctcgggtcactgcaagctctgcctcccaagttcatgccattctcctgcctcagcctcccaagtagctgggactacaggcacctgccaccatgcccagctaattttttttttttcagtagagacagggtctcaccatgttagccaggatggtcttgatctgacctcgtgatccgccgacctcggcctcccaaagtgctggaattacaggcgtgagccactgcgcctggccaagaatggacattttttaaaaaaacatcagtacttcctaccactgctgcatgagtataatgctccggaattatcagaaagcataatgcagaaatacgaattagtggaacttaatcatgtgccatataagcttacctaacaaacagttatatccctattcctcaactgaatgtctttcaataaataagaatttatcatttattttctgcaacttttttatgtctcattctttaaacattaaaaacccttaatattttaacaaaaatttcttgattagaggcacagtgaaaaagaagtcaaaaaaaaaagttctacttttcatcagtgctattaaaggtggcagcaaatgtaaatcttggctgaatggtcttaattactcattaaaccacagtcagaaagacatataggtgctatttgggaaaactttttattacctaggatggggtttctctaattgctaatcacaaccccactgggtcatgtttgacattttataatgaaaataaaacagaaagtgccacagtatgttacagaaagcaaagatgagtattgtttctcaaagcctttgctttatgtatttatacacatactcattcatatctatctatatatatagagagagatagtggttcacagtaatcatacaaagtctttattccatccactattataaacatttctattaaaactaaaactgggctctatgtaaaaaccccaaagatacacacacaaaaaaaatctgtttgttagaactcaagtgaattcagtaaagttgcagaatacaaaatcaacatacaaaaagcattagcatttttatacataaataatgaaaataatgacctaactgaaaaattaagatgccatttatgatagcataaaaaaaatacttacttaggaataaatttaacaccaaggcagtaaaagatctgtatgtacactgaaaactatgaaacactgatgaaagaaagacacaaataaatggaaaggtatcccgtgctcatggatcagaataatactgttaaaatggtcacactacccaaagcaattcagaatcaatgcaatcctatcaaaattccaatggcattatttacacaaacagaaaaaaatcctaaaattcatatgtaacgataaaagaccctgaataggcaaaagaatactgaggaaaaaatgttggagacatcacatttcctaattataaattatactacaaaactatagtaatcaagacagtatggtactggtataaaaacacatacacaggccagtgggacagaagaaagagtccagatataaatccaaacatacacagtcaactaatttttgacaaagacaccaagaagacacatcggggaaagaacagtcttcattaagtgttcttaataaagatgctgggaaaactgcacttccacatgcaaaacaatgaaatcagacccttatcttagacctacacaacaatcaattcaaaatggataaaagacctaaatgtaagaccagaaactatagaagagaacataggagaaaagttcctggacactgacccttggcaatgattttttggatatcacaccaaaagctcagtcaacaaaaacaaaaacaaatgtgactacatcaaaccaaaaagcttctgacagtaaaagaaacagtcaacaaaatgaaacagtagcctacagattgagtaaaaaatatttgtaaggcatatatatggaaaagggttagtatccaaaatttataaagaattcatacaactcaattttaaaaatgggcaaaagacctgaaaagacatttctccgaagacgacacacagatggccaacaggtatataaaagggtgctcaacataattaatcatcaaggaaatgcatataaaaaccactcgaagtactacctctcaccagttaggctagctgttatcaaaaaaaacaaaagacaacaaatgttgtgatggtgtggaataaaaggaactctgtgcactgttggtgggaatgtagattggtacagccattatggaaaacagaatggaagtttctaaagaaaaataaaactaccatacgatccagcaatccctcttctgggcatatactcaaagtaaatgaaatcaccaccttgtaaatatatctgcagtccgtgttcattgcagcattattcatagtagccaacatggagacaactgaagtgtccgttgacagatgaataaagaaactgtgtatatatatgcctacacacaatggaatattattcatccctaaaaaaaaaaaaaccaacgatatcttgccatttgctacaacatggatgggcctgaaggacactgtgctaaatgaaataagccagacagaaaaaaagatactgcataatttcacatatatgtggaatctaaaaaaaaaatttaaatatataaagagcaaaactggttatagggggatagggagaaatggggaatgtaggtcaaaggattcaaggtagcagatatgtaggatgaataagtctagagatctattgtacaacatgaggattttaggtaacaaatttgtactgtatttgggattcatggtaaatgagtagatgtcagctgctgttgtcaaaaacaaaaaatatgtgggtaactgagatgatggatatgttaatttgcttcacattgtataccttaaatgtatgcaataaaatttattttaaaaataaaaaaaata

SEQ ID NO: 76293 - DNA, 3295 bp, Homo sapiens
gcggccgtctactactactaaattcgcggccgcgtcgacagcaaactgtgcaactactacattatatcattacctggtatcccatggattttgtgcttgggacagaccataaatgatggaaaatgtcaacacaaaaatagctgaaagccaggtacaactactgcatttatatatgtaagttttgtatatcaaaaataattggtctaaatttcctagacttagacttgatttcttaacattagggtatcgcatactcaaatggtagacaatgaccccaactaaatcttcctgatgttacactgctttatcaagaggatggactttttttttttgagacagacagagtcttgctctgtcacccaggctggagtgcagtggcgcaatctcgggtcactgcaagctctgcctcccaagttcatgccattctcctgcctcagcctcccaagtagctgggactacaggcacctgccaccatgcccagctaattttttttttttcagtagagacagggtctcaccatgttagccaggatggtcttgatctgacctcgtgatccgccgacctcggcctcccaaagtgctggaattacaggcgtgagccactgcgcctggccaagaatggacattttttaaaaaaacatcagtacttcctaccactgctgcatgagtataatgctccggaattatcagaaagcataatgcagaaatacgaattagtggaacttaatcatgtgccatataagcttacctaacaaacagttatatccctattcctcaactgaatgtctttcaataaataagaatttatcatttattttctgcaacttttttatgtctcattctttaaacattaaaaacccttaatattttaacaaaaatttcttgattagaggcacagtgaaaaagaagtcaaaaaaaaaagttctacttttcatcagtgctattaaaggtggcagcaaatgtaaatcttggctgaatggtcttaattactcattaaaccacagtcagaaagacatataggtgctatttgggaaaactttttattacctaggatggggtttctctaattgctaatcacaaccccactgggtcatgtttgacattttataatgaaaataaaacagaaagtgccacagtatgttacagaaagcaaagatgagtattgtttctcaaagcctttgctttatgtatttatacacatactcattcatatctatctatatatatagagagagatagtggttcacagtaatcatacaaagtctttattccatccactattataaacatttctattaaaactaaaactgggctctatgtaaaaaccccaaagatacacacacaaaaaaaatctgtttgttagaactcaagtgaattcagtaaagttgcagaatacaaaatcaacatacaaaaagcattagcatttttatacataaataatgaaaataatgacctaactgaaaaattaagatgccatttatgatagcataaaaaaaatacttacttaggaataaatttaacaccaaggcagtaaaagatctgtatgtacactgaaaactatgaaacactgatgaaagaaagacacaaataaatggaaaggtatcccgtgctcatggatcagaataatactgttaaaatggtcacactacccaaagcaattcagaatcaatgcaatcctatcaaaattccaatggcattatttacacaaacagaaaaaaatcctaaaattcatatgtaacgataaaagaccctgaataggcaaaagaatactgaggaaaaaatgttggagacatcacatttcctaattataaattatactacaaaactatagtaatcaagacagtatggtactggtataaaaacacatacacaggccagtgggacagaagaaagagtccagatataaatccaaacatacacagtcaactaatttttgacaaagacaccaagaagacacatcggggaaagaacagtcttcattaagtgttcttaataaagatgctgggaaaactgcacttccacatgcaaaacaatgaaatcagacccttatcttagacctacacaacaatcaattcaaaatggataaaagacctaaatgtaagaccagaaactatagaagagaacataggagaaaagttcctggacactgacccttggcaatgattttttggatatcacaccaaaagctcagtcaacaaaaacaaaaacaaatgtgactacatcaaaccaaaaagcttctgacagtaaaagaaacagtcaacaaaatgaaacagtagcctacagattgagtaaaaaatatttgtaaggcatatatatggaaaagggttagtatccaaaatttataaagaattcatacaactcaattttaaaaatgggcaaaagacctgaaaagacatttctccgaagacgacacacagatggccaacaggtatataaaagggtgctcaacataattaatcatcaaggaaatgcatataaaaaccactcgaagtactacctctcaccagttaggctagctgttatcaaaaaaaacaaaagacaacaaatgttgtgatggtgtggaataaaaggaactctgtgcactgttggtgggaatgtagattggtacagccattatggaaaacagaatggaagtttctaaagaaaaataaaactaccatacgatccagcaatccctcttctgggcatatactcaaagtaaatgaaatcaccaccttgtaaatatatctgcagtccgtgttcattgcagcattattcatagtagccaacatggagacaactgaagtgtccgttgacagatgaataaagaaactgtgtatatatatgcctacacacaatggaatattattcatccctaaaaaaaaaaaaaccaacgatatcttgccatttgctacaacatggatgggcctgaaggacactgtgctaaatgaaataagccagacagaaaaaaagatactgcataatttcacatatatgtggaatctaaaaaaaaaatttaaatatataaagagcaaaactggttatagggggatagggagaaatggggaatgtaggtcaaaggattcaaggtagcagatatgtaggatgaataagtctagagatctattgtacaacatgaggattttaggtaacaaatttgtactgtatttgggattcatggtaaatgagtagatgtcagctgctgttgtcaaaaacaaaaaatatgtgggtaactgagatgatggatatgttaatttgcttcacattgtataccttaaatgtatgcaataaaatttattttaaaaataaaaaaaata

SEQ ID NO: 76294 - DNA, 2935 bp, Homo sapiens
agcttggtttggccttgggttccgctgtaggggaggtcccgtgcgaaagaatgaggagatcctggggccttacctactagcggaatcgactgaagagacgcctgccagtgcgggaggtaggaagctcgatccccaaagaaaagagcgagtgggcaggcagctgcgagacagaaccggagtgtgcagggtccctagaggccggttcctggtctgtgctgctctcctggaagccatggtacaggcagagctcagggcgatccccaggtgagggcagcggctctgcctgggattccaccgcagtacaaccgggtagatgcggggtggagaagaaaggatgttgcctgcactgctcgccaatagcaccctgagaggctacatttgcagaagcagcagcagcagaagacacagcgccggtccaggaggcggctcgagctgttcgtaaagtcgcccgacagctttttctccgtagtatgcgagttgacaaaacagccagagaacagggctccccattacaatcttttcgagatcttttcccttgctaaccggatctgatttgtgcgaaaacatgccttgcacttgtacctggaggaactggagacagtggattcgacctttagtagcggtcatctacctggtgtcaatagtggttgcggttcccctatgcgtgtgggaattacagaaactggaggttggaatacacaccaaggcttggtttattgctggaatctttttgctgttgactattcctatatcactgtgggtgatattgcaacacttagtgcattatacacaacctgaactacaaaaaccaataataaggattctttggatggtacctatttacagtttagatagttggatagctttgaaatatcccggaattgcaatatatgtggatacctgcagagaatgctatgaagcttatgtaatttacaactttatgggattccttaccaattatctaactaaccggtatccaaatctggtattaatccttgaagccaaagatcaacagaaacatttccctcctttatgttgctgtccaccatgggctatgggagaagtattgctgtttaggtgcaaactaggtgtattacagtacacagttgtcagacctttcaccaccatcgttgctttaatctgtgagctgcttggtatatatgacgaagggaactttagcttttcaaatgcttggacttatttggttataataaacaacatgtcacagttgtttgccatgtattgtctcctgctcttttataaagtactaaaagaagaactgagcccaatccaacctgttggcaaatttctttgtgtaaagctggtggtttttgtttctttttggcaagcagtagttattgctttgttggtaaaagttggcgttatttctgaaaagcatacgtgggaatggcaaactgtagaagctgtggccaccggactccaggattttattatctgtattgagatgttcctcgctgccattgctcatcattacacattctcatataaaccatatgtccaagaagcagaagagggctcatgctttgattcctttcttgccatgtgggatgtctcagatattagagatgatatttctgaacaagtaaggcatgttggacggacagtcaggggacatcccaggaaaaaattgtttcccgaggatcaagatcaaaatgaacatacaagtttattatcatcatcatcacaagatgcaatttccattgcttcttctatgccaccttcacccatgggtcactaccaagggtttggacacactgtgactccccagactacacctaccacagctaagatatctgatgaaatccttagtgatactataggagagaaaaaagaaccttcagataaatccgtggattcctgaacagtatggaaaagcaaactgtgcaactactacattatatcattacctggtatcccatggattttgtgcttgggacagaccataaatgatggaaaatgtcaacacaaaaatagctgaaagccaggtacaactactgcatttatatatgtaagttttgtatatcaaaaataattggtctaaatttcctagacttagacttgatttcttaacattagggtatcgcatactcaaatggtagacaatgaccccaactaaatcttcctgatgttacactgctttatcaagaggatggactttttttttttgagacagacagagtcttgctctgtcacccaggctggagtgcagtggcgcaatctcgggtcactgcaagctctgcctcccaagttcatgccattctcctgcctcagcctcccaagtagctgggactacaggcacctgccaccatgcccagctaattttttttttttcagtagagacagggtctcaccatgttagccaggatggtcttgatctgacctcgtgatccgccgacctcggcctcccaaagtgctggaattacaggcgtgagccactgcgcctggccaagaatggacattttttaaaaaaacatcagtacttcctaccactgctgcatgagtataatgctccggaattatcagaaagcataatgcagaaatacgaattagtggaacttaatcatgtgccatataagcttacctaacaaacagttatatccctattcctcaactgaatgtctttcaataaataagaatttatcatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaagagaaaaacaaaaagagaaaaaaagagagaaaaagaaagagaggaaaagaacgcaccgaaaagaaaaaagaaggaagagagagaacggaaacagagaaagagagagaagacaagaggaggagagaaagaggccggagaaggagaacag

SEQ ID NO: 76295 - DNA, 1546 bp, Homo sapiens
agcttggtttggccttgggttccgctgtaggggaggtcccgtgcgaaagaatgaggagatcctggggccttacctactagcggaatcgactgaagagacgcctgccagtgcgggaggtaggaagctcgatccccaaagaaaagagcgagtgggcaggcagctgcgagacagaaccggagtgtgcagggtccctagaggccggttcctggtctgtgctgctctcctggaagccatggtacaggcagagctcagggcgatccccaggtgagggcagcggctctgcctgggattccaccgcagtacaaccgggtagatgcggggtggagaagaaaggatgttgcctgcactgctcgccaatagcaccctgagaggctacatttgcagaagcagcagcagcagaagacacagcgccggtccaggaggcggctcgagctgttcgtaaagtcgcccgacagctttttctccgtagtatgcgagttgacaaaacagccagagaacagggctccccattacaatcttttcgagatcttttcccttgctaaccggatctgatttgtgcgaaaacatgccttgcacttgtacctggaggaactggagacagtggattcgacctttagtagcggtcatctacctggtgtcaatagtggttgcggttcccctatgcgtgtgggaattacagaaactggaggttggaatacacaccaaggcttggtttattgctggaatctttttgctgttgactattcctatatcactgtgggtgatattgcaacacttagtgcattatacacaacctgaactacaaaaaccaataataaggattctttggatggtacctatttacagtttagatagttggatagctttgaaatatcccggaattgcaatatatgtggatacctgcagagaatgctatgaagcttatgtaatttacaactttatgggattccttaccaattatctaactaaccggtatccaaatctggtattaatccttgaagccaaagatcaacagaaacatttccctcctttatgttgctgtccaccatgggctatgggagaagtattgctgtttaggtgcaaactaggtgtattacagtacacagttgtcagacctttcaccaccatcgttgctttaatctgtgagctgcttggtatatatgacgaagggaactttagcttttcaaatgcttggacttatttggttataataaacaacatgtcacagttggtaagtaaaatgttcacttttcttaaactgtactaaattcgtatctataactaaatttctttagacaaagtttcttcttaggataaggcttgcttctttttaatcttcctataaattaaatctgaaatttaatttatagaaagacttgaaaaaaatttaatatatatcttaatacatatataaagatataataacatctttgtttattatttggcaacttataccctcacatgttgaccatgtttgttcatttatttctgttgctcattgcatagctgtatgagtatgtcataaataaaagcacagtgctacata

SEQ ID NO: 76296 - DNA, 649 bp, Homo sapiens
agcttggtttggccttgggttccgctgtaggggaggtcccgtgcgaaagaatgaggagatcctggggccttacctactagcggaatcgactgaagagacgcctgccagtgcgggaggtaggaagctcgatccccaaagaaaagagcgagtgggcaggcagctgcgagacagaaccggagtgtgcagggtccctagaggccggttcctggtctgtgctgctctcctggaagccatggtacaggcagagctcagggcgatccccaggtgagggcagcggctctgcctgggattccaccgcagtacaaccgggtagatgcggggtggagaagaaaggatgttgcctgcactgctcgccaatagcaccctgagaggctacatttgcagaagcagcagcagcagaagacacagcgccggtccaggaggcggctcgagctgttcgtaaagtcgcccgacagctttttctccgtagtatgcgagttgacaaaacagccagagaacagggctccccattacaatcttttcgagatcttttcccttgctaaccggatctgatttgtgcgaaaacatgccttgcacttgtacctggaggaactggagacagtggattcgaccacgtcgccaacatggggggtcctctagagtcacacgc

SEQ ID NO: 76297 - DNA, 543 bp, Homo sapiens
ttctctgtgtccaaagtcaagtgattgtcagtgagatctcaaataaactgacttctaaatttaagtattgctattgctgtattttgaagtacgattttgatttaatcagagatatctcatttttactatttttagaatctgtgagctgcttggtatatatgacgaagggaactttagcttttcaaatgcttggacttatttggttataataaacaacatgtcacagttggtaagtaaaatgttcacttttcttaaactgtactaaattcgtatctataactaaatttctttagacaaagtttcttcttaggataaggcttgcttctttttaatcttcctataaattaaatctgaaatttaatttatagaaagacttgaaaaaaatttaatatatatcttaatacatatataaagatataataacatctttgtttattatttggcaacttataccctcacatgttgaccatgtttgttcatttatttctgttgctcattgcatagctgtatgagtatgtcataaataaaagcacagtgctacat

SEQ ID NO: 76298 - DNA, 1505 bp, Homo sapiens
atgaaccgaagttttcacaagtctcagaccttgcgattctacgattgcagcgcagtggaagtcaagagcaagtttggggcggaattccgaaggttctctctggaccgtcataagcctgggaagtttgaagatttctacaagctggttgtgcacacccaccatatctccaacagtgatgtaactattggctatgcagatgtgcacggagacctgctgcccatcaacaatgatgacaacttctgcaaggcggtttctagtgcaaatcccctgctcagggtcttcatccagaaacgagaggaggccgagcgtggcagcctcggcgcgggctcgctgtgcaggcggaggcgggcgctgggcgcgctgcgtgatgaaggaccccggcggcgtgcacacctggacatcggcctcccgcgcgacttccgccccgtatcatccatcatcgatgtggacctggtccccgagacgcaccggcgagtgcggctgcaccggcacggctgcgagaagccgctgggcttctacatccgcgatggcgccagcgtgcgcgtgaccccgcacgggctggagaaggtgcccggcatcttcatctcgcgcatggtacccgggggcctggcggagagcaccgggctgctggctgtgaatgacgaggtcctggaggtgaacggcattgaggtggccgggaagacgctggaccaggtcacggacatgatgatcgccaacagccacaacctcatcgtcaccgtcaagcccgccaaccagcgcaacaacgtggtgcgcggcggccgcgcgttgggcagctcgggaccgccctcggacggcaccgcgggcttcgtgggtccccccgccccgcgcgtcctgcagaacttccaccccgacgaggcggagagcgatgaggacaacgacgtcgtcatcgagggcacactggagcctgcacgtcccccccagaccccgggcgcgcccgcaggcagcctctcccgggtcaatggcgcgggcctggcgcagcggctgcagcgggacctggccctggacggcggcctccagcggctgctcagctccctgcgggccgacccccgtcacagcctggcgctgccgccaggcggcgtggaggagcacgggcccgcggtcacgctctagactcccgagaggcccccaaatcctagctccagttccccggtaaggacagggacaggacctgcagactgcatccgctcattttttgttgtttttgtgaccacaaaaacaacgctgctctttgtttcaacttccggatataaaaacacaagtattgcctatttttatagaatttcgccacagaacttaaaatgaacgcctgtagagacactctataccaggcctgagtgcaggtcttggcgcctttgcaaagtgatagaaaagatctgaccaagtgcaaaaaaatgctttttaaaatttttacaaatactttgtttttaaagtgaagctttaaaattacttttttaaaatagtcaaattcatgtttttaagtaagt

SEQ ID NO: 76299 - DNA, 1451 bp, Homo sapiens
ttaatctctgagttctttggtttggtgcctgtggagctgtaaggagagtgctagagagttaattttaggggctgcacttgagcttgcctgatttcagctcagcctgcaggtctggaatgctcctgtgcaccctgggtgcttcggcgtcacgcagatggaacagcagtgccaggtgtatgacggccgagggctcaggcggggctcggttgtgtgtcccctctaactgtcccctctcccgcagaggaggccgagcgtggcagcctcggcgcgggctcgctgtgcaggcggaggcgggcgctgggcgcgctgcgtgatgaaggaccccggcggcgtgcacacctggacatcggcctcccgcgcgacttccgccccgtatcatccatcatcgatgtggacctggtccccgagacgcaccggcgagtgcggctgcaccggcacggctgcgagaagccgctgggcttctacatccgcgatggcgccagcgtgcgcgtgaccccgcacgggctggagaaggtgcccggcatcttcatctcgcgcatggtacccgggggcctggcggagagcaccgggctgctggctgtgaatgacgaggtcctggaggtgaacggcattgaggtggccgggaagacgctggaccaggtcacggacatgatgatcgccaacagccacaacctcatcgtcaccgtcaagcccgccaaccagcgcaacaacgtggtgcgcggcggccgcgcgttgggcagctcgggaccgccctcggacggcaccgcgggcttcgtgggtccccccgccccgcgcgtcctgcagaacttccaccccgacgaggcggagagcgatgaggacaacgacgtcgtcatcgagggcacactggagcctgcacgtcccccccagaccccgggcgcgcccgcaggcagcctctcccgggtcaatggcgcgggcctggcgcagcggctgcagcgggacctggccctggacggcggcctccagcggctgctcagctccctgcgggccgacccccgtcacagcctggcgctgccgccaggcggcgtggaggagcacgggcccgcggtcacgctctagactcccgagaggcccccaaatcctagctccagttccccggtaaggacagggacaggacctgcagactgcatccgctcattttttgttgtttttgtgaccacaaaaacaacgctgctctttgtttcaacttccggatataaaaacacaagtattgcctatttttatagaatttcgccacagaacttaaaatgaacgcctgtagagacactctataccaggcctgagtgcaggtcttggcgcctttgcaaagtgatagaaaagatctgaccaagtgcaaaaaaatgctttttaaaatttttacaaatactttgtttttaaagtgaagctttaaaattacttttttaaaatagtcaaattcatgtttttaagtaagt

SEQ ID NO: 76300 - DNA, 1118 bp, Homo sapiens
atgaaccgaagttttcacaagtctcagaccttgcgattctacgattgcagcgcagtggaagtcaagagcaagtttggggcggaattccgaaggttctctctggaccgtcataagcctgggaagtttgaagatttctacaagctggttgtgcacacccaccatatctccaacagtgatgtaactattggctatgcagatgtgcacggagacctgctgcccatcaacaatgatgacaacttctgcaaggcggtttctagtgcaaatcccctgctcagggtcttcatccagaaacgagatgacggagccctgcgaccaggaacctgactcttcagctcaaatcttggtttgaaagggggacttctctgtgcccctgttgtcggcatgccatggtagagaatggatggcccacgcagctggcccctcatgagaccccagccatctcattccactgggagccacgtcaggacgaaggaggactgggaggggcgtctggctgcgtggtgtggggcctgcagtgttgtggcacacgcagcttcagccaaacatctagccctgtacctagaactaagaaataaaactataacatcagatttaaaagttctctgggaacatttgtcctgcccaaaatagtaacttgtcatttttaaaagaataaaacagagctttgataagccccgtggatgcacctgacacgagagaatcaatggtgcaggtggatttgggctcaaggtggttttcaacacccaggtgatgtctaggtgactggaaagggtgtctgttggacttgcaccttttttccctgtggaagctatttttatgcagttttgtatttgttctcagaacaaattggccaaaaacactacctttaagtgtgacttgatttttagtgtacattttcagatgttatgggaaatgcattcacagttgaggtgtcaaagcaggggaagatggcttccttggcaataacaagcaaaggcaaacatgtttatttttgtatctgtaaaagctggtcgctctttaagtgtagttccagcatctaaagtggacacagaacctgttcttcagggcctgtcacaccctcactgtccatgtgagagtttgtccctccttgtggatac

SEQ ID NO: 76301 - DNA, 1173 bp, Homo sapiens
atgaaccgaagttttcacaagtctcagaccttgcgattctacgattgcagcgcagtggaagtcaagagcaagtttggggcggaattccgaaggttctctctggaccgtcataagcctgggaagtttgaagatttctacaagctggttgtgcacacccaccatatctccaacagtgatgtaactattggctatgcagatgtgcacggagacctgctgcccatcaacaatgatgacaacttctgcaaggcggtttctagtgcaaatcccctgctcagggtcttcatccagaaacgaggtggtgaacactgaccacctcaaggaaccaagcagccagtggtgacagttgcaagatgacggagccctgcgaccaggaacctgactcttcagctcaaatcttggtttgaaagggggacttctctgtgcccctgttgtcggcatgccatggtagagaatggatggcccacgcagctggcccctcatgagaccccagccatctcattccactgggagccacgtcaggacgaaggaggactgggaggggcgtctggctgcgtggtgtggggcctgcagtgttgtggcacacgcagcttcagccaaacatctagccctgtacctagaactaagaaataaaactataacatcagatttaaaagttctctgggaacatttgtcctgcccaaaatagtaacttgtcatttttaaaagaataaaacagagctttgataagccccgtggatgcacctgacacgagagaatcaatggtgcaggtggatttgggctcaaggtggttttcaacacccaggtgatgtctaggtgactggaaagggtgtctgttggacttgcaccttttttccctgtggaagctatttttatgcagttttgtatttgttctcagaacaaattggccaaaaacactacctttaagtgtgacttgatttttagtgtacattttcagatgttatgggaaatgcattcacagttgaggtgtcaaagcaggggaagatggcttccttggcaataacaagcaaaggcaaacatgtttatttttgtatctgtaaaagctggtcgctctttaagtgtagttccagcatctaaagtggacacagaacctgttcttcagggcctgtcacaccctcactgtccatgtgagagtttgtccctccttgtggatac

SEQ ID NO: 76302 - DNA, 376 bp, Homo sapiens
tctggtatttattaatgcccctccccccaccccgtctcttgcattgtagtttggggcggaattccgaaggttctctctggaccgtcataagcctgggaagtttgaagatttctacaagctggttgtgcacacccaccatatctccaacagtgatgtaactattggctatgcagatgtgcacggagacctgctgcccatcaacaatgatgacaacttctgcaaggcggtttctagtgcaaatcccctgctcagggtcttcatccagaaacgaggtactgaagtggttgagtggccggctggtcttgttgagaaatcatttttaaaatacagttttcaattttttctgtcattacaggactatgtggttcgttttcta

SEQ ID NO: 76303 - DNA, 682 bp, Homo sapiens
tgtgggagacggggtctcaggagcaccaggagtgagtcctggagaggggtggctgtgagaatctgggagcgagtgtgagtgtggcgtggagggggcactggtgtaacagaaggcagaagggcaggcagctgggaggctgcgggaacctgaagaccagagggttgaccctttgttccaggaaacgcttgatcaaattcccctgaagtctcccgcaaagcacagacgttgggactggtcttccctcttctgtcttaggggaaaaaggagtcagagagcaagagagggctgttacctccagctttcaagtaagcccaagattggtgcgtaccttttccagaaacacaaattctacctgatggtaaaaaaaatgaacatagaattggttttttcaagttgctttaagaaatccatgtccaaggccgggcgcggtggctcacgcctatgtaatcccagcactttgggaggccgaggcaggtggatcacctgaggtcaggagttccagatcagccgggccaagatggtaaaaccctgtctctactaaaactacaaaaaactagccaggcttggtagtgcacatctgtagtcgcagctacttgggaggctgaggcaggagaatcctttcaacctgggaggtggaagtcgcagtgagccgagatcatgccactgtactccagcctgggca

SEQ ID NO: 76304 - DNA, 348 bp, Homo sapiens
tagagacagggtcttgccctgttcccacgctagagtgcagtggcatgatcatagctcactgcagcctcaaactcctgtgctcaagcaatcctcctgcctcagtctctacagtagctggcactacaatagtgggtgccaccatgcccgactaattttttttattttttattttgtagagatgaggtattgctgtgttgcccaggctgaactggaatgcctggcctcaagaatcctcccaccttggcctcccaaagtcctgggattacatgcccaaatcttctttagttgtttctaatagttgttagccattgagatctaaggttgcttctaagttgattgatatattct

SEQ ID NO: 76305 - DNA, 2534 bp, Homo sapiens
agtaacctgttgcagaaaagtgaaagtatatccgcaacagttggctctgattgcagagagcgcgcttgtgagaactgatggcgggtacgcgcagaaaatctttgcaaaacaggcaagtgggatctcttctcatttttctgtgcatatctgtgggggatgcgacaactatccgctattcagtggcagaggaaatggagagcggctcgtttgtggccaacgtagctaaggacctaggactggaggtagggaagctggctgcgcgcggggcgcggctggtttccgagggcaacaaaatgcatttccggctccaccgcaagacgggagatttgtttgtgaaggagaaactggatcgggagtcactttgtggcaaagccgacccttgtgttctgcactttgaagtagtcctggtggagccgctgcagtccttccgggccgaggtcagggtatttgatatcaatgacaatgccccagttttcctaaacaaggagccgcttttaaagattccggagagcacccctttgggttcacgttttcctctgcagagcgcccaggatctggacgtgggccttaacggtctccagaactacaccctgagtgccaatgggtatttccacctgcacacccgcttctgcagccacgggcctaaatatgctgagctggtgctgaacaaacccctggaccgagaggagcagcctgaagtcaacttgacaattacggcggtggacggcgggtccccgcctaagtctggcacagctcacatccacgtggtggttctggatgtcaacgaccacgtgccccagttctcgcgactggtgtacagagcccaggtatcagagaacagccccaatggctctttggtggccacggtgactgccgtggacctagacgagggcaccaacaaagcgataacttactctttagctcaaaacccagaagcaattctcaagacgtttcagattgaccctcaaaatggagaagttcgactaagaggacccctcgattttgaagccattgaaacatacgacattgacattcaagctacagatggtggaggcctctctgcccacagcaaagtcctggtagaagtggtggatgtgaatgacaatcctcccgaagtgatggtctcctctgtgtccagcccactccctgaagactcaccaccacagacagtagtagcccttttcactatcagagaccgggacattcgagtgggaggaaaagtcacctgcttcctcagagaagaccttccctttgtaatcaaacctacatttgggaattcttactcactggtcactgacagaagcttggatcgggaggaggtctcaggctataatatcaccattgttgccatggatactggaccacctagcttgtctgccgagactatgatagaggtgctaatatccgacgttaatgacaatcctccaatatttcgggaagattcctatatcttgactgttcgagaaaacaacagtcctgcggtttttattggcaaagtccatgctgaggatcttgatttgggtgagaatgcccaaataacatattctctgttgcctccaaaaaacggagatctttcagtctttgcttacatatccataaattcaggcaatgggaagctctacgcgctgagaaccatggattatgaggccattcaagattttcaatttgtggtaaaggcaactgatgggggcttcctgtcactgagtagccaagttactgtcagagtggttgtcctagatgacaatgacaatcgtccaatgatcttatacccactgcagaacggcaccttgccctgcaatgacctggtgcccaggtctgcagaggcaggctacctagtgaccaaagtggtggctgtggatggtgactcaggtcagaattcttggctttcatatcatctacttaaggccactgaccttgggttattttctgttcaaagacaaaatggagaaatccatacattaaggcagatatctgagagagaccccatgatgcagaaattgatcattcttgttcaggatcacggccaaccagctctttccactactgtctcactcaacatcctgctggtagatggcttttcagagccctacctgcagttccaggatccaaccaagcattctagaaaggtaaatccatccactaaatatttggtcatttctctggtcatcctttcctttctctttctcctctctgtcatagtgatcttcattatacatgtctaccaaaagattaaatatagagaaaagttcacaattcaagagcatttctatgatgactgtaatttctctaacaacctggtacaaggacaaggcaatggatccttatctcggccttgtccatatgaaatgtgttcagccactggcactggtaatagtgagtttcgctttcttaagcgttttatgcccaacttgcctttccctcatgccactggggagataaaaatggaggctggctccagtttgcccccaaattctgataggaataagtctcagagattagagggccatgaccaggtatctgatgactatatgtag

SEQ ID NO: 76306 - DNA, 477 bp, Homo sapiens
gccaggccgttcctcactgcttgcccatgcactcacttaaatctgcttgcctttccttcagcctggaatactcttctccaaaccttctttatgccaagggtcaaaacacagtttctttgtgaaactcctctcatttcctctaatcaatccctgtggccaggtccttgttcctccatatacaccatttcaagactcttgtcatccgttttctatttcctactcccagcttctggcacacttctatgtcacttatatgcttccattaatggatgaaattaagtaaagtacatgttagacagaaacctaaaatttacaaagcatatttgaagtatcttttggtttcaaatgaagtccaaagaaatactggtatataaccattaacagctaaaaaaatttttcttaaaccacaaaatcactacaaatcaatcttcacttagatcaagttaatagaccttttcaggaacaatactgaaaaag

SEQ ID NO: 76307 - DNA, 455 bp, Homo sapiens
ggtcatagattgtttaaccaccttttgatctacccttaggaacactaaaggttgaagtaatttcctttcatgtgatcccctccctcttacttcccaagtctaaccttagtattattgtccaagtaactctaaagcatgttaagcagctgatgtttggttagaaagaaaagttgtcacaagattatgatgagagcaactcacttctgtttaaacagtgtgcaccctctaccctgccacttcacctcctgggaatccttatcacatatttgtcctgaaaacattatccacctgccctgtgctttataatatcagcagtatatctttttatcttgtggatgatgtgcctttatattttgagaaaaatttccagtaacagatttgatttgcatggacagaaacttgagcaaatgccaaactagcaggggggccattattctgctctataaataagttta

SEQ ID NO: 76308 - DNA, 2416 bp, Homo sapiens
  misc_feature (1919)..(1919): n is a, c, g, or t
  misc_feature (1985)..(1985): n is a, c, g, or t
  misc_feature (2268)..(2268): n is a, c, g, or t
ttgaattgaagtgaaattgcccaaagagatattttcctttagggactcatttcttcacatacttttgcttatcttgttggaagacacactatgtcaatctcagtatcctgtttgaatgaagactgctttcctcctatgtatctgttgcccctagacagtcattgtgcagcttgttacctttctgtgaaactccatgagacagctccagcattcatccttacaggtgctacctcctgacacttctgcttctttgcaaaatgacttccctgatctcctgagtctgtattgtttccagtgctgcctgaaccacatttgggtgatgctacaggaccagacagcagacagatttgtcatggatgcctgatgggataggaccctgttggcatcctctctgaaaatctcccttgcctggctagggattgttttattttattttctttagcctgtagcaaatacaggttcagtatctccattgaataatatattgtagaaagaaaggcagtaataaaaacttcgttctttttccccatttgaaaaacaattattataggagtttagaaaataaaaattttaaaaacaaaattaaaataattgatgttacaccatcaagggtctttgaatactcgattcttttttgattttttttgtctttactcctgtaccaatgtatcctttttaaagaataataaaatttgagaaattaaactcattgttattagtacctttctatccacttctttttttttttccaggatagtgaaaaaaaaaaaaaagaggagtgagggctgaacttgttacgatttagaaattaaggcccattttccttcttaagaacccagtttctctatatgaagcagatccagaccgcaggtccctgtcccaccacgcctttcacttccctgtgcctcgtttccccatctgtagaagagagtcagtcatgataataactcctacttcttggtagtgttgcaaggattaagcagcttaatacttgtatgtgctttgaacagtaacgtgctgtagtgtacaaaagatgtaaattgcagaccaggcatgctggcagctgcctgtagtttcagcttctcgggaagccaaagcaaaggatctcttgagcctcagtatctgaggtcagcctgggcaacctggcaaaatacctcatctcataataataacaacaataataataatgttagctgttatgggctgttattggttacttatcctaagtcacagtcttcttatttaatttactctcatatctcaattgtttttttgaagtaatcaattatcttccttgattgggtttgtttccagtatttgtctttggaaaggaatcctgcatttatacctggttatttatagcttcttctaaaggggtgaaagtatttccctacacagtcatgcatcaccatgcccggtcagttctgagaaatgagttgttagatgatttcatcgtgcaaacatcacaaagagcacttacacaaatgtacatggcatagccggctgcacacgtaggctacaggctataagtgtagcctgtgctcctaggctacaaacctgtgcagcatgtgaccaggctgaatactgtaggcaattgtgacacttaacacaatggtttttatgtatcaaaatgtgggaaaggtatagtaataatgcagtagaggccaggtgcggtggctcacacctgtaatcccagcactttgggaggctgaggcgggcagatcacgaggtcaggagatggagaccatcctggctaacacagtgaaatcccgtctctactaaaaatataaaaaattagccaggcatggtggcacgcacctgtagtcccagctactcaggaggctgaggcaggagaattgcttgaacctgggaggcaaaggttgctgtgagctgagatcatgcctctgcactccagcctnggctacagagcgagaccccatctcaaaataataataattattattattaagaagggaaaaaaatgntacacctgtacacctgtataaggcacttaccatgaatggagcttgcaggatggaaagtggctgtggatctgggtgaatcagtgagtggttagtgaatgtgaaagcctaggacatcactatctactactgtagacttataaacactgtatattggccaggcgcggtggctcatgcctgtaatcccagcactttgggaggccgaggtgggcggatcacgaggtcaggagatcgagaccatcctggccaacatagtgaaaccccatctctactaaaaatacaaaanttagccgggcatggtggcgcatgcctgtaatcccagctacttgggaggcggagggaggagaatcccttgaaccagggagttggaggttgcagtgagctgagattgcgccacagcactctagtctggtgacacagcgagactccatctc

SEQ ID NO: 76309 - DNA, 472 bp, Homo sapiens
  misc_feature (158)..(158): n is a, c, g, or t
  misc_feature (235)..(235): n is a, c, g, or t
  misc_feature (237)..(237): n is a, c, g, or t
gatttgccaccccttacattacaccgccagaatgaacctgtgcctttgtgtccagctagtggctggactgtggcttgttacttacctccacgccctcctgcatactgtcctaatagcacagctgtccttctgtgcctccaatatcatccatcatttcntctgtgatctcaatcctctcctgcagctctcttgctctgacgtctccttcaatgtaatgatcatttttgcagtaggngntctattggctctcacgccccttgtctgtatcctcgtatcttatggacttatcttctccactgttctgaagatcacctctactcagggcaagcagagagctgtttccacctgcagctgccacctgtcagtggtggtgttgttttacggcacagccatcgccgtctatttcagcccttcatccccccatatgcctgagagcgacactctgtcaaccatcatgtattcaatggtggct

SEQ ID NO: 76310 - DNA, 864 bp, Homo sapiens
  misc_feature (420)..(420): n is a, c, g, or t
  misc_feature (576)..(576): n is a, c, g, or t
  misc_feature (582)..(582): n is a, c, g, or t
  misc_feature (675)..(675): n is a, c, g, or t
ggcactttcctgttacctaaggaagaacccttgaagaagaggaagaggaaagaaagacaagtcaggcatggctctcacccagggacaggtgacattcagggatgtggctatagaattctctcaggaggagtggacatgcctggaccccgctcagaggactttgtacagggacgtgatgttggagaattataggaacctggcctccctgggaatctcttgttttgacctcagtattatctctatgttggagcaagggaaggagcctttcactttggagagccaagtacaaatagcaggaaacccagatggatgggaatggatcaaagccgtgatcacagctctctcttccgaatttgtaatgaaagatttactacacaaagggaagagtaatacaggagaagtattccaaacagtgatgtnggaaagacaggaaagccaagacattgaaggatgttccttcagggaagtccagaaaaatacacatggccttgagtatcaatgcagagatgctgaaggaaattacaaaggagtgcttttgacccaagaaggcaatctcactcatggaagagatgaacntgatanaaagagatgcaagaaacaagcttattaaaaatcagcttggattaagccttcagtcacatctgcctgaactgcagctttttcaatatgaagggnacaatcttatgaatgtactcaggtgagacgtcttccaacaataattcctcagtttcaccacctcaacaaaatgccttataatgtcaaacccaccatttttaagaaaattctccaaggatttatccccttctctattactcccacgggcaaacggcaataatgggggagcccttacacatcgagggcggg

SEQ ID NO: 76311 - DNA, 421 bp, Homo sapiens
tcagttggtaaaaacagacctgactcgtgaggctggacagagtcctccacgccttgggatctgagtcactggaaccaaactagactctattttacttcctataaccacctgcctggacagattgcacccttgtcagttaccatcaggggagagttgttttcttcaccacggtcacaaagactggccttcatgtgtgtgctatcatggtgatgacttcccagggaggaaagtacagggaggatgagaaactttttggccaatgggagcaggaagaacttcaagctctccaggagataaaagcaaagtcacagggctctgtgctgctgaagcacacttctggatatacctgccacaagcagcaacgctaattaaattggcattccttatcaccactgcagtagctcctcaggaatatttatat

SEQ ID NO: 76312 - DNA, 453 bp, Homo sapiens
gtttctaaaatgtattacataaagtatgtggagctgaagaaagcaaaaggttggactataatggatgctcttttgtgcctccaagatacacccttcagttctgaggctttcatttgtccgccccctgagagtattgctgcctgatgtctttctcctgagccttgagacttatgaattgtccttgggcaaagggagctgccttaccagaagaaaccttctttctctaggacactccttatcaaatggctattgatatgatagtataaatgcttgtgcccctatatcaaagcagaattctaaagaaccattttagcagagctgcccaagagattggccaaggcctccttgagactgtttcacagttcaagttctttttctcaatcttaattttttttatttctcaataggtattaatcctgagaactctccttaataaaattattatgtgcaaat

SEQ ID NO: 76313 - DNA, 831 bp, Homo sapiens
  misc_feature (28)..(28): n is a, c, g, or t
aattcggcatgagggaaaacctggaggnaaagaaaaaagagggaagcatgagggtactggatgcctgggcaaagattaagagaatttgccaagaggtgggacatttccaagacaaacagcatactttacactttggctaaagtccctcatggcagtactcatttttgatatgtgctctcactacatttaatcgcagtgacagttgtgagattagaggtaccgctttcttcaaaaggatcattgaaagttgtgggtttatccttgtgtttctgtttagttttttatcatactagttttatttgtaaaccaaaatgcattatattttagacctttgctccaaaaggctaatgtaataatttttttaatggacttaagattttaactctaaaacctcatcaacattccatatattatgattcacatgggacttgtaaaagacagacctccacacctcagaaccgcaatgggccttttgtcccccactgccgagtatttccgacctcctttgaaggttataaatttacaaccttagtatgttttatggtgtggtgaatattgccggagaatgatctggcccagatgaaaatgggattctgttggccctcaatgttcttttcttgagagaccctactctgcattttaatacatgttatactatcttcaagttttaaccaaaatgttaatttgattttttttttctttcagtcaggaagaaaggaaaaaaaagaggaagggagggaggagataaaggaaagaaaaggaaaagaaaaaaggcagaaagaaaagagaaagaaagaaaaagaaatagaaagaaaaaaggcaaacacaatg

SEQ ID NO: 76314 - DNA, 1648 bp, Homo sapiens
ctccagagttctttttgttcactcctaccccccatcaccatttgattgatctccttaccctgtaatttccccttcttgtcgcttacctgcagtatctttcccacccaggcatgccttattctttctaaaggaaagtatgaatggagaggggaaagcttgggaaactgatagatttccttggatgccaaaacacctccatagcctgtctgcccggccctatgtggaaacagcattgagtttcaagtcctttatgcctccacccagggatagccacttggaatccacatggcaattgtgaaacaagcaggaaatgcgtaattgtcagaattttgtggggaaaggactagggaataaggaaaacaaagatcttccttgtgttttagagctgtcagctagaggagcacctgcttgagtctgatgccatctaatggtcccagaagaaactgggttttgaacctagagttccatggactcttaggaattagactactactactactaagcattcactggtgcttactatgtgctattgctgtgccaagtatctgaaacctgtcttcttaccttatttttcaagataattctatgtggcaggtattactatctcaattctaagagtgagaaaatggagttttagaaacatttactaacttgcctgggtcacatagctaaggaagaggtggacttgcccagctttgcataaaactcctcaaaagagttgcctatactccctgattccacttatcttcctactatcctctttttaaaatatattatttatttatttaaataagcaatatatgaatgtggtttgaaattcaaaagacacaaagaagtatacagaggaaagcctcactctcaatccttctcaaggtttgctaattcctcttgcataggcaatccgttcttccagctttgtgtttatctttccagagaagtttactgtgtattaagcaaatatgtatatctttattcttgctcagtattttcgcaaacagcagctgtctaagttcactgttctgaactttattttttaaattaaaaatatatggctatgtagtattctattttatggaagttccatatttcatttatcctgtttccttctactgatggctagttaggttattggaagtcttttgctgttgctagttagtcttgtatagacattgtaatgcacatgtgcaaaaatacaagtatgatacaatcttaaaggggagttgctgagtccaatatatacattacaaatattgatagatattgcaaaattgccttcatagaggctatattaatttatagttccagcagcaacatatgagtttatctgtttctccatatatatatatatatatatatatacccaacagacacgtgttcattttctaaacactgttggaccactcctttctgggtgaaagtacgcatgctatttgtagttatcatgggctttaatatcatcctggtaagtacacgagatctaaaccccaggagatagggcacgactagacattaagcccacacacattacatcgctacatttggacacccacggacataattgcggccccaaccctcaacgagtaataataggggaccctttgattgcgaaaacccttttgtaaggaatctcagccgaaaaaggcaaaac

SEQ ID NO: 76315 - DNA, 299 bp, Homo sapiens
gaacagacccaggtcacacatctgcctttgaagacctggggttgtcacagctctattgaaaaaaatttaattgagattggaatgaacagttaagaaagctgtaatgggccaggtgtggtggctcatacctgtaatcccagcaccaaagaaatggttccagaccgggggcagtggctcacgcctgcaatcccagcactttgggaggctgaggcagatggatcatctgaggtcaggagttcgagactagcctggccaacgtggtgaaacctcgcctctattaaaaatacaaaaattagccg

SEQ ID NO: 76316 - DNA, 540 bp, Homo sapiens
atccaggagtaccagttcttagatcaggaggactggggcccccagcggacctcaaaggagatcaggcagttgcagaatgactgcatgaggcttcgggagtcactgaacaccacccaagtgcacaacctggccctgggggagaagctgcagaacctgcccaccttattgtataagagcctgaaggagggagcccaggccatccaggaggaggcccaggccatccaggatgaagtgaaggccctgcaggaggaaagccaggcctgccggaggtggctctgctcaggtgtgcgggcagccatggcagcggggagggaagaggcggctgccccatgctgctcactcgagctgtctctgcctgcagtgacccaaacccccggaaggcaggtctcctcttcaagctgcctgacctgccccacgaccacagagaccagggtcaggcctggcaggccccaggccagaggtcggacacctcctcgggaggccgctccttcagccagctcctccctagatcccagaaataaacttggaagctaagcttca

SEQ ID NO: 76317 - DNA, 473 bp, Homo sapiens
gattctgagaggtttcactgactcctacctggatagttaagaacatacacacggccgggtgtggtggctcatgcctacaatcccagctacttgggagactgaggcaggaggattgcttgaacctgggaggaggaggttgcagtgagctgagatcacaccactgcactccagcctggacaacagagcaagactctattctgtctcaaaaaaaaaaaaaaaaaagaacatactcactattagctctcctgaaattaatgggttggggaccctggcccagaactcagaaccctgcctctggtctggtattgttttcaccacaccacagggtcccccacaattcccccttaaaagctgaaactgtctggatggagcagctggtcctactccttgtccctcagtgacgtccagctccgttgtcttatttgcaccctaggctgtctctggtgggtttctggggcagggggctctaggcc

SEQ ID NO: 76318 - DNA, 947 bp, Homo sapiens
acaaatataggcaacaattcatagtgaaacagtggttatcttaggaagagatatactgagaaatagataaccaagaaacttggctagaggtttctttcctttttcttctaatacattttcttgtatactttgaccttttttaaaacaatagggcttatggatagaattatgggccattttgttttctacttcgataccatatatatctacacacacacactcccttaatttttaaaagtaatttttaatttttgaatacgaattttaaatttttaataaaaacatttattaagaattttttttctcattccagaactgggagctcagtaacgttggggccataagaaaacaaaatgtgtttattagatacaaattcaactgttacagtaaacaatgaatatctcaagttttgatatgaacctatttttaatataaatgtgtcaaattatatagaagttcaatataaagtacttttgacttacttttgcaaagattgaaagaactatgaaaaaaaattactgtaattttttttaaacacatactgttctatggaagtattacaccgaattactgcattgattccaatgatattccaactgaaataaaatatttgaaccacggcattaactccattccttttttgctgatgttaggacatacattaccactaggtggcaatatataattagcattccatttactttgcagccaaacacatttgcatttgcaacattcaaagtaggtagcaaatacctttcaaatatttatctaaaatacagtattgctcagagcatcttattaaaacaatacagtttagggtaataaaggaagcatatccctttttttctggatttgaattcaaatcactaaaattcattagttgggttcgatgattactaggacttaactgcaagttgtacatgctatattctcaagatataagacta

SEQ ID NO: 76319 - DNA, 896 bp, Homo sapiens
tggagcagttctgctagaggaggaaacagcacaaagggcactcttatgctgctgtaaaccagtgccaggatttttaaaatgtgagacacctgttaccctgtgcccagatttcatattgttcaaacacacatgctctacatacaatttgtgcagttaatgcaatcatcacaaggtcctaggccgacctacagcctcagcttacgaagatgacaagattaagagattaaagtaaagacaggcataagaaatcaaaagagtattgattaaggaagtgtttatgttcttctgccatggcttcagctggtccctccattcaaggtccctgacttcctgcaacagggggcaaaggactctttgtcttcaaatttccctccaccttgctcatcatcaagagagtgtgaagaggaggagaaaggctgaagaggaggagaaaggctaagatcttttccaatgcaaaattaggaaaaaatatactacagatttatgaaaaaataagaagtgaaagtattctctgactgcaagtatgaccacctgtctttctatatcaggttgataatttctaacatgttcctttgtaattgtttctcaattttgtgctgaatgttgaccatgtgcatttccatttcttcaacaaaatcacatttgtctttagagcactgttgttactgtgcacagcactctccccatgcctgaactgtcaacaatccactgagtaggacatatgcccagctgtctgactaaagctgagcattgtgggccgtggctttcaaatactccagtgctttcacagatgatctggggaggaaactagtgactccacacctttaatttaataatattgccccaaacaaatgagtaaaacagagaataaagagggcaaataagtactctgaaga

SEQ ID NO: 76320 - DNA, 1037 bp, Homo sapiens
tggagcagttctgctagaggaggaaacagcacaaagggcactcttatgctgctgtaaaccagtgccaggatttttaaaatgtgagacacctgttaccctagagtgtgaagaggaggagaaaggctgaagaggaggagaaaggctaagatcttttccaatgcaaaattaggaaaaaatatactacaggtaagatggagcaagcatgctctgcaccttgtgtctccctcaaaatgtggctctaaaacctggacaggatacagcagctatttgaggtctctgaaaagcaaacagtaacatgcaaaaaggggaagaggacaggaatctgaagtagcaccaaaccaatgatttatgaaaaaataagaagtgaaagtattctctgactgcaaaacccaagctaaaagactgcatttactacccttccttgctaacaagagtgactacgtgactatgttctggccaatgcaaacagcctgaaaagctgatgtaatgactggatcttcagcagccaccttgagcaagaggtagaagctagaggctgaggaatgatggagcagaaaggaaggagctggggttcctattaacatcctgaagctacactatcaggcctggactgaccaactctttctggccttcttttacaagagaaaaatacagttatttaaaccactatacttctgttttcttttttggggtatagataactgaacctaatcctgtcccaaatcctgatcctatctaaccagtgttagctatcagcccatacgtatactggagaatgacgtttaacaaaataagatgttaaagttctaactaattgtaataatcatgcagttttctcatgctgaacaaagttaaagaaatataatgtgtgtttcctaaagagtgtcattttttggaaagataacatggggcacaaagtaacataaaaatctacatataattatgtaaacattgctttgacatacaacaccaaatatttttattgtatttgtgaatgcatttcttggtaataaaacggcagttatgaataagtgata

SEQ ID NO: 76321 - DNA, 1239 bp, Homo sapiens
tggagcagttctgctagaggaggaaacagcacaaagggcactcttatgctgctgtaaaccagtgccaggatttttaaaatgtgagacacctgttaccctgtgcccagatttcatattgttcaaacacacatgctctacatacaatttgtgcagttaatgcaatcatcacaaggtcctaggccgacctacagcctcagcttacgaagatgacaagattaagagattaaagtaaagacaggcataagaaatcaaaagagtattgattaaggaagtgagagtgtgaagaggaggagaaaggctgaagaggaggagaaaggctaagatcttttccaatgcaaaattaggaaaaaatatactacaggtaagatggagcaagcatgctctgcaccttgtgtctccctcaaaatgtggctctaaaacctggacaggatacagcagctatttgaggtctctgaaaagcaaacagtaacatgcaaaaaggggaagaggacaggaatctgaagtagcaccaaaccaatgatttatgaaaaaataagaagtgaaagtattctctgactgcaagtatgaccacctgtctttctatatcagaacccaagctaaaagactgcatttactacccttccttgctaacaagagtgactacgtgactatgttctggccaatgcaaacagcctgaaaagctgatgtaatgactggatcttcagcagccaccttgagcaagaggtagaagctagaggctgaggaatgatggagcagaaaggaaggagctggggttcctattaacatcctgaagctacactatcaggcctggactgaccaactctttctggccttcttttacaagagaaaaatacagttatttaaaccactatacttctgttttcttttttggggtatagataactgaacctaatcctgtcccaaatcctgatcctatctaaccagtgttagctatcagcccatacgtatactggagaatgacgtttaacaaaataagatgttaaagttctaactaattgtaataatcatgcagttttctcatgctgaacaaagttaaagaaatataatgtgtgtttcctaaagagtgtcattttttggaaagataacatggggcacaaagtaacataaaaatctacatataattatgtaaacattgctttgacatacaacaccaaatatttttattgtatttgtgaatgcatttcttggtaataaaacggcagttatgaataagtgata

SEQ ID NO: 76322 - DNA, 1153 bp, Homo sapiens
tggagcagttctgctagaggaggaaacagcacaaagggcactcttatgctgctgtaaaccagtgccaggatttttaaaatgtgagacacctgttaccctgtgcccagatttcatattgttcaaacacacatgctctacatacaatttgtgcagttaatgcaatcatcacaaggtcctaggccgacctacagcctcagcttacgaagatgacaagattaagagattaaagtaaagacaggcataagaaatcaaaagagtattgattaaggaagtgagagtgtgaagaggaggagaaaggctgaagaggaggagaaaggctaagatcttttccaatgcaaaattaggaaaaaatatactacaggtaagatggagcaagcatgctctgcaccttgtgtctccctcaaaatgtggctctaaaacctggacaggatacagcagctatttgaggtctctgaaaagcaaacagtaacatgcaaaaaggggaagaggacaggaatctgaagtagcaccaaaccaatgaactgggagctcagtaacgttggggccataagaaaacaaaatgtgtttattagatacaaattcaactgttacagtaaacaatgaatatctcaagttttgatatgaacctatttttaatataaatgtgtcaaattatatagaagttcaatataaagtacttttgacttacttttgcaaagattgaaagaactatgaaaaaaaattactgtaattttttttaaacacatactgttctatggaagtattacaccgaattactgcattgattccaatgatattccaactgaaataaaatatttgaaccacggcattaactccattccttttttgctgatgttaggacatacattaccactaggtggcaatatataattagcattccatttactttgcagccaaacacatttgcatttgcaacattcaaagtaggtagcaaatacctttcaaatatttatctaaaatacagtattgctcagagcatcttattaaaacaatacagtttagggtaataaaggaagcatatccctttttttctggatttgaattcaaatcactaaaattcattagttgggttcgatgattactaggacttaactgcaagttgtacatgctatattctcaagatataagacta

SEQ ID NO: 76323 - DNA, 906 bp, Homo sapiens
tggagcagttctgctagaggaggaaacagcacaaagggcactcttatgctgctgtaaaccagtgccaggatttttaaaatgtgagacacctgttaccctagagtgtgaagaggaggagaaaggctgaagaggaggagaaaggctaagatcttttccaatgcaaaattaggaaaaaatatactacagatttatgaaaaaataagaagtgaaagtattctctgactgcaagtatgaccacctgtctttctatatcagaacccaagctaaaagactgcatttactacccttccttgctaacaagagtgactacgtgactatgttctggccaatgcaaacagcctgaaaagctgatgtaatgactggatcttcagcagccaccttgagcaagaggtagaagctagaggctgaggaatgatggagcagaaaggaaggagctggggttcctattaacatcctgaagctacactatcaggcctggactgaccaactctttctggccttcttttacaagagaaaaatacagttatttaaaccactatacttctgttttcttttttggggtatagataactgaacctaatcctgtcccaaatcctgatcctatctaaccagtgttagctatcagcccatacgtatactggagaatgacgtttaacaaaataagatgttaaagttctaactaattgtaataatcatgcagttttctcatgctgaacaaagttaaagaaatataatgtgtgtttcctaaagagtgtcattttttggaaagataacatggggcacaaagtaacataaaaatctacatataattatgtaaacattgctttgacatacaacaccaaatatttttattgtatttgtgaatgcatttcttggtaataaaacggcagttatgaataagtgata

SEQ ID NO: 76324 - DNA, 936 bp, Homo sapiens
tggagcagttctgctagaggaggaaacagcacaaagggcactcttatgctgctgtaaaccagtgccaggatttttaaaatgtgagacacctgttaccctgtgcccagatttcatattgttcaaacacacatgctctacatacaatttgtgcagttaatgcaatcatcacaaggtcctaggccgacctacagcctcagcttacgaagatgacaagattaagagattaaagtaaagacaggcataagaaatcaaaagagtattgattaaggaagtgagagtgtgaagaggaggagaaaggctgaagaggaggagaaaggctaagatcttttccaatgcaaaattaggaaaaaatatactacaggtaagatggagcaagcatgctctgcaccttgtgtctccctcaaaatgtggctctaaaacctggacaggatacagcagctatttgaggtctctgaaaagcaaacagtaacatgcaaaaaggggaagaggacaggaatctgaagtagcaccaaaccaatgatttatgaaaaaataagaagtgaaagtattctctgactgcaagtatgaccacctgtctttctatatcaggttgataatttctaacatgttcctttgtaattgtttctcaattttgtgctgaatgttgaccatgtgcatttccatttcttcaacaaaatcacatttgtctttagagcactgttgttactgtgcacagcactctccccatgcctgaactgtcaacaatccactgagtaggacatatgcccagctgtctgactaaagctgagcattgtgggccgtggctttcaaatactccagtgctttcacagatgatctggggaggaaactagtgactccacacctttaatttaataatattgccccaaacaaatgagtaaaacagagaataaagagggcaaataagtactctgaaga

SEQ ID NO: 76325 - DNA, 2527 bp, Homo sapiens
ggccgggagacctggcggagctgggggtggggggccagtttttgcaacggctaaggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgc

SEQ ID NO: 76326 - DNA, 2507 bp, Homo sapiens
  misc_feature (17)..(17): n is a, c, g, or t
ttcattaacctttcctnaattcccgggaggctaaggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgc

SEQ ID NO: 76327 - DNA, 3203 bp, Homo sapiens
ggccgggagacctggcggagctgggggtggggggccagtttttgcaacggctaaggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggcaaca

SEQ ID NO: 76328 - DNA, 3149 bp, Homo sapiens
ggccgggagacctggcggagctgggggtggggggccagtttttgcaacggctaaggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaaaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggcaaca

SEQ ID NO: 76329 - DNA, 2890 bp, Homo sapiens
agcagagacccggccaagcctttactcataccatattctgatccttttccagcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggcaaca

SEQ ID NO: 76330 - DNA, 3152 bp, Homo sapiens
ggccgggagacctggcggagctgggggtggggggccagtttttgcaacggctaaggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggcaaca

SEQ ID NO: 76331 - DNA, 2764 bp, Homo sapiens
  misc_feature (17)..(17): n is a, c, g, or t
ttcattaacctttcctnaattcccgggaggctaaggaagggcctgtgggtttattataaggcggagctcggcgggagaggtgcgggccgaatccgagccgagcggagaggaatccggcagtagagagcggactccagccggcggaccctgcagccccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggcaaca

SEQ ID NO: 76332 - DNA, 2470 bp, Homo sapiens
ttcaggtctatagacagcggacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggcaaca

SEQ ID NO: 76333 - DNA, 2427 bp, Homo sapiens
tagaggatctagggagccttccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggcaaca

SEQ ID NO: 76334 - DNA, 2853 bp, Homo sapiens
ggccgggagacctggcggagctgggggtggggggccagtttttgcaacggctaaggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggcaaca

SEQ ID NO: 76335 - DNA, 3022 bp, Homo sapiens
ggccgggagacctggcggagctgggggtggggggccagtttttgcaacggctaaggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggcaaca

SEQ ID NO: 76336 - DNA, 2827 bp, Homo sapiens
ggccgggagacctggcggagctgggggtggggggccagtttttgcaacggctaaggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggcaaca

SEQ ID NO: 76337 - DNA, 2652 bp, Homo sapiens
ggccgggagacctggcggagctgggggtggggggccagtttttgcaacggctaaggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacacacagagggaccctggaaccagatccctccccatgggaaagacgaagcacagagactcgagccaagtttccctacag

SEQ ID NO: 76338 - DNA, 2658 bp, Homo sapiens
ggccgggagacctggcggagctgggggtggggggccagtttttgcaacggctaaggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccgcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggcaaca

SEQ ID NO: 76339 - DNA, 1708 bp, Homo sapiens
cccccccccgtaccagttgctgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggcaaca

SEQ ID NO: 76340 - DNA, 1604 bp, Homo sapiens
tcagctcggtacccaaacgctgctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggcaaca

SEQ ID NO: 76341 - DNA, 1767 bp, Homo sapiens
aatataacaatggaaaatgttatgtgaatcaaattagctttcttgctctgaagttcacaaggggcctaatgataattctggtacattatttttgactcttttttggtaaattggtaaattagtaaaagcaaatggtgcaatcacaggatataaattgtgttgtttgttcagagaatattttacatccaggattgaaattctctagatatttttttaactgtgttttcctctaatttaaagtgcttgtaattacacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggcaaca

SEQ ID NO: 76342 - DNA, 2376 bp, Homo sapiens
ggccgggagacctggcggagctgggggtggggggccagtttttgcaacggctaaggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggcaaca

SEQ ID NO: 76343 - DNA, 1762 bp, Homo sapiens
ggccgggagacctggcggagctgggggtggggggccagtttttgcaacggctaaggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgcccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggcaaca

SEQ ID NO: 76344 - DNA, 2000 bp, Homo sapiens
gcggcttgcggggaccacagctcccgaaagcgacgttcggccaccggaggagcgggagccaagcaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggcaaca

SEQ ID NO: 76345 - DNA, 2473 bp, Homo sapiens
ggccgggagacctggcggagctgggggtggggggccagtttttgcaacggctaaggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcaggcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggcaaca

SEQ ID NO: 76346 - DNA, 2121 bp, Homo sapiens
ggccgggagacctggcggagctgggggtggggggccagtttttgcaacggctaaggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgctgtatgactgcacatgactcgggggtggggaaaggggtcggctgaccatgctcatctgctggtccgtgggacggtgcccaagccagaggctgggttcatttgtgtaacgacaataaacggtacttgtcatttcgggcaaca

SEQ ID NO: 76347 - DNA, 1707 bp, Homo sapiens
ggccgggagacctggcggagctgggggtggggggccagtttttgcaacggctaaggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacatccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggcaaca

SEQ ID NO: 76348 - DNA, 1899 bp, Homo sapiens
ggccgggagacctggcggagctgggggtggggggccagtttttgcaacggctaaggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcgctcccgaaggtcctgctagagtcacccag

SEQ ID NO: 76349 - DNA, 1223 bp, Homo sapiens
cgcgatacgcgacttgagcctgcagaccgggcctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggcaaca

SEQ ID NO: 76350 - DNA, 702 bp, Homo sapiens
ccggactttatcgtcatataagcggcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggcaaca

SEQ ID NO: 76351 - DNA, 1387 bp, Homo sapiens
ggccgggagacctggcggagctgggggtggggggccagtttttgcaacggctaaggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgcctgaccaggcttcagtgcctgaccaggcttcagtgcctgaccaggcttcagtgcctgaccaggcttcagtgcctgaccaggcttcagtgcctgacctggcttcagtgcctgaccaggcttcagtgcctgaccaggcttcagtgcctgacc

SEQ ID NO: 76352 - DNA, 993 bp, Homo sapiens
ggccgggagacctggcggagctgggggtggggggccagtttttgcaacggctaaggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggg

SEQ ID NO: 76353 - DNA, 865 bp, Homo sapiens
ggccgggagacctggcggagctgggggtggggggccagtttttgcaacggctaaggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctgcgcctgaccaggcttcagtgcctgaccaggcttcagtgcctgaccaggcttcagtgcctgaccaggcttcagtgcctgaccaggcttcagtgcctgacctggcttcagtgcctgaccaggcttcagtgcctgaccaggcttcagtgcctgacc

SEQ ID NO: 76354 - DNA, 874 bp, Homo sapiens
ggccgggagacctggcggagctgggggtggggggccagtttttgcaacggctaaggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgc

SEQ ID NO: 76355 - DNA, 357 bp, Homo sapiens
gttttactttctttttagctttaaagtttttttggcggcaatgtgaatacattcctatacttctgcccacttaatttgttcttggccattgtctttgatactcatgtgtagccactcaagccccaggtgacaccatctacacacactggaaatatgaaattttttgaggcccaacatgttgttcaaaggaaatgctcactgcagcattttgaattttaattttcagattagggaagctgaaccgataagcataatacgaatattccaaaatctgcccaaacacttctggtccaaagtatttcagataagggatactgaacctgtataagctgttcatctaagctatattagatatgt

SEQ ID NO: 76356 - DNA, 761 bp, Homo sapiens
agtattccatgcagcaattaacaacataagcatttcgttatatgtcctaacacagagaagctcgaaaacaccaagaatgaacctgttttttaaaaagaatcaacactaaacaatacatacatacaaattatttagcccactggaggggtatcctccaactctctatactctcctctaccaccccaccccaactaggtccaaaagagctatgtcttacaacagtcccttaacttagctttccaggaggctcagtcatccattcctagagaagcctccttaactcacttaccattctctatttactgccttgagaattctacttcaatatgtggaattgtatttccttaaaccttagtcaaaaaggtaatcatgtcttggtatcatgaaataattttgaacttgaggaccctctgaaagggcctcagggacccctggcattaccagaccacactcttgagaatcactgatatccatttattttggaagtacaggtagaagaggagcctgccaactgtaagcggcaaatagaaactgagcaggttataggattcaaagtcaaaagatgtggatttgagccctaactccactgtacacttttctggctatttgaactaagtaagacagtaatttaacctctttcaagagtttcaggccgggtgcagtggctcacgcctgtaatcccagcactttgggaggccaaggtgggtggatcacgaggtcaggagatcgacaccatcctggctaacacagtgaaaccccgt

SEQ ID NO: 76357 - DNA, 714 bp, Homo sapiens
gcatcttcatcttcaacgttgtgtactacaagccgctggtctacaaaaacaccaacgtgtacccgtggtggggtgaggccatgggctgggccttcgtgctgtcctccatgctgtgcatgccactgcacctcctgggctgcctcctcagggccaagggcaccatggctgagtgctggaagcacctgacccagcccatctggggcctccaccacttggagtaccgagctcaggatgcagatgtcaggggcctgaccaccctgaccccagtgtccgagagcagcaaggtcgtcgtggtggagagtgtcatgggacagctcagctcacatcaccagctcacctctggtctgtggggcaagaggctgcaatattccatcctgggtgtctgggctgctaacctggcctgctcaggcttcccaccctgtgccctgggctgggcacacccccgggaagggaccccggacacggctcccacatccaggctcaaggcggatgcacttcctgcacctccagtcttctgtgtagcggctttaacccacgtatgtctgtcacgtccagtcccgagacggctgagtgaccccaagaaaggcttccctgacacccggacagaggctggagggctggggctgggtgagggtggtgggcctgcggggacattcttactgtgctaaaaagccactgcaaacatagcaataaaaacctgtcattttccaaagc

SEQ ID NO: 76358 - DNA, 519 bp, Homo sapiens
gcatcttcatcttcaacgttgtgtactacaagccgctggtctacaaaaacaccaacgtgtacccgtggtggggtgaggccatgggctgggccttcgtgctgtcctccatgctgtgcatgccactgcacctcctgggctgcctcctcagggccaagggcaccatggctgagtgctggaagcacctgacccagcccatctggggcctccaccacttggagtaccgagctcaggatgcagatgtcaggggcctgaccaccctgaccccagtgtccgagagcagcaaggtcgtcgtggtggagagtgtcatgggacagctcagctcacatcaccagctcacctctggtagccatagcagcccctgcttcatccccaccccacccctccagggggcctgcctttccctgacgcttttggggtctgcctgggagaggaggggagaaagcaccatgagtgctcactaaaacaactttttccatttttaataaaacgccaaaaatatcacaacccaccaaaaataga

SEQ ID NO: 76359 - DNA, 415 bp, Homo sapiens
tttattgagacagactctcgcactgtcatctgggctggtgtgcagtggcacgatctctgcttgctgcaacctgtgcctcccgggttcaagcaattctcctgcctcatcctcctgagtagctaggattacaggcacacgccaccatgcctggctaattttttgtatttttagtagagatggggtttcactattttggccaggctggtctcaaactcctgacctcatgatccgcctgcctcagcctcccaaggtgctgggattacagacgtgagccaccatgcccagtcgatatattcacatttttaataggaataactgtatactaaaatctattttagtgcatgtttaagatttgaagatgtaatttgactcagtactttccacctacatttttttcttcattctgtgcctgcta

SEQ ID NO: 76360 - DNA, 384 bp, Homo sapiens
ttttttttttaattgataattttctacaagtaccctccctaccttgaggatctgcgtctacctatagaggttttggcactactgtaaatgagtgaaatgtatcacagtcagggaaaggaggatctggggactttttgaaagggacaattgtgataaattccaggcaacttttattatgcagggctgtggactcggtgttaccttcttggaagctggacatgcagatttgatgtgagcagtactgtgtgggccaaacaaaacacatctgcagaccagacttgacctgcaggtcactaatttgaaacctctgtcctaaactgaggctaaatttgatttcttgtttccatcaactttatttttttttatttatttattgagacagtc

SEQ ID NO: 76361 - DNA, 424 bp, Homo sapiens
atgaataagagagataggcaagaaaaataagcaccaggacactgggaattcatccaggaacaaaacagaccccgtctcttctcttcctggacccagaatctttgcacaggctggtctttcccagagcactttcaccccctgccttctcctgaatactcatcttcattctttaggtttcagcttagaggtcccctcttccaggaagccttctctggctcctcctcccttctaggctgggccaagtgtttctctagggtttccatagctccccaggcttcccccatcccagcctggaccactctgggatggcacaatctggttggtgatgcctgtgtcttccactggactgggacctactataggataaagtctcagatgtgtttatctctggttcctctggacctagcagagaactagatactaa

SEQ ID NO: 76362 - DNA, 726 bp, Homo sapiens
cccagaaaaaaatatttggtacaactctttataacaggtactcaataaatattcataaatgcacctaagtttaggactggcagatggatgataagtaaacaaatacgtacccatgtgtaaatcattgagtttaggtctgtgaatttgaaaacaatgttgttatctgcagtgtttccaaacagaattctacttatccagtttttcccaccccagtgctaactctagagatcaggtatattgcactcactcattatatgtatatttagctgtatcttgagggattctttaactcagaatgttatggatttgttgagaatggctgaacacacggcctacaaggagaatcctgaccatttgctggacacactttcatagaatgacctctaaaggaaatgcagttgttctgataagaatcccagttcctcctgaccaacccactgctgataatctggtaaccccagccaagccaaggatgtcattctgtctgtccggatcttctgaaggcctcacatttctcttgtgccgcaactcttgtacggggtcatttcctctaaggaccaccataattgagtgtgtctttgttcatgcactaactttaagaagagaggtaaatactaaatcctcgccaactttaccaactacagaagattctagaaaggcagatcaaagctgactgtggctggctgagatcgcaggtgcctttccatgctgagtggcctgagtctg

SEQ ID NO: 76363 - DNA, 299 bp, Homo sapiens
aaaaattaaggggtggaaaaggagaaaagactaatacaattcaaacactagccaagagaggcctgactggggaaataacgcaaacaagaaataatgtggtgccctggaagaaatgctatcagtaagttacaagtcagcattgaggaagccccgaatgagactgtggaagacattctagagaagacgatctgaactaggtctagcatcagcttcccagcttttgaatctcactaggcaagggggacagagctccctgttgtggtttataacaactgtgataacagacacccagactcccc

SEQ ID NO: 76364 - DNA, 1077 bp, Homo sapiens
agacgcggagccatggccgaggtgttgcggacgctggccggaaaaccaaaatgccacgcacttcgacctatgatccttttcctaataatgcttgtcttggtcttgtttggttacggggtcctaagccccagaagtctaatgccaggaagcctggaacgggggttctgcatggctgttagggaacctgaccatctgcagcgcgtctcgttgccaaggatggtctacccccagccaaaggtgctgacaccgtgtaggaaggatgtcctcgtggtgaccccttggctggctcccattgtctgggagggcacattcaacatcgacatcctcaacgagcagttcaggctccagaacaccaccattgggttaactgtgtttgccatcaagaaatacgtggctttcctgaagctgttcctggagacggcggagaagcacttcatggtgggccaccgtgtccactactatgtcttcaccgaccagccggccgcggtgccccgcgtgacgctggggaccggtcggcagctgtcagtgctggaggtgcgcgcctacaagcgctggcaggacgtgtccatgcgccgcatggagatgatcagtgacttctgcgagcggcgcttcctcagcgaggtggattacctggtgtgcgtggacgtggacatggagttccgcgaccacgtgggcgtggagatcctgactccgctgttcggcaccctgcaccccggcttctacggaagcagccgggaggccttcacctacgagcgccggccccagtcccaggcctacatccccaaggacgagggcgatttctactacctgggggggttcttcggggggtcggtgcaagaggtgcagcggctcaccagggcctgccaccaggccatgatggtcgaccaggccaacggcatcgaggccgtgtggcacgacgagagccacctgaacaagtacctgctgcgccacaaacccaccaaggtgctctcccccgagtacttgtgggaccagcagctgctgggctggcccgccgtcctgaggaagctgaggttcactgcggtgcccaagaaccaccaggcggtccggaacccgtga

SEQ ID NO: 76365 - DNA, 300 bp, Homo sapiens
agacgcggagccatggccgaggtgttgcggacgctggccggaaaaccaaaatgccacgcacttcgacctatgatccttttcctaataatgcttgtcttggtcttgtttggttacggggtcctaagccccagaagtctaatgccaggaagcctggaacgggggttctgcatggctgttagggaacctgaccatctgcagcgcgtctcgttgccaaggatggtctacccccagccaaaggtgctgacaccgtggacgggcctcctgcagcccaggggtgcacggccggcggctcccccagcc

SEQ ID NO: 76366 - DNA, 356 bp, Homo sapiens
cagagactctgagctttggccctttcccgagttcccgggattatgagctgacacagcccccaagcaaccacagtgattccagcctgggagtgtggccttggcgggagggtcaatgcccagtcatggttcagcggctgtgcacacccctgcttacctgcatcccacgctttccatgcaaactcacgtggcggcgctttgtgcttgcaggatggtctacccccagccaaaggtgctgacaccgtggtgagtaaagttactgacactgaaactgaacgcagctcaaggggctgttctgaaggtattagagggcggtttccttgatgtaaatctcagttggggctgcttcgttctctcct

SEQ ID NO: 76367 - DNA, 4251 bp, Homo sapiens
  misc_feature (555)..(555): n is a, c, g, or t
  misc_feature (579)..(579): n is a, c, g, or t
tccacctcttggtgggagagggtgcaaaaaattttatgatcattctcagtctaccacaagaaggttccagtgatcaagaaaggcttcatggagataccaagcattgagcaggacttcaaggatggataagatctgatgctgaaggaaggagaaggggtgatattccaggagggaaggacagtgtgaataaaggagcggaggtgggaaggaagtgtttgggaggccctgatctgaccagtcttgttgaggagagggtgcatgaggcaggctggtaggagatgagaaaaagagaattgggggtagatttaggggtcttgaaggctggcctgagaatttgataaatgacccaataggcaaaaggaggcacggaaggattgtaagtagggtcaggaggtaacattgaatgccattgcctacacccccatgtccccacctgaaagtaacatccttcgttgcgtggttttctaaacatcgggactcttcatggtttgatggctggccccagggtagttggcacttttcatttttctcccgttcctgccccaccaccatcanaaggcttggacacctccatcatcnctgatgagtactgaatgttgggtccctgcggtccagagctgcctgcttctgccagagggaatgacagaagggaagtgactttcaaacaggagccggggtggggctgggcaaatgcacctggtccccttgcccacccactcctgcttctactctactctgggttcatcagttcatgccctgtcctggaggagaatttccaacatagtgacccccatgtggctaaaatggcagggaggggtgctaacatttattgaacattttcttgcatgaatctctctctctgagggtattcagttaggtctcaattctgcaaggttgctattacattatgaccactttgcagatgaggaaactgaggccagggaagttcatacagccagtcaatggcagcactggggttgaggccagctggtctgactctgcatcttggtcgcacgatgtcttttatctcattttctgtgtgagaacctcccaggacagcaccacaggctgatctgagatttaagagcagatctaaagtcacgcctaccttcggatgatactgaaaagccagagtcctggccaaaaagctggtcaggagggctgtgaggggccaggtgcacagtggggctctgacatgcctccccagtcccttcaggccctgtggtaaggctgaggtctcaggccatcactctgggggtctgaagatgagtcagagccagcctggggccctggcctcccagtgggtgagcaggaaggatttcactgcattgggaacattgtgtttccagatatagactggccacctgcctggccccctggatctctgggtggccgtccctggtgggcagtcaggagccaggccccacggggtgggtctgaggggcctttggatgacttcatctatcctcccccaccaagttagtatttctgtctgttctgtgaagtcctggtaactgaacaagccctttgggttcagattccttctcccactgaaagccgcatattgcagtaaatcctttttggccaagataaatgacagatggcccaggaggaagggcatcaggtgatagagacagagcagctagaagagtcagggagagaagaagatacaaaagaaattgtgcagcactcctttccttccacaaggcttgatgtgcccacactgcctccctgcaggacaggcatgggtgccatgtgtgagggtccacaggccaggccccctcttttagcctcagtttcccagttcacagggtggaggaggaatacgtgtttggaaccagtgacttccgggggccccctccggtggccttaaggtgacatcctcacccacctgggggcctgaggcaagcctgatagcttctacagtcctgcaggcccaaaagctaaccaagcagcagaacctttgcaaatgcagactctcagggcttatcctgcagggccccagtcagtggatctggggtggacccaggggcctttaattttagaaaatttgcagatgggtctgatattcactgtggcatagtatagatcaaggtcagctgtccccattcactgattcttagtcttgggtgcacattagaatcacctggagggctatagggaaaaattccaatgctcaggctacaccccagaccaattatatcgtaacctctgaaggtgaggcccagacagcagtaatgtttaaagttcctcaggtggttgcaataagcactgagactgagaaccattgctatggatgagccaaaaggtggaggcagcgtccaccatccatccttgcccgccctccttctgaaggtgaagctttcacctttggaaaccctgtcatccaccaagacagctaaaagcccgtcctctagcagctgatccctctgatggacaaggcattaaatgacaggttacataatcggggacctagtcctgggaccccggacaaggcacctgccttgcctgaacctcagtttcctcaactgtggaaggagggcatgggtgcctggttttcaaaacgtgctcagagcaggtctagctgtactgggcagtacctcggccaggagcactggactccgggcccccatgcccctggccctggttctcccagagcagctctaatcttagcctgttattgctgaagcctccttgtgctaagacaaacacttcaggagccaaaaacaatttgacaactgttagtctagatgatgtgcactttcatcccagctctgaaggtctacggaaaccccactctcccttctccacatatactcataattcctgtagtctggagccttcatttggcacctacaccccataaatcctgctttgatttgcctggcactgatgtggtcctgtatctggtttatctcccccactaagctgtgagttccttgaaggcaggtcttcattcattttataaacacagcacacatttattgagctccttctgccaccatgctggatgatggggacactgtggtgaatgagactgacacagcccctccctcatggagcaaaaacttcgtggatgagaaagattgagtgaagcaattacaaagttatatgtgctgtaacagggaagcatagggtgctatgggggcacaagggacggcacccaggaagatagagggggcaggaagcttcccagggacagggaaggaggccagccttggctgagggagctgcatctgcagagacctggagggtgagggaggggccaaggccatagacagggagcaggcctttgagccctgcctggtaaggagccagcattttatcctgggcccctgatgacgtaaccgtggggtgacctgaacagtttttcctgcctgtggaatcctcctctttgcctaccccacaccccttctccagcactggtgcaggagttgcatagtagtggctcaggagtcctggatgagagagatgcatctgggggcacagtaggggtgcacaggtgtggacggatgaggaggcaccttcacacgaatgggtgctcccagacaggggtgggtggtgcatgaatgttgaattgcgttgggtggtaggtgggatgtctgtgtttgaagcctgtcctgctccccacctaggttctatgaacaccctagcccaccctgacagcccttttcctggagtccagcccccagcttggcatagttggtgaagacccattgtctgcctatcgccaggcactcagagaaagcctctatcccccttctgtgggttcacgggctctctggggccacgctgcaggtggtggcttgccctgttgcctggccctcagctcaggcccttggagtgcctctctgccctgtctgctgccccggctgctcctcttaccctccctccctctctgcccgcttccggcccagtttctcagctacctcagtgcctgtgaccgcctgttacgtcagggatatgaggaaggcctggtggatgaggccatggagatgttccagttctccgagagccaggcaggggagttcctgcgcctctgggagcagttcagtgacatgggcttccagcaggaccggatcaaggaggtgctgctggtccatggcaaccgccgagagcaagccctggaggagctggtggcctgtgcccagtgaccacggaggcactccacgatgcctgggcatctaggcccaatgccagacctggcaacccatcctaactgtattattaaaaccaagtaagagtaaaaaa

SEQ ID NO: 76368 - DNA, 5494 bp, Homo sapiens
  misc_feature (555)..(555): n is a, c, g, or t
  misc_feature (579)..(579): n is a, c, g, or t
  misc_feature (4120)..(4120): n is a, c, g, or t
  misc_feature (4668)..(4668): n is a, c, g, or t
tccacctcttggtgggagagggtgcaaaaaattttatgatcattctcagtctaccacaagaaggttccagtgatcaagaaaggcttcatggagataccaagcattgagcaggacttcaaggatggataagatctgatgctgaaggaaggagaaggggtgatattccaggagggaaggacagtgtgaataaaggagcggaggtgggaaggaagtgtttgggaggccctgatctgaccagtcttgttgaggagagggtgcatgaggcaggctggtaggagatgagaaaaagagaattgggggtagatttaggggtcttgaaggctggcctgagaatttgataaatgacccaataggcaaaaggaggcacggaaggattgtaagtagggtcaggaggtaacattgaatgccattgcctacacccccatgtccccacctgaaagtaacatccttcgttgcgtggttttctaaacatcgggactcttcatggtttgatggctggccccagggtagttggcacttttcatttttctcccgttcctgccccaccaccatcanaaggcttggacacctccatcatcnctgatgagtactgaatgttgggtccctgcggtccagagctgcctgcttctgccagagggaatgacagaagggaagtgactttcaaacaggagccggggtggggctgggcaaatgcacctggtccccttgcccacccactcctgcttctactctactctgggttcatcagttcatgccctgtcctggaggagaatttccaacatagtgacccccatgtggctaaaatggcagggaggggtgctaacatttattgaacattttcttgcatgaatctctctctctgagggtattcagttaggtctcaattctgcaaggttgctattacattatgaccactttgcagatgaggaaactgaggccagggaagttcatacagccagtcaatggcagcactggggttgaggccagctggtctgactctgcatcttggtcgcacgatgtcttttatctcattttctgtgtgagaacctcccaggacagcaccacaggctgatctgagatttaagagcagatctaaagtcacgcctaccttcggatgatactgaaaagccagagtcctggccaaaaagctggtcaggagggctgtgaggggccaggtgcacagtggggctctgacatgcctccccagtcccttcaggccctgtggtaaggctgaggtctcaggccatcactctgggggtctgaagatgagtcagagccagcctggggccctggcctcccagtgggtgagcaggaaggatttcactgcattgggaacattgtgtttccagatatagactggccacctgcctggccccctggatctctgggtggccgtccctggtgggcagtcaggagccaggccccacggggtgggtctgaggggcctttggatgacttcatctatcctcccccaccaagttagtatttctgtctgttctgtgaagtcctggtaactgaacaagccctttgggttcagattccttctcccactgaaagccgcatattgcagtaaatcctttttggccaagataaatgacagatggcccaggaggaagggcatcaggtgatagagacagagcagctagaagagtcagggagagaagaagatacaaaagaaattgtgcagcactcctttccttccacaaggcttgatgtgcccacactgcctccctgcaggacaggcatgggtgccatgtgtgagggtccacaggccaggccccctcttttagcctcagtttcccagttcacagggtggaggaggaatacgtgtttggaaccagtgacttccgggggccccctccggtggccttaaggtgacatcctcacccacctgggggcctgaggcaagcctgatagcttctacagtcctgcaggcccaaaagctaaccaagcagcagaacctttgcaaatgcagactctcagggcttatcctgcagggccccagtcagtggatctggggtggacccaggggcctttaattttagaaaatttgcagatgggtctgatattcactgtggcatagtatagatcaaggtcagctgtccccattcactgattcttagtcttgggtgcacattagaatcacctggagggctatagggaaaaattccaatgctcaggctacaccccagaccaattatatcgtaacctctgaaggtgaggcccagacagcagtaatgtttaaagttcctcaggtggttgcaataagcactgagactgagaaccattgctatggatgagccaaaaggtggaggcagcgtccaccatccatccttgcccgccctccttctgaaggtgaagctttcacctttggaaaccctgtcatccaccaagacagctaaaagcccgtcctctagcagctgatccctctgatggacaaggcattaaatgacaggttacataatcggggacctagtcctgggaccccggacaaggcacctgccttgcctgaacctcagtttcctcaactgtggaaggagggcatgggtgcctggttttcaaaacgtgctcagagcaggtctagctgtactgggcagtacctcggccaggagcactggactccgggcccccatgcccctggccctggttctcccagagcagctctaatcttagcctgttattgctgaagcctccttgtgctaagacaaacacttcaggagccaaaaacaatttgacaactgttagtctagatgatgtgcactttcatcccagctctgaaggtctacggaaaccccactctcccttctccacatatactcataattcctgtagtctggagccttcatttggcacctacaccccataaatcctgctttgatttgcctggcactgatgtggtcctgtatctggtttatctcccccactaagctgtgagttccttgaaggcaggtcttcattcattttataaacacagcacacatttattgagctccttctgccaccatgctggatgatggggacactgtggtgaatgagactgacacagcccctccctcatggagcaaaaacttcgtggatgagaaagattgagtgaagcaattacaaagttatatgtgctgtaacagggaagcatagggtgctatgggggcacaagggacggcacccaggaagatagagggggcaggaagcttcccagggacagggaaggaggccagccttggctgagggagctgcatctgcagagacctggagggtgagggaggggccaaggccatagacagggagcaggcctttgagccctgcctggtaaggagccagcattttatcctgggcccctgatgacgtaaccgtggggtgacctgaacagtttttcctgcctgtggaatcctcctctttgcctaccccacaccccttctccagcactggtgcaggagttgcatagtagtggctcaggagtcctggatgagagagatgcatctgggggcacagtaggggtgcacaggtgtggacggatgaggaggcaccttcacacgaatgggtgctcccagacaggggtgggtggtgcatgaatgttgaattgcgttgggtggtaggtgggatgtctgtgtttgaagcctgtcctgctccccacctaggttctatgaacaccctagcccaccctgacagcccttttcctggagtccagcccccagcttggcatagttggtgaagacccattgtctgcctatcgccaggcactcagagaaagcctctatcccccttctgtgggttcacgggctctctggggccacgctgcaggtggtggcttgccctgttgcctggccctcagctcaggcccttggagtgcctctctgccctgtctgctgccccggctgctcctcttaccctccctccctctctgcccgcttccggcccagtttctcagctacctcagtgcctgtgaccgcctgttacgtcagggatatgaggaaggcctggtggatgaggccatggagatgttccagttctccgagagccaggtcagcagggcttcctgccagggccccaggggatggaagggatgggggtgtacccaggagcccggtgtgcagggccacaccagtcctcagagccagtctgngggtccagcctgtgggtctgtcgggagattgcctgactcctcagctctgaggaggagatggcccagggagctacagcagggacaaaggtgagaggcacagagggagatcaggaagaggtgggacggggacaggaggcagagagcagcaggggttttgctttattagacttaatcaacacagcctctgtgactgaatggccactctttgtcggacactcagataggagccatgggcagcacaaagatgcatgacctttctacttggggagcgtgccgcctaccccaagtgcatgcagctgtaggcccaatagtcacatcttgttttctgagactgagtctcactctattgcccaggctggagtgcaatggcacgatcttggctcactgcaacctctgcccccgaggttcaagcaattctcccgcctcggtctcccaagtagctgggattacaggcgcctgccaccacaccctgctaattttttttgtattttcagtagagacggagtttcaccatgttgaccaggctggtctcgaatgcctgatctcangtgatccgcccgcctcggcctcccaaagtgctgggattacaggcgtgagccaccgcacccggccccagtagtcacttctaagtgccccatggcagagcagctcttcacagaggctgaaggggacggagggttgggtgaggcctcgagaaggagagagtgagcagaggtggggaagtttcaagccctggggtcggaggggaaggaaagtgcaggctgcgctgtgatacctccacagtgttcagggcacgggcagggaccttgggctgtttgtgctccaggtgcaggtgtacggtctgcccccctcctgccccagcagaaagttgacagtgagtgggaggagtgggaggagagtcaggacagagcccatggccaggctggggccttctttccttggcagaggaagggaggtcggaacctacatcaccctacaggtacagaaaagtggcaggtgcggcccaggatcaggctcacgtggcctgggggtagccacagctttttgggactaggtgcagtaggcactggagctggggctccccatggctgaggccaggcccagcagagcccccagcaccctccctgtctcctcttcctcaggcaggggagttcctgcgcctctgggagcagttcagtgacatgggcttccagcaggaccggatcaaggaggtgctgctggtccatggcaaccgccgagagcaagccctggaggagctggtggcctgtgcccagtgaccacggaggcactccacgatgcctgggcatctaggcccaatgccagacctggcaacccatcctaactgtattattaaaaccaagtaagagtaaaaaa

SEQ ID NO: 76369 - DNA, 694 bp, Homo sapiens
tctcccttcgctctcacttctctcacctatcagtctcttagtctcgcctcctcattttcccactaccctccccatctctcccacctctcattgtcttctgctcacacacttcttcatccgccgcgtctctcactcctcctcactcgtgctatccctctgtcacgctctgttccccgcacagctcatctcagtactctccccctgctcgcttctctcttctcgccgatcttcttctcagtcacccagtactctccatttcctacctcctcacgcttctctccttttctcgttactccaatcctacacgagcgtcaccctctcagacccttgttaggttccaccctaccccaccccatccagctccatcttggaattagaaagatgcttcatggctcagagctggtgtcatcgctttttccagccacacccaactccccatccctatcctacttccagtcacccactaggaccttcctgcaagagggcaagcagttcagtgacatgggcttccagcaggaccggatcaaggaggtgctgctggtccatggcaaccgccgagagcaagccctggaggagctggtggcctgtgcccagtgaccacggaggcactccacgatgcctgggcatctaggcccaatgccagacctggcaacccatcctaactgtattattaaaaccaagtaagagtaaaaaa

SEQ ID NO: 76370 - DNA, 452 bp, Homo sapiens
ggagtctcactctgtctcccaagctggagtgcagtggcgcgatctcggctcactgcaagctccacctcctgggttcacaccattctcctgccttagcctcccaagtagctgggactacaggcgcctgccaccatatccagctaattttttgtatttttagtagagacggggtttcaccatgttagccaggctggtctcgatctcctgacctcgtgatgcaaagtgctgggattacaggcatgagccactgtgcccagccttattgcccctctcttaaggctgtgaagggcagtaagtgcttctaatgagctcagactggggcctggcacatagtaagcattcagtaaatgctcaatatgttttaactggcaatcatttcttccccactaaaccaagaactctcggtccatcttagaatcccgggcacagagagggcaccagtgtagacatgc

SEQ ID NO: 76371 - DNA, 418 bp, Homo sapiens
tattaaaatgagcacataatttaacatttaaaaaaaaattactactttttagctctattccctgaaaaagcctaaaagtattgactaacccagtggcagtgcattcctagggcctagattattttgtctgtaaataccattccctactaaaaacaaccagggatccaaccagaagtgggtagatctcaggatgtagcatgtagtattacaagagcttgtaatatcctatcctgttttaatagaaaagaagttatcaaacattattagggtcatgtcaaaaaggactcaggagacaacttgaataggcttcactggccaaaaaatgggtaaatttgagcatcaataaggataacaataaggacaaaacaacatatatatttacatctgtgagttcataatgataccaaaaaagataaaa

SEQ ID NO: 76372 - DNA, 713 bp, Homo sapiens
gggggtagatgagagtggggacttggatctgcctgccaggccgtcctgggcgctgcaggaagcaacatgacttaggtaactgcccagaggtgcaccagacatgatgcagcagccgcgagtggagacagataccatcggggctggcgaggggccacagcaggcagtgccctggtcagcctgggtcacgaggcatggctgggtgcgctggtgggtgagccacatgcccccgagctggatccagtggtggagcacctcgaactggcggcaaccgctgcagcgcctgctgtggggtctggaggggatactctacctgctgctggcactgatgttgtgccatgcactcttcaccactggctcccacctgctgagctccttgtggcctgtcgtggccgcggtgtggcgccacctgctaccggctctcctgctgctggtgctcagtgctctgcctgccctcctcttcacggcctccttcctgctgctcttctccacactgctgagccttgtgggcctcctcacctccatgactcacccaggcgacactcaggatttggatcaatagaagggcaaccccatcccactgcctgtgtctgttgagccctggcctagggcctgagaccccacggggagagggagggcaatgggatcagggctccctgccttggcagggcccagacccctagtccctaacaggtagactggcctgaccccggact

SEQ ID NO: 76373 - DNA, 738 bp, Homo sapiens
agcggaggaggtgaggagggtttgctgggtgggtatgggggagggggagactctgcaggagcctaattccccactctgagctcacccttctgtctgcccgggccctaccccttcccctactctcacccttataatccttttcagcactaggtcttcccgtcacctccacctctctccatgacccggctctgcttacccagacccgaagcacgtgaggatccgatcccagttcctccaaggggcctgggtgctggggaggggtcaggtagtccagtgcgtccacctgtatccacctggggccctagctgggcccagctcctggacagtgtcctatggctgggggcactaggactgacaatccaggcagtcttttccaccactggcccagccctgctgctgcttctggtcagcttcctcacctttgacctgctccataggcccgcaggtcacactctgccacagcgcaaacttctcaccaggggccagagtcagggggccggtgaaggtcctggacagcaggaggctctactcctgcaaatgggtacagtctcaggacaacttagcctccaggacgcactgctgctgctgctcatggggctgggcccgctcctgagagcctgtggcatgcccttgaccctgcttggcctggctttctgcctccatccttgggcctgagagcccctccccacaactcagtgtccttcaaatatacaatgaccacccttcttcatcaggccc

SEQ ID NO: 76374 - DNA, 1165 bp, Homo sapiens
agcggaggaggtgaggagggtttgctgggtgggtatgggggagggggagactctgcaggagcctaattccccactctgagctcacccttctgtctgcccgggccctaccccttcccctactctcacccttataatccttttcagcactaggtcttcccgtcacctccacctctctccatgacccggctctgcttacccagacccgaagcacgtgaggatccgatcccagttcctccaaggggcctgggtgctggggaggggtcaggtagtccagtgcgtccacctgtatccacctggggccctagctgggcccagctcctggacagtgtcctatggctgggggcactaggactgacaatccaggcagtcttttccaccactggcccagccctgctgctgcttctggtcagcttcctcacctttgacctgctccataggcccgcaggtcacactctgccacagcgcaaacttctcaccaggggccagagtcagggggccggtgaaggtcctggacagcaggaggctctactcctgcaaatgggtgcaccagacatgatgcagcagccgcgagtggagacagataccatcggggctggcgaggggccacagcaggcagtgccctggtcagcctgggtcacgaggcatggctgggtgcgctggtgggtgagccacatgcccccgagctggatccagtggtggagcacctcgaactggcggcaaccgctgcagcgcctgctgtggggtctggaggggatactctacctgctgctggcactgatgttgtgccatgcactcttcaccactggctcccacctgctgagctccttgtggcctgtcgtggccgcggtgtggcgccacctgctaccggctctcctgctgctggtgctcagtgctctgcctgccctcctcttcacggcctccttcctgctgctcttctccacactgctgagccttgtgggcctcctcacctccatgactcacccaggcgacactcaggatttggatcaatagaagggcaaccccatcccactgcctgtgtctgttgagccctggcctagggcctgagaccccacggggagagggagggcaatgggatcagggctccctgccttggcagggcccagacccctagtccctaacaggtagactggcctgaccccggact

SEQ ID NO: 76375 - DNA, 389 bp, Homo sapiens
ctgctataaagaaatatccaagactgggtagtttataaagaaagagggttaattggcccatggttctgcaggctgtacaggaagcatggcagaacctgcttcttggcagaaggcaaagggggagccagcactttacatggtggaagcaggaggaagagagaagagagggggtagaggtgccacacacctttaaatgaccagctctcaagaactcactcactctcagaagagcattaagggggaaatccaccattgtcatccagtcccctcccaccaggcccaccgccagcattggggattaaatttcagcatgagatttgggtggggacacagatccaaaacatatcacatataactcaggagtagctatgaagactgctagccagccg

SEQ ID NO: 76376 - DNA, 278 bp, Homo sapiens
gggttttggttgaggtttctacctcattatccaagatatttgcttttcagccagcagaaagaaaaaggagaagagctgccaccctttgtatccaggatgatctcttcttgaaatccttgatttaattatatctgcatgaccctttccccaactaaggttatatccacagttaccgggggttagcactgggacatcccttattttaagaacatgtctcagaaagttgcacaaaaaacttctactacatcccattggccaatgattcttacatgatgaca

SEQ ID NO: 76377 - DNA, 871 bp, Homo sapiens
gggctcttcctcgcggaagtggggaggaggcggttgcggttagtggaccgggaccggtaggggtgctgttgccatcatggctgaccccgacccccggtaccctcgctcctcgatcgaggacgacttcaactatggcagcagcgtggcctccgccaccgtgcacatccgaatgggttctcttaactacagtgacttcaacagtttttttatactttgagtctgtacggacatttgtacatgagagtcctgccttaattttgctgtttgccctcggatctctgggtttgatttttgcgttgactttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggctgtttgctcttttgtggatattgtgcctgtcaggattcttgaagttttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaaatttaacgagaaaaaaggattaaagtaattggaagcagtatatagaaactgtttcattaagtaataaagtttgaaac

SEQ ID NO: 76378 - DNA, 482 bp, Homo sapiens
gacttgccttgcctttttctgcttttaacatttgtattcaaagttgtacaccattgtcaaatgtataatgtagcagtaaatcattagaggaagtaagttaagtcctgttaatactgttctcaaatataaacatatttctttaatctcttccctatagttttttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaaatttaacgagaaaaaaggattaaagtaattggaagcagtatatagaaactgtttcattaagtaataaagtttgaaac

SEQ ID NO: 76379 - DNA, 1800 bp, Homo sapiens
atgtggtcgagtgtaggctcccacgttggaccgggaccggtaggggtgctgttgccatcatggctgaccccgacccccggtaccctcgctcctcgatcgaggacgacttcaactatggcagcagcgtggcctccgccaccgtgcacatccgaatggcctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgactttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggctgtttgctcttttgtggatattgtgcctgtcaggattcttgaagttttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaaatttaacgagaaaaaaggattaaagtaattggaagcagtatatagaaactgtttcattaagtaataaagtttgaaacaatgattaaatactgttacaatctttatttgtatcatatgtaattttgagagctttaaaatcttactattctttatgatacctcatttctaaatccttgatttaggatctcagttaagagctatcaaaattctattaaaaatgcttttctggctgggcacagtggctcacgcctgtaatcccaccactttgggagaccgaggcaggtggatcacgaggtcaagaggttgagaccatcctggccaacatggtgaaaccccgtctctactaaaaatacaaaaattagctggatgtggtggcacacacctgtagtcccagctagtcaagaggctgaggccagagaatcgcttgaacctgggaggtggaggttgcattgagccaagatcacgccactgcattccagcctggtgacagagcgagactcagtctcaaaaaaaaaaaaaaaatttttcttcctaaattagccacgcatagcggttcgtttgcaattcaaaaataattttatgagtagataagaatatcagtttaccgttgtctagtgattttatctaaattttccctgaattattaagtaatattgatttggctttgattctgaagtagtagagtctttaccattataaactgtaaatctctttttgcttaaaaggaaaaaaatgtaaaagataaattccacagagaattattcagtattacattaaaatgttaatgactttttattttaaattgtactaacattaaaagttggcctgaaagtcagatattatgacaaaatttgacattaattgtttttaaagtatagatttcatttgaaattatagaatgctaatgtggttagaggacaccaaagatactgggtcatcagccattaagtatatctatttcaaaattaaaatatttgggaagtat

SEQ ID NO: 76380 - DNA, 2290 bp, Homo sapiens
atgtggtcgagtgtaggctcccacgttggaccgggaccggtaggggtgctgttgccatcatggctgaccccgacccccggtaccctcgctcctcgatcgaggacgacttcaactatggcagcagcgtggcctccgccaccgtgcacatccgaatggcctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgactttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggctgtttgctcttttgtggatattgtgcctgtcaggattcttgaagttttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaaatttaacgagaaaaaaggattaaagtaattggaagcagtatatagaaactgtttcattaagtaataaagtttgaaacaatgattaaatactgttacaatctttatttgtatcatatgtaattttgagagctttaaaatcttactattctttatgatacctcatttctaaatccttgatttaggatctcagttaagagctatcaaaattctattaaaaatgcttttctggctgggcacagtggctcacgcctgtaatcccaccactttgggagaccgaggcaggtggatcacgaggtcaagaggttgagaccatcctggccaacatggtgaaaccccgtctctactaaaaatacaaaaattagctggatgtggtggcacacacctgtagtcccagctagtcaagaggctgaggccagagaatcgcttgaacctgggaggtggaggttgcattgagccaagatcacgccactgcattccagcctggtgacagagcgagactcagtctcaaaaaaaaaaaaaaaatttttcttcctaaattagccacgcatagcggttcgtttgcaattcaaaaataattttatgagtagataagaatatcagtttaccgttgtctagtgattttatctaaattttccctgaattattaagtaatattgatttggctttgattctgaagtagtagagtctttaccattataaactgtaaatctctttttgcttaaaaggaaaaaaatgtaaaagataaattccacagagaattattcagtattacattaaaatgttaatgactttttattttaaattgtactaacattaaaagttggcctgaaagtcagatattatgacaaaatttgacattaattgtttttaaagtatagatttcatttgaaattatagaatgctaatgtggttagaggacaccaaagatactgggtcatcagccattaagtatatctatttcaaaattaaaatatttgggaagtattgtcttatggtttcatttgtgttggtccacacagcatgttaggtcagtgtaccagtaaccaatgaaattttgtcaaattccctcactgtactagtttgttaggctgccataacaaagttctacagcttgggtggcttcaacaagaaatttgttttcccacagttctggaggctaaaagtccaagatcaaggtgttagcagggttggtttcctttgaggcctttctctttgatttgtagatggccatcttctccctgtgtctttaaatggccttccctctgtacttgtctgtgcccaaatttcttcttcttatgaggacaccagtcatactggattagggcccacactgaggacctcatttttccttaattatctctttcaaaacctatctccaaatacagtcacattctgaagtgctgggattaggatttcttcatgtgaattttggggggactacaactcagcccataacaccccctaagtatttccca

SEQ ID NO: 76381 - DNA, 892 bp, Homo sapiens
atgtggtcgagtgtaggctcccacgttggaccgggaccggtaggggtgctgttgccatcatggctgaccccgacccccggtaccctcgctcctcgatcgaggacgacttcaactatggcagcagcgtggcctccgccaccgtgcacatccgaatggcctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgactttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggctgtttgctcttttgtggatattgtgcctgtcaggattcttgaagttttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaaatttaacgagaaaaaaggattaaagtaattggaagcagtatatagaaactgtttcattaagtaataaagtttgaaac

SEQ ID NO: 76382 - DNA, 1445 bp, Homo sapiens
agatccaagatgggcattatattcattgtatgtttacaaattcttacattttagttattcttcagcaaaaaatccagatggatgtttttttcagaaagtgttgaatgggtttacaaagtttttttgtaaggaacaatattgcaaattactaaaattgtatttttataggctgtttgctcttttgtggatattgtgcctgtcaggattcttgaagttttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaaatttaacgagaaaaaaggattaaagtaattggaagcagtatatagaaactgtttcattaagtaataaagtttgaaacaatgattaaatactgttacaatctttatttgtatcatatgtaattttgagagctttaaaatcttactattctttatgatacctcatttctaaatccttgatttaggatctcagttaagagctatcaaaattctattaaaaatgcttttctggctgggcacagtggctcacgcctgtaatcccaccactttgggagaccgaggcaggtggatcacgaggtcaagaggttgagaccatcctggccaacatggtgaaaccccgtctctactaaaaatacaaaaattagctggatgtggtggcacacacctgtagtcccagctagtcaagaggctgaggccagagaatcgcttgaacctgggaggtggaggttgcattgagccaagatcacgccactgcattccagcctggtgacagagcgagactcagtctcaaaaaaaaaaaaaaaatttttcttcctaaattagccacgcatagcggttcgtttgcaattcaaaaataattttatgagtagataagaatatcagtttaccgttgtctagtgattttatctaaattttccctgaattattaagtaatattgatttggctttgattctgaagtagtagagtctttaccattataaactgtaaatctctttttgcttaaaaggaaaaaaatgtaaaagataaattccacagagaattattcagtattacattaaaatgttaatgactttttattttaaattgtactaacattaaaagttggcctgaaagtcagatattatgacaaaatttgacattaattgtttttaaagtatagatttcatttgaaattatagaatgctaatgtggttagaggacaccaaagatactgggtcatcagccattaagtatatctatttcaaaattaaaatatttgggaagtat

SEQ ID NO: 76383 - DNA, 1407 bp, Homo sapiens
agtcgtacctacttttgggatttacgctgttggaatgctctgactgtggcagttgttgttactttctatgatgtatatattattctgcaagctttcatactgactactacagtattttttggtttgactgtgtatactctacaatctaagaaggatttcagcaaatttggagcaggttttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaaatttaacgagaaaaaaggattaaagtaattggaagcagtatatagaaactgtttcattaagtaataaagtttgaaacaatgattaaatactgttacaatctttatttgtatcatatgtaattttgagagctttaaaatcttactattctttatgatacctcatttctaaatccttgatttaggatctcagttaagagctatcaaaattctattaaaaatgcttttctggctgggcacagtggctcacgcctgtaatcccaccactttgggagaccgaggcaggtggatcacgaggtcaagaggttgagaccatcctggccaacatggtgaaaccccgtctctactaaaaatacaaaaattagctggatgtggtggcacacacctgtagtcccagctagtcaagaggctgaggccagagaatcgcttgaacctgggaggtggaggttgcattgagccaagatcacgccactgcattccagcctggtgacagagcgagactcagtctcaaaaaaaaaaaaaaaatttttcttcctaaattagccacgcatagcggttcgtttgcaattcaaaaataattttatgagtagataagaatatcagtttaccgttgtctagtgattttatctaaattttccctgaattattaagtaatattgatttggctttgattctgaagtagtagagtctttaccattataaactgtaaatctctttttgcttaaaaggaaaaaaatgtaaaagataaattccacagagaattattcagtattacattaaaatgttaatgactttttattttaaattgtactaacattaaaagttggcctgaaagtcagatattatgacaaaatttgacattaattgtttttaaagtatagatttcatttgaaattatagaatgctaatgtggttagaggacaccaaagatactgggtcatcagccattaagtatatctatttcaaaattaaaatatttgggaagtat

SEQ ID NO: 76384 - DNA, 1285 bp, Homo sapiens
ataaataaaaagataagcgtctcaggaggatcgtgaaaggaaaagtgacatctgttttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaaatttaacgagaaaaaaggattaaagtaattggaagcagtatatagaaactgtttcattaagtaataaagtttgaaacaatgattaaatactgttacaatctttatttgtatcatatgtaattttgagagctttaaaatcttactattctttatgatacctcatttctaaatccttgatttaggatctcagttaagagctatcaaaattctattaaaaatgcttttctggctgggcacagtggctcacgcctgtaatcccaccactttgggagaccgaggcaggtggatcacgaggtcaagaggttgagaccatcctggccaacatggtgaaaccccgtctctactaaaaatacaaaaattagctggatgtggtggcacacacctgtagtcccagctagtcaagaggctgaggccagagaatcgcttgaacctgggaggtggaggttgcattgagccaagatcacgccactgcattccagcctggtgacagagcgagactcagtctcaaaaaaaaaaaaaaaatttttcttcctaaattagccacgcatagcggttcgtttgcaattcaaaaataattttatgagtagataagaatatcagtttaccgttgtctagtgattttatctaaattttccctgaattattaagtaatattgatttggctttgattctgaagtagtagagtctttaccattataaactgtaaatctctttttgcttaaaaggaaaaaaatgtaaaagataaattccacagagaattattcagtattacattaaaatgttaatgactttttattttaaattgtactaacattaaaagttggcctgaaagtcagatattatgacaaaatttgacattaattgtttttaaagtatagatttcatttgaaattatagaatgctaatgtggttagaggacaccaaagatactgggtcatcagccattaagtatatctatttcaaaattaaaatatttgggaagtat

SEQ ID NO: 76385 - DNA, 732 bp, Homo sapiens
tcaactatggcagcagcgtggcctccgccaccgtgcacatccgaatgggtacgttgtcccctctccagtgcctcccagccgcttgtctgcactgctcggcctctagaagccgacttccggcttccgagggagagcggccatctcctgggactcacagggagtgctcactgagctcccggccctccttctccgggtaccagaggactggcgccctcctcagggagtcggggaggcgcttcctcccctcctagcgggtgtgggagggcgccaggcccagaaggcttgcggctgtcctgtgtgcgccccggctccccagcgggcgccgcggtgtaggaagggacagatggaaaccgccgcagcctgaatttggcatcttgaagtgaaaagaaacgtcgtggaaatgagtcggttgatcactgtgactgacgtacacacgagtggaatccacggcctgatgtttttgttctgtggggtttcgcgttacaggcttatatttaccgtcctgtgctaggctggaagctccctgacggcactatttcctctccgcagggcccagaatgcaacaggtctttgaggattattgaggaagttgctcaacacagaagcttcctaagtcagtctaaattgtgttttaagttattacgtagtagccaatgggcagaaatttttgaatttaaaatgctcagcttcatctacgtggaagccattgcctgctctagtttggtcatttga

SEQ ID NO: 76386 - DNA, 537 bp, Homo sapiens
agatccaagatgggcattatattcattgtatgtttacaaattcttacattttagttattcttcagcaaaaaatccagatggatgtttttttcagaaagtgttgaatgggtttacaaagtttttttgtaaggaacaatattgcaaattactaaaattgtatttttataggctgtttgctcttttgtggatattgtgcctgtcaggattcttgaagttttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaaatttaacgagaaaaaaggattaaagtaattggaagcagtatatagaaactgtttcattaagtaataaagtttgaaac

SEQ ID NO: 76387 - DNA, 1941 bp, Homo sapiens
atgtggtcgagtgtaggctcccacgttggaccgggaccggtaggggtgctgttgccatcatggctgaccccgacccccggtaccctcgctcctcgatcgaggacgacttcaactatggcagcagcgtggcctccgccaccgtgcacatccgaatggttctccagagagattgtaccttcagcaaacaatatatgaggataccttctgcaccctcagccacactgaatatcatcagattttttcatctccggcaatctggtagatcagggatggtgaacattttctacaaagggccaacctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgactttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggctgtttgctcttttgtggatattgtgcctgtcaggattcttgaagttttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaaatttaacgagaaaaaaggattaaagtaattggaagcagtatatagaaactgtttcattaagtaataaagtttgaaacaatgattaaatactgttacaatctttatttgtatcatatgtaattttgagagctttaaaatcttactattctttatgatacctcatttctaaatccttgatttaggatctcagttaagagctatcaaaattctattaaaaatgcttttctggctgggcacagtggctcacgcctgtaatcccaccactttgggagaccgaggcaggtggatcacgaggtcaagaggttgagaccatcctggccaacatggtgaaaccccgtctctactaaaaatacaaaaattagctggatgtggtggcacacacctgtagtcccagctagtcaagaggctgaggccagagaatcgcttgaacctgggaggtggaggttgcattgagccaagatcacgccactgcattccagcctggtgacagagcgagactcagtctcaaaaaaaaaaaaaaaatttttcttcctaaattagccacgcatagcggttcgtttgcaattcaaaaataattttatgagtagataagaatatcagtttaccgttgtctagtgattttatctaaattttccctgaattattaagtaatattgatttggctttgattctgaagtagtagagtctttaccattataaactgtaaatctctttttgcttaaaaggaaaaaaatgtaaaagataaattccacagagaattattcagtattacattaaaatgttaatgactttttattttaaattgtactaacattaaaagttggcctgaaagtcagatattatgacaaaatttgacattaattgtttttaaagtatagatttcatttgaaattatagaatgctaatgtggttagaggacaccaaagatactgggtcatcagccattaagtatatctatttcaaaattaaaatatttgggaagtat

SEQ ID NO: 76388 - DNA, 982 bp, Homo sapiens
  misc_feature (895)..(896): n is a, c, g, or t
atgtggtcgagtgtaggctcccacgttggaccgggaccggtaggggtgctgttgccatcatggctgaccccgacccccggtaccctcgctcctcgatcgaggacgacttcaactatggcagcagcgtggcctccgccaccgtgcacatccgaatggcctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgactttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggctgtttgctcttttgtggatattgtgcctgtcaggattcttgaagttttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaaatttaacgagaaaaaaggattaaagtaattggaagcagtatatagaaactgtttcattaagtaataaagtttgaaacgannaacaaaaaaaaaaattgtgctcattggctcaacagccgaacctctcgggcgcttccctttactggaggtcatattatgatccttcg

SEQ ID NO: 76389 - DNA, 638 bp, Homo sapiens
cttgcgctcaacctctcagaaggctcaggggatgccccaaagtggcaaaacaattggagaatgagactcacctgccaagaggaaagacactgaattgattcacccctgaggagagcaggttaaggtgtggtagtttagttctgtaggaaaatcataggcagagctcgaggccaacgcttctctgcctctgttggggaaagaacaagaggaaatgggtttgaagaacaacatgtaggaccaaaaataaacgcaaagaactgccgatcatccgtgttgttaagtcctggaacgctgaaagcagtgcagagtccttcgttaaaagaaaaacaaaaaccaaacctcaggtataatcttgcctagacgcaaaccaaaaaaagatctaggacaatctctctaagatctatgttatcagcagttgcctctgggtaaagggattattggtggtaacaataactgaattattttcactatgtattaattaaatatataatttattattaatgatcaataattattgctgttttctgaatttttaaattttctgtggtgtccctttttataatgagaatcttcatttttaggaatctcttctagtcttctgtgacttaaaaatttatgattcaatttttaataaagtc

SEQ ID NO: 76390 - DNA, 530 bp, Homo sapiens
tttcattttgaaaccattgtccctcccccaaccacttccatggaaaaattgtcttccatgaaactggtccctggtgccaaaaagttggggatttctgtcttacagatcctttttttgttgatagagtttaatgactattttctttaaagtgagcatatcatttgcatgaagataactattgtctttgagttatgctttgacaagagacaaaagagtagacactattgcaggactagagcacaagaacttcagagaacagaatgactagactattaagacaaagtatgctttcaataactgaattagacttgcccctgagtatttcatgttctgggatgctattataatggtattttaagcatttccatttctacttgcttattgctcatatatagacataccattaattgtataatgtatcctgtgacagtgctaaatcaatagctctagtagcttttttctacgttatttaggattttctatgtgcatgatcatattatctgtgaataaagatacttttactttttctt

SEQ ID NO: 76391 - DNA, 363 bp, Homo sapiens
tccaagctttgtgagttgcaaaagtgttctagtgttgtggcatgctttgtgaacaatgtggaaaggctttccattcattgggcctgttaattttagcaaccaggtaaaacaaaacgagtaatggccttaacagaaaagtaataccagtgttcttattaagatgaccttaaatctagagagttatagaacttggttaagtctatgtgctcgtaccccttacttataactcaagggaaattggagcaaaaatttgtgaattactgtttgctccaaaagttcataggcagtgctactgataaatcaaaactacagataggttttcctctcctcaaaggatggaagcaatgataatatgttaatatt

SEQ ID NO: 76392 - DNA, 584 bp, Homo sapiens
cagtgctggctcttattcatctcccatttctgcaatccatggtgatgattaaaagtcttaggagttttacgaggctcagtattttttttttttaatatgctagttcttcatgaatacattgggtactctgaagcatatcatttcctgggtttcctgaagtggtatgttgcgtggaatggcacattaggtctaaataattatcccctatgtaaggttcttgtttttcattcattctcttaaaaaatagatattaaacattaaataaggacagccaggtattgtttgaggtgttagtgggctatgctaaaaaatcaaaggtgggaatgaggcagctggagctcaaaggagcatgttagaaggagtcccaagaggacaaatccatttggttcttctttccttgttttttttcgaatatttttgaggatgataatttttttcccctcaaaagcttttaatgaatgttaggattaaaaaagagagagagagaatttatagaagagaaattaactatagctcctaaaatagctctttgtttctgaaagccttgattctgctatctattttataactgaaacaaaaacaaa

SEQ ID NO: 76393 - DNA, 752 bp, Homo sapiens
catagttaacacaattaactgtaattccttaagatcatctgatatccagtctatgttcagttttctccagtccagttttctccggtggtgtcaagcacttttttttcccattaagtttgttaggatctaaatgaagatcacgcattgcatttgtggtatcttttactccttaactgtatcttccctccttttttttaataccataaatttgttggagaaactgggtcatttttcctattggatgtatcacacattctggatttggctgattgtttccttggggtatcatttaacttgttatttttctcttatttcttgtaaagtggtagttaggtgtaaagtcttgatttaggtttagttttcaggaaagaatactttggggtactgagtacttcctgtaacattccagcatgacatacataatgactgcaagtctcactttagatgatgccaatttaagtactataaaattcctcaccaacttttaggtaatagttgaatatccacgtttaagttgtctagataaagtatttcattaggggttgcaaaatggtgatttttttttgagttattccctctgtatttattagctggaattctttaagtctttttaatatggccttattaatcttttttttttttttttgagatgggacagagttttgctcttgtcacccaggctggaggttgcagtgggctgagatcgtgccattgctctccagcttgggcaacaagagtgaaactccttagca

SEQ ID NO: 76394 - DNA, 648 bp, Homo sapiens
tttcttaataaggtgtttaattacaggttcaattacatatatatgaatattcattttggtaacctgtgtttgctgaatcaatttgttcattttatctaaaatttcaaagttgttctattattcatttatctttttaatacttataaggtgtgcggttagaatttgtgccttttgtctgttttgttaatcaatcttgctgggggccatcaattttatcagtgtttcaaaaaagcaaactttgattttattcatccctttaccatactgaaaatgttttgcttaatttccaaacttatacttccactgtgattaaatatttgtataactaaaactctttggaatttgtgtcttctcaatgatcaaaaatatgattaatttttataaatattgcttctgcacttgaaaaggatgtgtattctgcatgttgagcgtagtgtatcacgtatctcaattagatggagcgtgttaaatgcatcctttaaagattccatttccttactgatgtttgtctgtttatttttcagtggctgagacacagatattaaagtttcccacaatgatcgtcaacttatttctttttttcgtttgttaagctttgttctgtgtgttttaaggttaagttaccaggcataaacacatttagaattc

SEQ ID NO: 76395 - DNA, 263 bp, Homo sapiens
catgcagcctagtatttcattaaaaggctatgatatatccaaatttatcttaaaaagagtctcctcagtggatattcagttgtttatattttctttgccattagaaaaacagaagtacacagagatggtatttaatatcgattttcaaggacagattcatggggccagggagaacagcagaacatatgggcaggaggagaatttcaaaggaatagaagggtaaaatgcatgaaatcagagcatgttgcactcagcatggatgg

SEQ ID NO: 76396 - DNA, 287 bp, Homo sapiens
tggcgcatgcctgtaatctaggctactgtggaggctgaggcaggagaattgcctgaacctggaagatgaagattacagtgatgagactgcaccactgcactccagcctgggtcacaagagccaagagcgagaatccatctaaaaaaaaaaaaaagaatttctatttgggggacaaaataaaagaaatggagtgaaagggatgtaaagaaattgaaagtcaacaggctaataatgccaataaataatgatggagcaaagaaatcagtattggccaaataaaaccaatg

SEQ ID NO: 76397 - DNA, 520 bp, Homo sapiens
  misc_feature (18)..(18): n is a, c, g, or t
  misc_feature (41)..(41): n is a, c, g, or t
  misc_feature (64)..(64): n is a, c, g, or t
  misc_feature (98)..(98): n is a, c, g, or t
  misc_feature (126)..(126): n is a, c, g, or t
gagaccggacataaaacngggacaaatggggaaaccccccnactggaaagccaccaaaacaaanccctacaaacctcatcccggaagaccccccttantccctggccccctccccccagagagccncctgtgtttaagtccatggcctcacctgcacctcacaagagaaaaaggagtaaagtgggccatatttgccagggtgttggatgggttaacaagagcatttttacctttttccctcccatgtttggttcctgcagcatttcccattgatgcatgctattgtagacttccttaggttgaccttggccttgacctccacccactagctcatgacccaaaactgaagatgtgcatcagaaagggacagatttggtctttctgctgtaaaagatattctgccttagtgcctgctaatttgttgtgcatagtcctgtgctgccaatcttccccaccaattgttaaggttaatgtgtgttttatatgtgtattcacaaacattaaaatgtaatcagtggat

SEQ ID NO: 76398 - DNA, 564 bp, Homo sapiens
tttagtagagatggggttttaccatgttggtcaggctggtcttgaactcctgacctcaagtgatccacctgccttggcctcccaacatgctgtgattacaggcatgagccactgcagctggctttgtttaattgggtttttcttattaagttttgagagtttaaaaaaatatatattctggatatgtcattaatcagatatataatttgtaaatatcttctcccttagtatatattttaatattccactggcaaaatggaagtttgcgtgaagcatttttgtgatgtattgttaaataaaatggttgtctctaggaaaagcacttatgtgattgagttgtgagttgaaatagctgttttccccccgccccgagcaaaatctcatttttactggagagaatgacaaactggtttctcagacttgcaggctttctcaaatctcaaatttatctaaaaaattctcgagatattttctcacaaatgagtgaggtgaacctgtcacttcatggaaaataaatgacagtatttttaccagtgataaaattagagccttttgtttaaaaaa

SEQ ID NO: 76399 - DNA, 527 bp, Homo sapiens
tttattgctgcagtattattttcctgctacttgttcatttcaaatatgtaatgtttctgctgcattgtgggttaaatgactttcatgtgctgattttccaaccccggcaccatccatgatatcattttctgtggagacatgtattttaagttgcaatctgcctcaaaatccttttggaatttagcacatttgtaggttgtggattctccactgagattaggaaaactgtcatgtgctaatttaaattattcattcagcaagaatttattgagtaataacatttgtcagaatcaactttaggctctgaggataaggcatggagttaattaggcccctgccttcaaggtgtttacaatctaatgcataaattttgctaaatattggcatgtttctctttctgcctctccaatactgccccttgtgaaaacaaattctatttatgatcttaatcgcatggaaatagttattatgagaataacaaattagctttaatctttctgagaatcacctcataaatataagaaata

SEQ ID NO: 76400 - DNA, 333 bp, Homo sapiens
tccttccagcttaggtagattaactatttataaggcccatggggaaaaggaaacaaaggaccagcataaaggaaatgcttttttattgcctaccttctacagctggagaactgccacaactttgtggcagtacccttcctcagtgccatgggtactggaatcccactgcatgattcatgagtctaggcacgtggatgggctcatggatgagcatggtctaggcacatggatggcctgtggtcatactgcctgagccctagaaaaactgaagttggcaggatttatattcaagatctgtttcccctatagatgtcttcgtcctctgttcctgtg

SEQ ID NO: 76401 - DNA, 308 bp, Homo sapiens
tcctccactgtcctagaatgttggcttctcttgggctgtcttctccttgacattcacaggcacagcagccatctgtgcagcccattggtcccctaacgggggtcctcaagccaatttcagaacaacccttctgactgttgaccagacactcccctggagggcccacaggcacctcaaatccgccatgacataagcacacacggagctcatggcctgccccacacctcagtgtgcatgggatatcccgccttagcccatggcattcccatccagaagctaaatcgtggtaaaatacacataacagcaaa

SEQ ID NO: 76402 - DNA, 279 bp, Homo sapiens
aaaggagtatgctactttgtgctcattggtctttcctacaagagatctgcctgcattcctcaggacggtgagcaacagctactcctagaaatggccgtgtgccggtctgctctaaagagggagtgctgggggaagatgcggacacactgacacaccctggcagacctaggatctatagtcaccagctactgctgctgccagctcgcttcctgcaccacgtcctcatggaagggaggtctggagcacagtaaatccatcacagacagaaaggcacgaggg

SEQ ID NO: 76403 - DNA, 568 bp, Homo sapiens
cgtgagtgagatgattaaagcgttccagagagtgcgctcttggatgatagccgttactttttattaaccctggctttggtggtaagggaaacttccagaaatgcttgtgggtatattggatagctcagaaaatctgggaaatcaaagtggctcaatagctgtgaggaactgtgggtgactttatcctcacatcgtgtttcttccagaaattcagacgcaacagaggttaggccagtttggtgggttccagtgagcggtgtgttgagcctagtagagcataggtacttggggttgccaaaaccccagcaagttgaggcttcacgctcagggaaacttctgggtcagaggttaataaccacgctccttggagcaaggaggaggggagcctttctgactagctgaagtaattgcaggtttctaactgggcctaaggtgagctgagggcttgagcccctcagcccagcgggggtcccttttcatcccttctctgacagattgctttgtaaactttcttaggccttccccccacccctttgccccagtgctttaagcccttctttgtcttctt

SEQ ID NO: 76404 - DNA, 195 bp, Homo sapiens
ctcccgctccgcacccgcctttcccgagcaggctacacctctccctggcgcatctttactggaaagccggcaggcgaggggagaagtgagcgccgtctccgcgcctcctcggtcctgctggctgagcgcggggatggctccggagggagacactcaggaaaccacctccgcccttcccccatctctatccagcgg

SEQ ID NO: 76405 - DNA, 384 bp, Homo sapiens
  misc_feature (247)..(247): n is a, c, g, or t
  misc_feature (261)..(261): n is a, c, g, or t
  misc_feature (264)..(264): n is a, c, g, or t
  misc_feature (348)..(348): n is a, c, g, or t
tgctgttacctggggaatttcatgccagggggtttggagtcagactatagagtaatggctagaacagtgcctgtctcaagtcggaaggtggaagcaacagtggcctttgtgtttctgtgtcaaccctgtccagttgacagaagctgcagaaatacagagctctctggccaggtgtgatggttcacgtctgtaatcccagcagtttgggaggccaagggggttttattacgaggtcaggagtttgagnaccagcctggccanacnatggtgaaaccctgtctctactaaaaatacaaaattagccaggcatggtggcgcatgcctgtaatcccagctacttgggaggcntgagacaggagaatcttgaacccaggaagtggagat

SEQ ID NO: 76406 - DNA, 397 bp, Homo sapiens
aatctccatatttggttctggaaaactcataccatgagttcaatttgactgaactttgaattctgctcagctttcagttctgttttttaaaagtagaaagtattccacttatgcatggaatgcttgccgttcaaaatcatatgagttgacacgatgctttagagatcattttttttttttatggtaaggacagcacccagtctgaatggtggtgctggagatttctctgtaatccatttctctccccagtcactcttgattctgaaattaatccatctctttctactttccttctcttctaggcatttaaattgtgtctgctattgagagaggaaataaaataacgcttattttcacatcactcagaggtagacagattagcactcttgcagaagag

SEQ ID NO: 76407 - DNA, 2390 bp, Homo sapiens
caatagctaggcagaaaaggtacagcaaataaacgaaaagcagaaccatgagtctgatggcgaaagaggggaagcagtttgcttttctgatagcaatttcatgagtcagctgacctaagatacatacttcaattctcatgggatttcttgagctaggaaaggtggttggcttacggcacagtagagagcttccagggctggctggcgtgggatacccgtaccacagaaatgcagggaccattgcttcttccaggcctctgctttctgctgagcctctttggagctgtgactcagaaaaccaaaacttcctgtgctaagtgccccccaaatgcttcctgtgtcaataacactcactgcacctgcaaccatggatatacttctggatctgggcagaaactattcacattccccttggagacatgtaacgacattaatgaatgtacaccaccctatagtgtatattgtggatttaacgctgtgtgttacaatgtcgaaggaagtttctactgtcaatgtgtcccaggatatagactgcattctgggaatgaacaattcagtaattccaatgagaacacctgtcaggacaccacctcctcaaagacaaccgagggcaggaaagagctgcaaaagattgtggacaaatttgagtcacttctcaccaatcagactttatggagaacagaagggagacaagaaatctcatccacagctaccactattctccgggatgtggaatcgaaagttctagaaactgccttgaaagatccagaacaaaaagtcctgaaaatccaaaacgatagtgtagctattgaaactcaagcgattacagacaattgctctgaagaaagaaagacattcaacttgaacgtccaaatgaactcaatggacatccgttgcagtgacatcatccagggagacacacaaggtcccagtgccattgcctttatctcatattcttctcttggaaacatcataaatgcaactttttttgaagagatggataagaaagatcaagtgtatctgaactctcaggttgtgagtgctgctattggacccaaaaggaacgtgtctctctccaagtctgtgacgctgactttccagcacgtgaagatgacccccagtaccaaaaaggtcttctgtgtctactggaagagcacagggcagggcagccagtggtccagggatggctgcttcctgatacacgtgaacaagagtcacaccatgtgtaattgcagtcacctgtccagcttcgctgtcctgatggccctgaccagccaggaggaggatcccgtgctgactgtcatcacctacgtggggctgagcgtctctctgctgtgcctcctcctggcggccctcacttttctcctgtgtaaagccatccagaacaccagcacctcactgcatctgcagctctcgctctgcctcttcctggcccacctcctcttcctcgtggggattgatcgaactgaacccaaggtgctgtgctccatcatcgccggtgctttgcactatctctacctggccgccttcacctggatgctgctggagggtgtgcacctcttcctcactgcacggaacctgacagtggtcaactactcaagcatcaatagactcatgaagtggatcatgttcccagtcggctatggcgttcccgctgtgactgtggccatttctgcagcctcctggcctcacctttatggaactgctgatcgatgctggctccacctggaccagggattcatgtggagtttccttggcccagtctgtgccattttctctgcgaatttagtattgtttatcttggtcttttggattttgaaaagaaaactttcctccctcaatagtgaagtgtcaaccatccagaacacaaggatgctggctttcaaagcaacagctcagctcttcatcctgggctgcacatggtgtctgggcttgctacaggtgggtccagctgcccaggtcatggcctacctcttcaccatcatcaacagcctccaaggcttcttcatcttcttggtctactgcctcctcagccagcaggtccagaaacaatatcaaaagtggtttagagagatcgtaaaatcaaaatctgagtctgagacatacacactttccagcaagatgggtcctgactcaaaacccagtgagggggatgtttttccaggacaagtgaagagaaaatattaaaactagaatattcaactccatatggaaaatcatatccatggatctctttggcattatgaagaatgaagctaaggaaaagggaattcattaaacatatcatccttggagaggaagtaatcaacctttacttcccaagctgtttgttctccacaataggctctcaacaaatgtgtggtaaattgcatttctcttcaaaaaaaaaa

SEQ ID NO: 76408 - DNA, 486 bp, Homo sapiens
caatagctaggcagaaaaggtacagcaaataaacgaaaagcagaaccatgagtctgatggcgaaagaggggaagcagtttgcttttctgatagcaatttcatgagtcagctgacctaagatacatacttcaattctcatgggatttcttgagctaggaaaggtggttggcttacggcacagtagagagcttccagggctggctggcgtgggatacccgtaccacagaaatgcagggaccattgcttcttccaggcctctgctttctgctgagcctctttggagctgtgactcagaaaaccaaaagtgagtgctcagagccagaacagagaacttgtggaccaagggctggacctggagccactcatggtctccagtgggctggagaaaagtgcctgttctgagagcaatatttgggaaggcttgctcctgtgtttcattatttgtttgcttaatttatcattatatcaaatatggatagcctttta

SEQ ID NO: 76409 - DNA, 508 bp, Homo sapiens
gccttctcctggacatgcccatgtttccaccaccaccttcccacaggaggctccagctccagagctgcctccgccctctccagtccagcagggactttttcatctgccccgcccttgtcctggtgctgctgtagcagtagtgtgaccttggtaaggcgctaattcttgcagagcccctgttctcctgtattgccctgcctgttggggggcccttattgtgagcagaacctagggccttttcttctcagcccttgtctcccacgctgtgcgctccccatcgagtcaatcccaggccagtcattgccgacagccctcagtgcctcattctctcttctccattttttctctaatattcagaagccttcataatgtcttgcttagactgttgcaatgccctctttttaaaaatccttggttttttaattgtataacatatagcaggatccagatctaaataaaacataatctctgcccttgcgaaactcatggtaatggcagtaagtcgact

SEQ ID NO: 76410 - DNA, 1279 bp, Homo sapiens
accctgctggatacaaatgccctgtacgacctaagggcctccacagcaggaacaaaaggaattttgtctgagattttagcagaaaagtaatttttgaaatctattcttggatttagacgtttattggatttcaaagcttcttgctgcccaggagcttgtgaatacggtcaaaggtccatgaaatttccaaagtggtaccacagcagatgaacctgaatgcaaactggagggaccaacagagtccagcctatagacataaatccttaactacacctagatctcactgtcttttccaatggtcaaaagaggggctcttgaaatggctccattgttttatagaaacaaggtcttcctaagaagtctttttctcctatctttttcttacccaaaataaaggaatggcccaaaacctcaagccaagcttaccagctataaacaacttggtggtcagcagccaaaagaagagtggacatgccatggtcatgtggcacgtaccctatacaagcttcacagagaagaatggaagcacttgattgtaagacagagggtgagatgtgagaggaatattaaccttcactttccacaggcatttttttctgcaaatggcaccagcttttggacttaaaattttattccgaatactatttagatgcatcagggccctcaaaatatggatttcaagttggagacatcaaagtgcattatttactaaaaccactgcagcttttttcccctctcctttcacaagatgctattgtaaattcaggctgctttaatctctgtgattaaaaaaaaaaaggaagaaagaaaaaaaaagtgctgcttgaagaggaactgaactcacaatctgggagctagaaatgctctctcgtgctctctctgtctccagtgataagctgaccagatgtcttgaattaagtacagggtcaccaacatctctaatagaatccaactgtggaatagaaaaactatttcgtctaagaagtggatcctagctgtcaaataaaaaatcgctgttgaatgctgtaaagtacatttttacacccatgtacaatttagagcttaggaactcatggaaaaaaatagagttaacacggataaagggattttaaaaggcgagagagggaagagtttcttaaggagtctccaatgacaaaaatgtgttcattttctgagacctccagaatgaattactaaggtatcctcaaacaaaagtggttttgctattcagaaattcatatgttctaaatagagaaaattaaaaattaaaaagacatga

SEQ ID NO: 76411 - DNA, 546 bp, Homo sapiens
agaacaacagcgagaaggagccaaagctggagccagaaagcctggcaccgcaccttcccctgacagttagcaccttcctttcacaacatctcccttaagggggaagcgtctgctgtggaacccaccgcaagcaacgcaggcagagttcagcctgaagagcgccaggccagcctcctctgtcttccgagcaccgcttctcaggtcgcttcccaatctgaggaggctgtcgtgtccacaaccagtccagggggatgtgcgccactagctgaggacgccaggcccggcgacaccacaaaggcttggccatgcggaatgtgccctcaagagcacacacttcgggtagagggcacttgcattgagctcttcagctttttaaatccactgtagttcatgagcctgtgtgacataattacttttacattttatattgtcaattagtttattggcattttcaatcttttcaactattggctatgaaaatatgaatttaacgtaacattcaaatgagtattaaagaaaaataaagtagaacttcattagagggct

SEQ ID NO: 76412 - DNA, 867 bp, Homo sapiens
gaagatttgatattttcccaccataaagaaatgataaatatttgaggtgattgatatcctaaataccctgattcagttattacacattgtatgcgtgcatcaaaatatatgtaccccatagatatgtatgattaatatgtaacaataaaaaatgaaagaacatttctcaataaattggcaaaattgaaaattttaatcatatcaaaaagtgtggagaaacagtatcatacactattgctaggaatgcaaattactagagccattttggagatcagtgtggcagtatcatttaacaattatttctaattatcaatgataactggcatagcaactcttttccggttatctcccccttctttctgacttctctttaattctttgcaatttgtaacccacaactaaccttttcgcctaaagaattgctcgggcaaaaagagaaaattctttcaatgtccctttgaaaattcttcagcaacatgactgattaacatgagtggggtttgttgttgtttaccctacacactctagaaaccatcagtaaaattgtaaaattgtgttcagagacattcagtaagagtacgactaggcgtggtgtggttgctgacgcctgttatcccactactttgagaggccaagccatgaggattgcttgagtccaggaatttgagaccagcctgagcaacacaggaagaccctatctctaaatttagctgggtgtggtggtgcatgcctgttgtcctagctaataaggaggctgagatgggaggtttgcttgagcccaggacttcgaagttatagtaagctatgaatgctgcactctacgctagcctgggcaatgatagaatgagactctgtctttttgaagga

SEQ ID NO: 76413 - DNA, 798 bp, Homo sapiens
agttcaaaacgggtcataaagcagtggagaaaactggaaacatcagcaatgcttttggcccaggaactgccaaggaatgtacagagcagtggtggttcaagaagttttgccaaggagacgagggccttgcagatgaggagcggagtggccggccattggaagctgacaatgaccaattgagagcaatcatgctttaaaattggtgaggatgtaaagtcatgaagagggaattggtttaggggcaacacacctctgagagtgccctccagagttgtgtgacacagtggcccagagagagtgtagaatctccagggctatccaaaacactaaattctttggtacttattcattgaatcaatggagagactttagggatggcatttggtacagatctgtaagtaatgtatgaacatccttggtctctaatagcagtaacgacaattttaatcatcataattatttagcctgtacctgctctgtgcacagatcctgtgccatgtgccctgtcacacttaaccgttacaagagcctgtgaattacagatgatattcctattttatagaccaggaaactaaagctcggagagagtcagaatctctgatcttacgcagtgtcttggtctgctccggctgccataacaaagtatcacagaccgagtggcttcaacaacaggcactgatcaggcactgattgcctaatagtcttggaggctagaagtccagggtcacctgttgaaaggaggactggtttcccctgaggcctctcaccttggctggtaggtggccgtctgtgtgtatc

SEQ ID NO: 76414 - DNA, 534 bp, Homo sapiens
cctcccaagttcaaggcgattcttgtgcctcagcctcctgagtagctgagattacaggcgcccaccaccacgcctggctaatttttgtatttttagtagagatagggtttcaccatgttggtcaagcttatcttgaactcctgacctcaggtgatccacccgcctcggcctcccacagtgttgggattacagacgtgagccaccgtgcccagccagagaaaatcttatatttgacttgaaaatctgaacttaaaaggcaaccaaccagagaacctgaggggtaacggaaggacagcaaaacacagaggcctggccccagtaggggaatcgggtgtaactcggaagaaatgctgacggagctcttaccatgtggcacgcgcaggagcatgctggcctgttttactcagccccggccctggccacagagaggacgggaccttccccaagtgaagtgggttcttcagttgtggaaaaggccttgccacccactgccaagcattcccttagctccccacagggcacggagagccagga

SEQ ID NO: 76415 - DNA, 496 bp, Homo sapiens
taaaaagttaaaaaaagttttttaaatagaaaaaagcttttgaaataaagacataaagaaaggaaatatttttgtacagctatatgatatatttgtgtttctgaggcagggtcttgctctgtcacccaggctggagtgcagtggcaccatcacggcccactgtagccttggcctcctaggctcaatgcaatcctcctactagagcctccggattaactgggaccacaggtgcataccacgacacttggctaatttttatgtttttttaaagacagggtttcaccatgttgcccaggctggtctcaaatgcctgagctcaagcaatctgccagccttggcttcccaaagtattaagctaagtgttactacaagagtaaaaaagttaaaaaaaaattttaagtttacacagtaaaaaagttataataagctaaggctaattattattgaagaaaacatttttatataaagtagcctaagtgtacagtgtttataaagt

SEQ ID NO: 76416 - DNA, 714 bp, Homo sapiens
gaggcacatctagcctcatcatgcaaaatgagagtttaatattaatccactcatctgagtctaattcaacataaaacataccccaatctaacgataaagcctagaactgctgatataccatacagtaacctcctgagtcttgtcttttctgcagcagtaactatagcaataaaaggttgggggagagtataaatatttaaggaccaaaataaatctttaaacgttgaacaaccaggttatgtgatgggttaaactggcgactggtcccgacatggcagctcgtcgaataatgatagaaacagcaaaaccttggccattcctttcctatcagtgcagcattagtgcatgtcagctttgtaataacttaactagctagagctagcagatggtgtttttatggccctatataaacagtattaagtcattttaactctttctccataactcaggttttcaatctaggctgcagttgtccacctcttatcctctgagatgctcatgaggaagagtactaacatttattgagcacccgttatataccagccacttctcatagggatttattaactccaatttacagagaacagctactaggggcagagccaagatttgaactgattgtttgattccattgctgtggttcctcccactattagcatatcattctgaacctctgttttcattgattaaatgcacaggaaggagaaaagcagc

SEQ ID NO: 76417 - DNA, 826 bp, Homo sapiens
agcatgaaatgcctggcaacagtctttaaagaggaaaaattacatgtggaggaatatatgcattaacacccgatacattaatatgtatttaagctattattattatctttaagagttgctacagatcacttgttttctgcgtgtttgccgtggagaggggtgactgcgtgatcatgggtggagtccttgcacctagattaaggaattgtatgattaaatgaaagtctggtgacctcatgtggtcctccacacttggatatatcagggatctgggagataaagtgtgtttctcccccaggtgactgaagaagaggatgcccaacaagtagggccaggtttatgaaagcaagaccaccctatgcataatgaaatccaactgtgccatactttttggacaaatacttattaacaagctcatgtaaaatgtttgtatgacttattctataatctcaataaagtcctagttctttctgccctgactacaccttgtatgaagggtttgctcagatacaataatattctaagctgggattctaatatcttttagttgatatcaggcaacaagaaatcttagcatcaatgtctggatagaggactttgtgggaatcaagccacaggtgccatctctaagggttaagagtgaattacattttcaaaacctttctatggaatgggtgggggtttccacaatagtgtcacaagtccaaataacttgaatattattgtgactggagagcccattatctaatgaacaagcctacgtgtaaacactcacttctagcacgcgtcctgctagttggcaaagcatctgatttcgatctctata

SEQ ID NO: 76418 - DNA, 469 bp, Homo sapiens
aaagggaagaatccatcccctgcgtgtctctcctccatgccccaccttctggggtcagagatccaaggcctcattgggcagccctggactccaaggccccgtcaccccagaaccatttgagattcaatgcctgtgtccagctcccaggagtccaaccgtgaaatccacaagtgcaggccccaccctgtcctgcagttctctttcccttatgataatgtggttgagtcctttgtcactccctcctcctgctggctgcagaaatgacctcagcccaggccagagaccccagctctggcaaggcctcttgtggtcggccaggcccaggctgaaagccaagcagaatcaggcaggatctctagcgggagggaaacctgataggacctttgtcagacttttgttgtgaggctttggttttaggagtgatgagggaaataaagtggaacagaaattgatgactaaaaaaaaaagc

SEQ ID NO: 76419 - DNA, 867 bp, Homo sapiens
gagtctttcatgaacactttgctcctctatgtctcatttatgcaaaattcctggtgactctccactaacatttttaaagtgaaagcaaactttcactttaaaaaaagtgagcgagaggatcccttgagcccaggagttcaaggccagtctgggcaacatagcaagaccccatccctaaaaaaaaaaaaataagttttattaaatgtggcactttcccctagaagggcagtaaccccaggaaccagtctgcctcttttcgaataaaggagactttttaaaaagaaaaaatttctttttagggtggggtgctctttatctagcatctttccttcctccttctctctgcaaaattcaacattcatgacagagggccacaccaaccacgggtttatagagagaggaactgaacagctgttgattcccatctggaatatatttaatgtttgcctgcttgtggagcatggtatttaaagggtgtggatggatgaatgtttaaaaaaaaaacacacaaaactatgcacaagctgtatgagagatggctaggtccatctatgattttttttaaaagaagaattttaataccttttctttgacagtgaactgtatttagaaatatgatctttattgtgaaatgctcataaaatgcaaccaaactgcatgtttggccataggctagaataatatattaaaagaattaatggaaagtagtattgtctgggtttcatgaaactattccagataatattctccagcaaaacttatggtaacctgtattttataatgtcaatctgctggaccaagttaatttagaaaataatttttaatcctcagattttcaaaacttggactactgcaagactgatatgt

SEQ ID NO: 76420 - DNA, 364 bp, Homo sapiens
agcctcattacagctggacagtttcaaatgttctcaatctccaccaaacctcctctcatactacctcagtggagagggagatggatacctcattattgttgagtttggggtggaagtctagactgcccatttagtcaacatagacactgcatgtagggtaagagaagaatcttgctaacccccggcagggatgaaactcctagattcctgctcagacttcttttacactactctgggtgctggaaggagagggtgttggaataccctggcaaggatcagcgtctgggcttgccactttgcctttgcaggtgtacatggggatgggaccataattctttttgtggtgttcaacgagagcaaaatg

SEQ ID NO: 76421 - DNA, 453 bp, Homo sapiens
acattccctgctagcccctaaatctttcaggatccatgtccccctataaaataagcatatgccagttgtaaccctggctctgcaacctcagtttaagacgtaacactgagttctattgaatctgacactgacaatgttgattacaggtttatcttcccaggtacagaacaagaacatgagatcaagcactcttcaggctatcctgagatggctgcataattgactctttcctccctttcttctctcctgcctgccttctccccttacatactgagttcccaaaaccctctttggaaagcaggggtcacagtcatttctgtggcttgtgttttttccgggggtgtcgtcaaattgtggctccacaaagctctattgatgtgggcacttgcctcagtcggtggctcattttttgtttttttgttttttgtttgtttaacagctataaatacagat

SEQ ID NO: 76422 - DNA, 323 bp, Homo sapiens
ctccctcttctttcaagctatcagatttgcatggaagtctaaagcctctccctgcctgctctggctgcctaccctcttccccatctcttttaatcccatctcatcttggcatctgtctcttggatgactcaaaagaaaacaaatatgtgggtttttttttctaattatacctatcttttcccccactgacattctaatacttgccctagacccaggaagcatgtcccacttccttcttcctccctatgagttgagaattaccattagacaatagtggctaaattatttaacactgattaattagccaatatttggggggcaca

SEQ ID NO: 76423 - DNA, 651 bp, Homo sapiens
ccccggtgggagacgggggtctcagcatcagaagagcgggaggggagggaaccatccttggtaaggaagaagctgaaagaggacaacaccgtatttcaggccagttgaaatcgtgggtgtcagggcaagggaggcgtccgcagaccagagttgtgatggaccgttctccaccatgtgatgttcattttctccactgagattaaaaaagaagaggaaaggaaagaaggaaagtgcacaacctccttgaaaagacagctcctcctgccgaaaatgtgttgcagactcggtcagtcaggtggacttaattggaaggcactttctttttgatggaaaaagaaggagaaagatttgtaaaattgaaccaatgttaacacactcgcatcccacaaggagctgagttttgatctgcttcatgctgagagagcgggaaggagaccagagtgtgtctcagactttctaagctcagctgtaagttataaagatccacctacaacttcttgcaattctcacaattacactacataaaatgaaaaagaaggccgggcgccgtggctcacgcctgtaatcccagcactttgggaggccgaggcgggcggatcacgaggtcaggagatcgagaccgtcctggctaacacggtgaaaccccgtctc

SEQ ID NO: 76424 - DNA, 730 bp, Homo sapiens
ttcttatctctttctccggagtccttagtcatgtgtggtttagccattagcacatgatttgagtaagtgccatagctaatttcataaagtttctgacccaaggatccttattgttaatctgtaccagtgctgcactaattgctggcttgcagagaaataagaaacttgttttagaatatgttgatatttttattttccttcatcgaaaaattcttgttttgacaaactgtcagtgaactaagcagtgtgctgggtgatataggtaatttacagcctggtacaagcccccctttgtctcattgtgggtcactaacagttcacagactggcccaagagctgtggaccacactgatattgatactaaaccattttttaattatagataaaaacatgaagcccagaggggtggaatgacttcccagatcctaacacttagtttgtgacagaaccaaatatagccttcctgactcctgatttgtggtttattataccttgcatcagttcaagttgttcccccactgggatttaggattacacttattatttacaggagtgcttggataaatagtaagcttaaggttatatcgcagcacttttaaataatcaacttcagttggaagaggaaattattcagcttctttcatcttgtactgacaattaggtagcaaacatcatgaatctatactgttttatgtaatttgttaaaagaaaataatacctgatttgtaaa

SEQ ID NO: 76425 - DNA, 1001 bp, Homo sapiens
cttgctagtaagggaggaggtcacctactaagacactcataacagaataagtcatgccaagaactgagtgtagaagggcactggacccagatgaaacaacatctgaaagattgaaatcctcaagcaggaagaagatttgatgcctcaagcagagggaagccaggctagttctctgacccgtgagacagtgcataaatatcttaatggcagacacactccggctcaccaccaggcccagtcatgatcccagaagaatgccctgctactctggtgcctcattccaatgccagcaagccctgcctaccctcctggcaacattcctctccccttcctagtatcccagacacctgcctgacccagaagtcattgtcctcagacttggaggtcagccctcgcccactagatcttgcaggtcagctgcctcccacacagatctcaggctcttggaatggcctccacacaataaccctgtttgtgctgtgatttctgatggatgttgtgttgccagggacaactctgcacaaggattgatcagcctcatgagaatgcagtctctgggctgcaggcattactgcctgggatcaccacttgcttctgttgcccttcccaaaggaaaaagaattcatgtcccaacagaagaggtttccagttgtggttttctggaaatgtgcaacaaaggcagttaccaatggagacacagcctgaagctctccttggccacatcttcagccccctgcctcagggagagagagagagaaagggtaggggccctggagctgccccttgcaaaggtccttggaagctggcaatgtgcctctcagagtgcccaccaacctcctttccctaccaagctccacgtaagcattaaattaattaatacactaccaaccagatctcaaactagaagccagtaagatccagcatgaacacttagaaggatcccttctttttgaaatctgaggaatttggatgcattgaaaaataaatgaacatatcataac

SEQ ID NO: 76426 - DNA, 239 bp, Homo sapiens
gagatgtaagtctcccctgaaaatgtattattaaccattagtagcgttaggatgtcctttggttaggtttctcactgtctccgaaaaggcaaatttctagagaagctaggagctattgctgttaggttttttatggactcatttcctctcttcctgtcatctaatgtactgtccagtagaagtataatgtgagccacataggtaatttaaaattttctactaggcacatttaaaaagct

SEQ ID NO: 76427 - DNA, 859 bp, Homo sapiens
tcctttcaatcattccccatcatactgatcaaggtacctgctttcccctcatttaaagaaaattcaagtctctaaaaggactaaatatcttccacctagggagacacatgctcatttaaattggtccactgcaggctatgataaagtggtcactaggatccttcgaatgactggagtacgtatcatcgagtataagaagaagtgctttctgaatgatgccgtcacatgatccatgatagtgaagacataaaaaataacagaatattgcaaacttctttattttggcctgtgtaatcacagatttacctacaacaggataaatgaattcatattatgaaactgaaacacactggtaaatataacatgctccatataaatggtgcaagagaatccccaaaggcaagaggagtgcaggaggacccaggccaaaccattcctccgtggcagtcttgttcctcagtccttctgcttatatgggtggggaggcgaaaggagaaaggaatgaggacaggaaaaaagcaacagctgtgaaagatggggccaagcagacgtgaaaactgaagctgtactcaggccattttccttctggggaatcttaacaccaagctgcacctaacaattgttctacccaagcaacactgcaagaaagcagacatgaggaggatagaggcacaggaggttaatggaaggccctcactgaaagccctggcccacagaatgtgcctcccaaactgtgtgaggcctgcgagcgttctgtgtacaagagaccagccctgtctcaggtaccaagcggaaatagtcaatagcccatcaaccgacaggggcagcctggggcacctgctgattcttgcagtgatga

SEQ ID NO: 76428 - DNA, 414 bp, Homo sapiens
gtgacttgagcatctacagacgttatcttcagagggttctggaacccatcccctttggatacctgtaaatctttattttttgacctcttcagtgaagaccaaggtcaagaagaggttgctaaagacttgtttcagattatatcttagatttaacataccacttggtattactggagttttactacattgaagcttaatcttcgtatctgtaatttagtgttgctcccacgtactgtgctgtaggtctctcatttccttgcctgaataaaaaccccaagttagccatgtaaaatttttgtctttctagactatcttatatttctcttttgttttctacaatattccagttactagctaaacaaagaatagtctttgagaaagagtgcttttgctctcaattcagacatttgttta

SEQ ID NO: 76429 - DNA, 197 bp, Homo sapiens
aaatccaattttacggaagacaaaaaagagggtgggtttcataactattctacaagtggccactatagaaattcttcaccaagaaagctcctgttaggcctttaaaaatgtgtttctgttaagacacaactagtttcgtaagtcgctctattgcataacatgcggaatctctatatccagtgtgctgctaactagca

SEQ ID NO: 76430 - DNA, 318 bp, Homo sapiens
atttatttcatttgtgtcacaatataaaattcttcttgttaggacttgtgtacaaactgtatttaaaaacatatttctgaaagaggaatttttcagtggtcttatctggactacctttcaacctgtacctatcttaggaccaaagccagattttcagaatgaatcactaattcagtgaacttgagtagattttagagattacctgtctaatgctctcattttatatatggacaaaatgaaatatataaatgtgaaatgatctctacaaggtcacacaacatttagagacagagatggaactaaaagcaaaatattaga

SEQ ID NO: 76431 - DNA, 450 bp, Homo sapiens
aatccagactcagcacaaataaccaattaaacccaccttcaaaggcagacaaaaatcatatcactcttttatgcttctaccagcatttgaaccacctccatatagacataattagttagaaaaagtcaggttaatatttttgtcagtgtctctgtgtgtgtgtattcaataagtttgcaaatatatctttggctcctgttaaggagacccaaactataatcctgctaaatgtccaagtctcctgtttatgactatgtaaaatcggaggctacagatgccctaaataccctcctatgccaaaatatctccaccatcacccctgcctagggtgtcagttcccaaactggaatttcccgcctcactcatttctctgggttaaagtccagcctccaggaaggcccaagtaaaataccagattaatctgaaaaggaccaacttgttaataactca

SEQ ID NO: 76432 - DNA, 471 bp, Homo sapiens
caaatttcttccaacttagtttaagtgtgcagctcatgtgactggcattctgataaggctaaagccatcaccggttatcttccttcctactgattcatgagttcctgctatagagtttctgctacatgtagtctttggcaataaatactactgagttttgggagcataattttgtacaggataactgccttttaaatttggtgggtataaggcaagtattgtaattaccttgggtgttttattgactctccagaccttttgtaagttgaggcacaccatagagttattgaactaatttaacttctgaagtgccaaatgaatgtgttgtatccatatccaaaaagagacagccaggctgcagctgctgaaggaatcctgagaggcattaagaacatttctgcctgtgagtgaatccaataagaaactgggaagggctttaattttattaaacttttaccttattacagtgag

SEQ ID NO: 76433 - DNA, 510 bp, Homo sapiens
ggctaaccggctttcaggtcccctctggcagctgggagttttccttctatagctcaaaattcttttctgccttatttactttctggtgtcgacatatcttattcctttgttgcaggacaagaacttggaacttgctgagctggggatggtgggagtaaaagagttgtaaccttcccttctgctccccaaacaatgtgagagaagaaaccattggacgccactctctcctgttagcccaactgccagagcgaaaaagttgtgacgtcactggcttacccagcaagctaactgtgggaggtgggagtaaaagagctgtaaccttctctcccactcgaggaactaccctcctgcttgacaaattacaggagcgaaaaagccacgtatcagaggagacttcagggtatgtttatatctgtattacaggatttttaaaagattgaatgaagtagcatttctgaaatgtctggaacataatgtttgaaatagaataaaatatcaataaatggtgct

SEQ ID NO: 76434 - DNA, 179 bp, Homo sapiens
gacacgttgtcattgataaaactgacatcaccttagaggcagaggacaagtcctcacattgtttctgggacaggggcatggaaaaagagaagctttcactaactccctttatgttgtgtatctcaatggctactaaatacacctctctcctttcttttttcttttctttttcatgccac

SEQ ID NO: 76435 - DNA, 3831 bp, Homo sapiens
ctcgcgagaatgccgccagctccggaggcgactgcggcaggagcccgagctctcgcgcgacaggcaccaattcgttagacgcgcgctgcaggagcgcggaacatggcgcggcacgggccaccgtggagtcggttggacgcgcagcaggagcgcgacgtgcgggagctcgtccggggtgtcgccggcctccaggacgaggcagaccccaacttccagctcgccctaaacttcgcctggtccaacttcagatttcatcgtttcttggatgtcaacagccacaaaatagaaaaaacaatcgaaggaatttatgaaaaatttgtcattcattctgatctaagcaaagctgctagttggaagagattaacggaggaatttctaaatgcaccacttcccagtataaaggaaataaagacagatgcacattattccatactgtcacttcttctgtgtctgtcagactctccttcaaacagcagttatgtggagacaccaagaaataaagaagtggaaaagaaagatgatttcgactggggaaaatacttgatggaagatgaagaaatggacattggtccgtacatggacacaccaaattggtctgaagaaagtgaagaggaaaatgatcaacagcccttaagcagagaggactctggaattcaggtagacaggacaccgttagaagaacaagatcaaaacagaaaactggatccttgtatcagttggaaagatgagccagatgaccgaagctggctggaacatcatgtggtccatcagtactggacagccaggccctcccagtttcctcatagtttacatttgcactctaatttagctgctgtctgggaccaacacttgtacagcagtgatccattgtatgttccagatgacagggttttggttactgagactcaggttattcgggaaaccctatggttactttcaggagtgaaaaagctctttatatttcagttgatagatgggaaggtaactgtgagaaacaatattatagtaactcatttaacacatagctgtttacgatctgtgctggaacaaatagcagcatatggccaggttgtgtttcgactccaggagttcattgatgaagtcatgggacacagttctgagagcatgctgcctggaagtgggtctgttcctaagaagtcaactgaagctccctttagaacctaccaggctttcatgtgggccctgtacaaatatttcattagtttcaaagaggaacttgcagaaattgagaagtgcatcatcaataatgatactacaataactcttgcaatagtggtggacaagttggcacctcgattgtctcagctcaaggttctgcacaaagtgtttagtactggagtagcagaagttccacctgatactcgaaatgtcgtccgggcctctcacctgcttaacaccctgtacaaggccattcttgaatatgacaatgttggagaagcctctgagcaaaccgtctccctccttttctctctctgggtggaaacggtgcggccttacctgcagacggtggacgagtggatcgtgcacgggcacctgtgggatggcgccagggagttcatcatccagagaaacaaaaatgttccagttaatcacagagacttctggtatgcaacttacacgttatatagcgtatcagaaaagacagaaaatgaagaaaaaatgagtgataacgctagtgcgagttccggcagtgaccaggggccctccagcaggcagcacaccatggtgtccttcctcaaacctgtcctgaagcagatcataatggctggcaagtcgatgcagctgctgaagaacctgcagtgtgcggagagcaccacctgccaggcaggagccagagatgcagaaagaaaaagtttatacactctctttctggaatctgtacagtcccgtcttcgacatggagaagattccactccacaggttcttactgagcaacaggcaaccaaggagaacctgatgaagatgcagtccattgctgaaagccatcttgaactggatgatgttcatgatccactgcttgccattaactttgcaaggatgtatttggagcagagtgactttcacgagaagtttgctggtggtgatgtatgtgtggatagatcatcggaatctgtgacatgccagacttttgaattaacgctgagatcctgcctctatcctcatattgacaagcagtatctagattgctgtggaaatctcatgcaaactctaaaaaaagattacaggttggtagaatacttgcaagctatgaggaattttttcttaatggaaggaggagataccatgtatgacttctacacgtcaatttttgataaaataagagaaaaggaaacatggcagaatgtgtcttttcttaatgtccaactccaagaagcagtaggacagcgttatcctgaagatagttcacgtctatctatatcttttgaaaatgttgacacagctaagaagaagctgcctgttcatatcttagatggtctgaccctcagctacaaggtcccatggcccgtggacattgttataagtttggaatgtcaaaaaatttataatcaagtgtttcttctcttattgcaaataaagtgggcaaaatatagtctggatgttttactttttggtgaactggttagtactgcagaaaaaccacgacttaaagaaggccttatacatgaacaagacacagttgctcagttcggaccacaaaaagaaccagtaagacagcagattcatcgcatgttcctcttaagagtgaagctcatgcatttcgtgaacagcttgcacaactacatcatgaccaggattctacacagtacagggctggagtttcaacatcaagtcgaggaagccaaggatttagatcaattgattaaaattcactataggtatctgtcaaccatccatgaccggtgtctgctgagagaaaaggtcagctttgtgaaagaagctatcatgaaggtgttgaacttggctctcatgtttgcagacggttggcaggcaggcctgggcacttggcgaatggaatctatagagaaaatggaatctgattttaaaaactgccatatgtttcttgtaaccattttaaacaaagccgtctgtagaggatcctttccccatttggaatctctagcgttgtcactcatggctggcatggaacaaagttaaatgtcttcagcgtaataaatatctccgactttgtcatcatacatgtacatttccaccatgtgcagctgaaaagtgaaaatatttttattttggtttatttgtaaaacttgtccacagtcagcctggcacagtcgctcatgcctctaatcccagcacgatgggaggccaagacaggcagatcacttgagcccaggagtttgaggccagcctgggcaacatggtgaaacccggtgtctaccaaaaatacaaaatgtatccagacatggtggtgtgtacctgtagtcccagctactcaggaggcaaagatgggaggattacttgagcccaggaggtcaaggctacagtgagccatgattgcactactgcagtgcaacctgggtgacagagtgagaccctgactcagaaagaaccacttgcccacagtccagacagatggattgtaggtgggttttctggagattagtagatactgtatagagttgtatacataaaattgtgtcagtagtacaaagtgtatataggctgtttactcttacatttcctactgtaagatacagatttatggtactgatacctttaaattatatcatattttgaaaatgtaattactgatattcaaaataaattaaaggacttaaaatcaaaaaaaaatcc

SEQ ID NO: 76436 - DNA, 473 bp, Homo sapiens
agacagagtcttgctctgtcacccaggctggagtgcagtggcacaatctcgactcactgcaagctccgcctcccgggttcatgccattttcctgcctcagctcccagctactcaggaggcaaagatgggaggattacttgagcccaggaggtcaaggctacagtgagccatgattgcactactgcagtgcaacctgggtgacagagtgagaccctgactcagaaagaaccacttgcccacagtccagacagatggattgtaggtgggttttctggagattagtagatactgtatagagttgtatacataaaattgtgtcagtagtacaaagtgtatataggctgtttactcttacatttcctactgtaagatacagatttatggtactgatacctttaaattatatcatattttgaaaatgtaattactgatattcaaaataaattaaaggacttaaaatcaaaaaaaaatcc

SEQ ID NO: 76437 - DNA, 482 bp, Homo sapiens
aactgctggagaggctgaggctgcagaatcacttgaacccaggaggttgtggctccagtgagctgtgatcatgctgctgcactccagcctgggtgggtgacaaagtgagtccctgtcaaaaaaaaaaaaaaatgtcctgggcatactgtcatgaatatttttctagacttaaagtacactcgtctttttttaatctcatttcaggttactttcaggagtgaaaaagctctttatatttcagttgatagatgggaaggtaactgtgagaaacaatattatagtaactcatttaacacatgtaagttatttgtatttatggtaatttaagaaataggatttatgtaaactagtaatataattttagaacattttacaatattaaaattgctattgaactcgttcttgcttcctcacatgcaaaaaaaagctaacttaaaaatatttaatatccaaaaagaaaaattgagttgtgcatctttata

SEQ ID NO: 76438 - DNA, 310 bp, Homo sapiens
ggtttaaagatggggtcttgctatattgcccaggctggtcttttgagaccctgactcagaaagaaccacttgcccacagtccagacagatggattgtaggtgggttttctggagattagtagatactgtatagagttgtatacataaaattgtgtcagtagtacaaagtgtatataggctgtttactcttacatttcctactgtaagatacagatttatggtactgatacctttaaattatatcatattttgaaaatgtaattactgatattcaaaataaattaaaggacttaaaatcaaaaaaaaatcc

SEQ ID NO: 76439 - DNA, 3911 bp, Homo sapiens
aattattgttcactttttcctttgtgtataaaattataaatattaatcatattattactttgtcttctactaaacatactgtttaaaacaattgcaaaagaagtattttacagcgagagggaaatgaatttgaatgtttacagaagaccacctttgaataattgcagtttgcttgtgttgtagagctgtttacgatctgtgctggaacaaatagcagcatatggccaggttgtgtttcgactccaggagttcattgatgaagtcatgggacacagttctgagagcatgctgcctggaagtgggtctgttcctaagaagtcaactgaagctccctttagaacctaccaggctttcatgtgggccctgtacaaatatttcattagtttcaaagaggaacttgcagaaattgagaagtgcatcatcaataatggtattaaatgttcttcatctttactcatactacacgtaactcataatttgaatgccacttagagtttttattatataagatttgaaagttgcctagcagataagtagttctcgtgaatgcttcttttaaaattattttaaatttatatttttaagccattcatatctctaaaaatcaaaaaactacagaagatttagaatgaaaaatctaaattattcttcctgcaccagtaccccagccagtcagttctcctctccagagacagccaggtccttggcttcttacgcatccttccagaaagagtttcaacatacatgagcagtgcatatacatatacgcatacctagcagtcattacactgctctcttcaaatttttccagtttaaattttgaggataataccatacatatatgaagagcttctgttttcctttttacaaattgagtgtttcatcatatggtcgtgtcatagcccagtccccttaatggatttaggttgttcccaggcttttgctattgccagtagtgctgcagtgataatcacttctacatatccgttatcgtacacaggcagtgagttatctgtagggtaggttctttttttttttttttcatttgagacggagtctcgctctgttacctaggctggagtgcagtggctcaatctctgcttactgcaagctccgcctcccgggttcacgccatcctcctgcctcagcctcccgagtaactgattacaggcacctgccaccatccccagctaatttttgtattttcaatagagacaggctttcaccatgttgaccaccttggcctcccaaaatgctgggattacgggcataagctgggattatactgcatctgaccatgtgggatactacaataactcttgcaatagtggtggacaagttggcacctcgattgtctcagctcaaggttctgcacaaagtgtttagtactggagtagcagaagttccacctgatactcgaaatgtcgtccgggcctctcacctgcttaacaccctgtacaaggccattcttgaatatgacaatgttggagaagcctctgagcaaacctgaccagggaaccctgagagctgaccgtgcacactctctgcctcaggtctccctccttttctctctctgggtggaaacggtgcggccttacctgcagacggtggacgagtggatcgtgcacgggcacctgtgggatggcgccagggagttcatcatccagagaaacaaaaatgttccagttaatcacagagacttctggtatgcaacttacacgttatatagcgtatcagaaaagacagaaaatgaagaaaaaatgagtgataacgctagtgcgagttccggcagtgaccaggggccctccagcaggcagcacaccatggtgtccttcctcaaacctgtcctgaagcagatcataatggctggcaagtcgatgcagctgctgaagaacctgcagtgtgcggagagcaccacctgccaggcaggagccagagatgcagaaagaaaaagtttatacactctctttctggaatctgtacagtcccgtcttcgacatggagaagattccactccacaggttcttactgagcaacaggcaaccaaggagaacctgatgaagatgcagtccattgctgaaagccatcttgaactggatgatgttcatgatccactgcttgccattaactttgcaaggatgtatttggagcagagtgactttcacgagaagtttgctggtggtgatgtatgtgtggatagatcatcggaatctgtgacatgccagacttttgaattaacgctgagatcctgcctctatcctcatattgacaagcagtatctagattgctgtggaaatctcatgcaaactctaaaaaaagattacaggttggtagaatacttgcaagctatgaggaattttttcttaatggaaggaggagataccatgtatgacttctacacgtcaatttttgataaaataagagaaaaggaaacatggcagaatgtgtcttttcttaatgtccaactccaagaagcagtaggacagcgttatcctgaagatagttcacgtctatctatatcttttgaaaatgttgacacagctaagaagaagctgcctgttcatatcttagatggtctgaccctcagctacaaggtcccatggcccgtggacattgttataagtttggaatgtcaaaaaatttataatcaagtgtttcttctcttattgcaaataaagtgggcaaaatatagtctggatgttttactttttggtgaactggttagtactgcagaaaaaccacgacttaaagaaggccttatacatgaacaagacacagttgctcagttcggaccacaaaaagaaccagtaagacagcagattcatcgcatgttcctcttaagagtgaagctcatgcatttcgtgaacagcttgcacaactacatcatgaccaggattctacacagtacagggctggagtttcaacatcaagtcgaggaagccaaggatttagatcaattgattaaaattcactataggtatctgtcaaccatccatgaccggtgtctgctgagagaaaaggtcagctttgtgaaagaagctatcatgaaggtgttgaacttggctctcatgtttgcagacggttggcaggcaggcctgggcacttggcgaatggaatctatagagaaaatggaatctgattttaaaaactgccatatgtttcttgtaaccattttaaacaaagccgtctgtagaggatcctttccccatttggaatctctagcgttgtcactcatggctggcatggaacaaagttaaatgtcttcagcgtaataaatatctccgactttgtcatcatacatgtacatttccaccatgtgcagctgaaaagtgaaaatatttttattttggtttatttgtaaaacttgtccacagtcagcctggcacagtcgctcatgcctctaatcccagcacgatgggaggccaagacaggcagatcacttgagcccaggagtttgaggccagcctgggcaacatggtgaaacccggtgtctaccaaaaatacaaaatgtatccagacatggtggtgtgtacctgtagtcccagctactcaggaggcaaagatgggaggattacttgagcccaggaggtcaaggctacagtgagccatgattgcactactgcagtgcaacctgggtgacagagtgagaccctgactcagaaagaaccacttgcccacagtccagacagatggattgtaggtgggttttctggagattagtagatactgtatagagttgtatacataaaattgtgtcagtagtacaaagtgtatataggctgtttactcttacatttcctactgtaagatacagatttatggtactgatacctttaaattatatcatattttgaaaatgtaattactgatattcaaaataaattaaaggacttaaaatcaaaaaaaaatcc

SEQ ID NO: 76440 - DNA, 4780 bp, Homo sapiens
gcgaaaatccatctcggggggaaaaaaaatatgaaacaacataagtttgtgatagcaaaagattgggaaaaaatctaaatttcattaataggggactggttaaataaaatatgatacatcttagttaaactatcaggcatgtttaaccttcatgatacatattgccacaggagaataatttttaaccataatgttatactctaaagacatttccgtcgttttagaaataaaaagctgtcatccactcagatcttatacttgttagaaatatagaactcagatttcagatggctttgaggttccttatgtgtatgcatttgagctatgaagaagtttgaaggttaaggattatttaggtataactcatgttttctcaaaccaggaaaaaaattggggacataactgtcatggagttatctttactcaatctggtgtagaaagcatttcccaacctcagagatttatgttcttttttttgttttaaagacagatgcacattattccatactgtcacttcttctgtgtctgtcagactctccttcaaacagcagttatgtggagacaccaagaaataaagaagtggaaaagaaagatgatttcgactggggaaaatacttgatggaagatgaagaaatggacattggtccgtacatggacacaccaaattggtctgaagaaagtgaagaggaaaatgatcaacagcccttaagcagagaggactctggaattcaggtagacaggacaccgttagaagaacaagatcaaaacagaaaactggatccttgtatcagttggaaagatgagccagatgaccgaagctggctggaacatcatgtggtccatcagtactggacagccaggccctcccagtttcctcatagtttacatttgcactctaatttagctgctgtctgggaccaacacttgtacagcagtgatccattgtatgttccagatgacagggttttggttactgagactcaggttattcgggaaaccctatggttactttcaggagtgaaaaagctctttatatttcagttgatagatgggaaggtaactgtgagaaacaatattatagtaactcatttaacacatagctgtttacgatctgtgctggaacaaatagcagcatatggccaggttgtgtttcgactccaggagttcattgatgaagtcatgggacacagttctgagagcatgctgcctggaagtgggtctgttcctaagaagtcaactgaagctccctttagaacctaccaggctttcatgtgggccctgtacaaatatttcattagtttcaaagaggaacttgcagaaattgagaagtgcatcatcaataatggtattaaatgttcttcatctttactcatactacacgtaactcataatttgaatgccacttagagtttttattatataagatttgaaagttgcctagcagataagtagttctcgtgaatgcttcttttaaaattattttaaatttatatttttaagccattcatatctctaaaaatcaaaaaactacagaagatttagaatgaaaaatctaaattattcttcctgcaccagtaccccagccagtcagttctcctctccagagacagccaggtccttggcttcttacgcatccttccagaaagagtttcaacatacatgagcagtgcatatacatatacgcatacctagcagtcattacactgctctcttcaaatttttccagtttaaattttgaggataataccatacatatatgaagagcttctgttttcctttttacaaattgagtgtttcatcatatggtcgtgtcatagcccagtccccttaatggatttaggttgttcccaggcttttgctattgccagtagtgctgcagtgataatcacttctacatatccgttatcgtacacaggcagtgagttatctgtagggtaggttctttttttttttttttcatttgagacggagtctcgctctgttacctaggctggagtgcagtggctcaatctctgcttactgcaagctccgcctcccgggttcacgccatcctcctgcctcagcctcccgagtaactgattacaggcacctgccaccatccccagctaatttttgtattttcaatagagacaggctttcaccatgttgaccaccttggcctcccaaaatgctgggattacgggcataagctgggattatactgcatctgaccatgtgggatactacaataactcttgcaatagtggtggacaagttggcacctcgattgtctcagctcaaggttctgcacaaagtgtttagtactggagtagcagaagttccacctgatactcgaaatgtcgtccgggcctctcacctgcttaacaccctgtacaaggccattcttgaatatgacaatgttggagaagcctctgagcaaaccgtctccctccttttctctctctgggtggaaacggtgcggccttacctgcagacggtggacgagtggatcgtgcacgggcacctgtgggatggcgccagggagttcatcatccagagaaacaaaaatgttccagttaatcacagagacttctggtatgcaacttacacgttatatagcgtatcagaaaagacagaaaatgaagaaaaaatgagtgataacgctagtgcgagttccggcagtgaccaggggccctccagcaggcagcacaccatggtgtccttcctcaaacctgtcctgaagcagatcataatggctggcaagtcgatgcagctgctgaagaacctgcagtgtgcggagagcaccacctgccaggcaggagccagagatgcagaaagaaaaagtttatacactctctttctggaatctgtacagtcccgtcttcgacatggagaagattccactccacaggttcttactgagcaacaggcaaccaaggagaacctgatgaagatgcagtccattgctgaaagccatcttgaactggatgatgttcatgatccactgcttgccattaactttgcaaggatgtatttggagcagagtgactttcacgagaagtttgctggtggtgatgtatgtgtggatagatcatcggaatctgtgacatgccagacttttgaattaacgctgagatcctgcctctatcctcatattgacaagcagtatctagattgctgtggaaatctcatgcaaactctaaaaaaagattacaggttggtagaatacttgcaagctatgaggaattttttcttaatggaaggaggagataccatgtatgacttctacacgtcaatttttgataaaataagagaaaaggaaacatggcagaatgtgtcttttcttaatgtccaactccaagaagcagtaggacagcgttatcctgaagatagttcacgtctatctatatcttttgaaaatgttgacacagctaagaagaagctgcctgttcatatcttagatggtctgaccctcagctacaaggtcccatggcccgtggacattgttataagtttggaatgtcaaaaaatttataatcaagtgtttcttctcttattgcaaataaagtgggcaaaatatagtctggatgttttactttttggtgaactggttagtactgcagaaaaaccacgacttaaagaaggccttatacatgaacaagacacagttgctcagttcggaccacaaaaagaaccagtaagacagcagattcatcgcatgttcctcttaagagtgaagctcatgcatttcgtgaacagcttgcacaactacatcatgaccaggattctacacagtacagggctggagtttcaacatcaagtcgaggaagccaaggatttagatcaattgattaaaattcactataggtatctgtcaaccatccatgaccggtgtctgctgagagaaaaggtcagctttgtgaaagaagctatcatgaaggtgttgaacttggctctcatgtttgcagacggttggcaggcaggcctgggcacttggcgaatggaatctatagagaaaatggaatctgattttaaaaactgccatatgtttcttgtaaccattttaaacaaagccgtctgtagaggatcctttccccatttggaatctctagcgttgtcactcatggctggcatggaacaaagttaaatgtcttcagcgtaataaatatctccgactttgtcatcatacatgtacatttccaccatgtgcagctgaaaagtgaaaatatttttattttggtttatttgtaaaacttgtccacagtcagcctggcacagtcgctcatgcctctaatcccagcacgatgggaggccaagacaggcagatcacttgagcccaggagtttgaggccagcctgggcaacatggtgaaacccggtgtctaccaaaaatacaaaatgtatccagacatggtggtgtgtacctgtagtcccagctactcaggaggcaaagatgggaggattacttgagcccaggaggtcaaggctacagtgagccatgattgcactactgcagtgcaacctgggtgacagagtgagaccctgactcagaaagaaccacttgcccacagtccagacagatggattgtaggtgggttttctggagattagtagatactgtatagagttgtatacataaaattgtgtcagtagtacaaagtgtatataggctgtttactcttacatttcctactgtaagatacagatttatggtactgatacctttaaattatatcatattttgaaaatgtaattactgatattcaaaataaattaaaggacttaaaatcaaaaaaaaatcc

SEQ ID NO: 76441 - DNA, 3530 bp, Homo sapiens
aattattgttcactttttcctttgtgtataaaattataaatattaatcatattattactttgtcttctactaaacatactgtttaaaacaattgcaaaagaagtattttacagcgagagggaaatgaatttgaatgtttacagaagaccacctttgaataattgcagtttgcttgtgttgtagagctgtttacgatctgtgctggaacaaatagcagcatatggccaggttgtgtttcgactccaggagttcattgatgaagtcatgggacacagttctgagagcatgctgcctggaagtgggtctgttcctaagaagtcaactgaagctccctttagaacctaccaggctttcatgtgggccctgtacaaatatttcattagtttcaaagaggaacttgcagaaattgagaagtgcatcatcaataatggtattaaatgttcttcatctttactcatactacacgtaactcataatttgaatgccacttagagtttttattatataagatttgaaagttgcctagcagataagtagttctcgtgaatgcttcttttaaaattattttaaatttatatttttaagccattcatatctctaaaaatcaaaaaactacagaagatttagaatgaaaaatctaaattattcttcctgcaccagtaccccagccagtcagttctcctctccagagacagccaggtccttggcttcttacgcatccttccagaaagagtttcaacatacatgagcagtgcatatacatatacgcatacctagcagtcattacactgctctcttcaaatttttccagtttaaattttgaggataataccatacatatatgaagagcttctgttttcctttttacaaattgagtgtttcatcatatggtcgtgtcatagcccagtccccttaatggatttaggttgttcccaggcttttgctattgccagtagtgctgcagtgataatcacttctacatatccgttatcgtacacaggcagtgagttatctgtagggtaggttctttttttttttttttcatttgagacggagtctcgctctgttacctaggctggagtgcagtggctcaatctctgcttactgcaagctccgcctcccgggttcacgccatcctcctgcctcagcctcccgagtaactgattacaggcacctgccaccatccccagctaatttttgtattttcaatagagacaggctttcaccatgttgaccaccttggcctcccaaaatgctgggattacgggcataagctgggattatactgcatctgaccatgtgggatactacaataactcttgcaatagtggtggacaagttggcacctcgattgtctcagctcaaggttctgcacaaagtgtttagtactggagtagcagaagttccacctgatactcgaaatgtcgtccgggcctctcacctgcttaacaccctgtacaaggccattcttgaatatgacaatgttggagaagcctctgagcaaacctgaccagggaaccctgagagctgaccgtgcacactctctgcctcaggtctccctccttttctctctctgggtggaaacggtgcggccttacctgcagacggtggacgagtggatcgtgcacgggcacctgtgggatggcgccagggagttcatcatccagagaaacaaaaatgttccagttaatcacagagacttctggtatgcaacttacacgttatatagcgtatcagaaaagacagaaaatgaagaaaaaatgagtgataacgctagtgcgagttccggcagtgaccaggggccctccagcaggcagcacaccatggtgtccttcctcaaacctgtcctgaagcagatcataatggctggcaagtcgatgcagctgctgaagaacctgcagtgtgcggagagcaccacctgccaggcaggagccagagatgcagaaagaaaaagtttatacactctctttctggaatctgtacagtcccgtcttcgacatggagaagattccactccacaggttcttactgagcaacaggcaaccaaggagaacctgatgaagatgcagtccattgctgaaagccatcttgaactggatgatgttcatgatccactgcttgccattaactttgcaaggatgtatttggagcagagtgactttcacgagaagtttgctggtggtgatgtatgtgtggatagatcatcggaatctgtgacatgccagacttttgaattaacgctgagatcctgcctctatcctcatattgacaagcagtatctagattgctgtggaaatctcatgcaaactctaaaaaaagattacaggttggtagaatacttgcaagctatgaggaattttttcttaatggaaggaggagataccatgtatgacttctacacgtcaatttttgataaaataagagaaaaggaaacatggcagaatgtgtcttttcttaatgtccaactccaagaagcagtaggacagcgttatcctgaagatagttcacgtctatctatatcttttgaaaatgttgacacagctaagaagaagctgcctgttcatatcttagatggtctgaccctcagctacaaggtcccatggcccgtggacattgttataagtttggaatgtcaaaaaatttataatcaagtgtttcttctcttattgcaaataaagtgggcaaaatatagtctggatgttttactttttggtgaactggttagtactgcagaaaaaccacgacttaaagaaggccttatacatgaacaagacacagttgctcagttcggaccacaaaaagaaccagtaagacagcagattcatcgcatgttcctcttaagagtgaagctcatgcatttcgtgaacagcttgcacaactacatcatgaccaggattctacacagtacagggctggagtttcaacatcaagtcgaggaagccaaggatttagatcaattgattaaaattcactataggtatctgtcaaccatccatgaccggtgtctgctgagagaaaaggtcagctttgtgaaagaagctatcatgaaggtgttgaacttggctctcatgtttgcagacggttggcaggcaggcctgggcacttggcgaatggaatctatagagaaaatggaatctgattttaaaaactgccatatgtttcttgtaaccattttaaacaaagccgtctgtagaggatcctttccccattgtgagtatatcatgttaaaatatttctacctctgtatttccttgtaactaagtgtatgtgtcattgttttgttactgatcccatgaagaattagaaattctcaccattttcaaaactgaaaagtcccttagcagttgtcccatgctttgaattgctttttaagcattacggtgaggtgagtgtaagcctgaggatcttactttctggtataccatttattacaacagatttctaaaactcctattaaataaagttgatggcagaatagatttctgtcacacttcactatcgtgtagtttttgtaactatttcttttcaaa

SEQ ID NO: 76442 - DNA, 980 bp, Homo sapiens
ctcgcgagaatgccgccagctccggaggcgactgcggcaggagcccgagctctcgcgcgacaggcaccaattcgttagacgcgcgctgcaggagcgcggaacatggcgcggcacgggccaccgtggagtcggttggacgcgcagcaggagcgcgacgtgcgggagctcgtccggggtgtcgccggcctccaggacgaggcagaccccaacttccagctcgccctaaacttcgcctggtccaacttcagatttcatcgtttcttggatgtcaacagccacaaaatagaaaaaacaatcgaaggaatttatgaaaaatttgtcattcattctgatctaagcaaagctgctagttggaagagattaacggaggaatttctaaatgcaccacttcccagtataaaggaaataaagacagatgcacattattccatactgtcacttcttctgtgtctgtcagactctccttcaaacagcagttatgtggagacaccaagaaataaagaagtggaaaagaaagatgatttcgactggggaaaatacttgatggaagatgaagaaatggacattggtccgtacatggacacaccaaattggtctgaagaaagtgaagaggaaaatgatcaacagcccttaagcagagaggactctggaattcaggtagacaggacaccgttagaagaacaagatcaaaacagaaaactggatccttgtatcagttggaaagatgagccagatgaccgaagctggctggaacatcatgtggtccatcagtactggacagccaggccctcccagtttcctcatagtttacatttgcactctaatttagctgctgtctgggaccaacacttgtacagcagtgatccattgtatgttccagatgacagggttttggttactgagactcaggttattcgggaaaccctatggtaagaaatgttcatttaattaatagtctttatgagacttgattactgaga

SEQ ID NO: 76443 - DNA, 375 bp, Homo sapiens
ttcatcgtttcttggatgtcaacagccacaaaatagaaaaaacaatcgaagggtaagtcagtgtgtatatatacgcatccagaaatatatgtattttcttatagatctttttaagatagctttataatcttttcttatattttagaatttatgaaaaatttgtcattcattctgatctaagcaaagctgctagttggaagagattaacggaggaatttctaaatgcaccacttcccagtataaaggaaataaaggtatgccttcaattatgagatctccactgtgtattttactgtttcctatctgattatcgtcaatttgtttcagttactgtttaaacattctattttagtattatctactggctaacgggat

SEQ ID NO: 76444 - DNA, 410 bp, Homo sapiens
aaagacagatgcacattattccatactgtcacttcttctgtgtctgtcagactctccttcaaacagcagttatgtggagacaccaagaaataaagaagtgggtatgttactagattccttaacatatgagaagtaaaagagaaattgtttgattacttagttgctaaacactgagttttattgaaacttctaaaaatctgtgaaactaaagtatttctattgctttagatgctatcacaattgtaaaattttatttaaaatgctgtcagccctctatattctcaggttccagacccacagattcaatcaactacagatcaaaaatattcaaaataaataaataataatacaacagtctaaaataatacaatcttttaaaaaactatttacatagcatttacatgatatta

SEQ ID NO: 76445 - DNA, 402 bp, Homo sapiens
tctatctatatcttttgaaaatgttgacacagctaagaagaagctgcctgttcatatcttagatggtctgaccctcagctacaaggtatatgctgatattccttgtatgaaccgtgttttctgctaacattaaaacatgcaagtaattggttactttctaattttgtttttgtttcataggtcccatggcccgtggacattgttataagtttggaatgtcaaaaaatttataatcaagtgtttcttctcttattgcaaataaagtgggcaaaatatagtctggatgttttactttttggtggtaagatttgttttcagcagataaattgtaattttatttaattttagcccttaataaaagaggttaatgggaaagggaagcatacggggatctggaaaaaa

SEQ ID NO: 76446 - DNA, 350 bp, Homo sapiens
catttttgtgactgcccaattttctataatgttatagaagataacctttctgatgatgaaaggaaaacctatgctgtttttattattggaacaagtttaagaggtgttaatatttctaattttagtaaatgtagaatgtaaacttgttccactaaaaacaggttacaaaacctgttgttgatccagaatcctgccttacgaatgccagagatcttagtgtcactcattttctctccattcaggttggtagaatacttgcaagctatgaggaattttttcttaatggaaggaggagataccatgtatgacttctacacgtcaatttttgataaaataagagaaaaggaaac

SEQ ID NO: 76447 - DNA, 710 bp, Homo sapiens
tactgcaggcgctcctcctggccgtgggcttggtccgaggcacttctggcctgaagacagcgccattgagcccctgcagtacaggtgtaggtgcatacatgtacatttccaccatgtgcagctgaaaagtgaaaatatttttattttggtttatttgtaaaacttgtccacagtcagcctggcacagtcgctcatgcctctaatcccagcacgatgggaggccaagacaggcagatcacttgagcccaggagtttgaggccagcctgggcaacatggtgaaacccggtgtctaccaaaaatacaaaatgtatccagacatggtggtgtgtacctgtagtcccagctactcaggaggcaaagatgggaggattacttgagcccaggaggtcaaggctacagtgagccatgattgcactactgcagtgcaacctgggtgacagagtgagaccctgactcagaaagaaccacttgcccacagtccagacagatggattgtaggtgggttttctggagattagtagatactgtatagagttgtatacataaaattgtgtcagtagtacaaagtgtatataggctgtttactcttacatttcctactgtaagatacagatttatggtactgatacctttaaattatatcatattttgaaaatgtaattactgatattcaaaataaattaaaggacttaaaatcaaaaaaaaatcc

SEQ ID NO: 76448 - DNA, 1504 bp, Homo sapiens
tgtgtacacaaatgccaaaatggtgcgtattctagcagtagttttatggacatcaaatgcctgaaagaaagatcaggaagttgtatgtacagttgatctgaaatgcaacaacttgattaggaaaagtgatacaggaaacttttcccactgcaccttccagaggcactgaggttcggttcctgccacccctgccagtgctttctgtggtgccaggaccacatccgtcagtgtttctgccaggcgtcatggtgcagtggggtttgagttgatgctctttctgtccactttgctcttccaatgttttatagaactggttagtactgcagaaaaaccacgacttaaagaaggccttatacatgaacaagacacagttgctcagttcggaccacaaaaagaaccagtaagacagcagattcatcgcatgttcctcttaagagtgaagctcatgcatttcgtgaacagcttgcacaactacatcatgaccaggattctacacagtacagggctggagtttcaacatcaagtcgaggaagccaaggatttagatcaattgattaaaattcactataggtatctgtcaaccatccatgaccggtgtctgctgagagaaaaggtcagctttgtgaaagaagctatcatgaaggtgttgaacttggctctcatgtttgcagacggttggcaggcaggcctgggcacttggcgaatggaatctatagagaaaatggaatctgattttaaaaactgccatatgtttcttgtaaccattttaaacaaagccgtctgtagaggatcctttccccatttggaatctctagcgttgtcactcatggctggcatggaacaaagttaaatgtcttcagcgtaataaatatctccgactttgtcatcatacatgtacatttccaccatgtgcagctgaaaagtgaaaatatttttattttggtttatttgtaaaacttgtccacagtcagcctggcacagtcgctcatgcctctaatcccagcacgatgggaggccaagacaggcagatcacttgagcccaggagtttgaggccagcctgggcaacatggtgaaacccggtgtctaccaaaaatacaaaatgtatccagacatggtggtgtgtacctgtagtcccagctactcaggaggcaaagatgggaggattacttgagcccaggaggtcaaggctacagtgagccatgattgcactactgcagtgcaacctgggtgacagagtgagaccctgactcagaaagaaccacttgcccacagtccagacagatggattgtaggtgggttttctggagattagtagatactgtatagagttgtatacataaaattgtgtcagtagtacaaagtgtatataggctgtttactcttacatttcctactgtaagatacagatttatggtactgatacctttaaattatatcatattttgaaaatgtaattactgatattcaaaataaattaaaggacttaaaatcaaaaaaaaatcc

SEQ ID NO: 76449 - DNA, 226 bp, Homo sapiens
cacactgcagcctgggtgacagagcgagatcctatctaaaaaaaaaaaaaaaaaaaaaaaaaaagcccaacacttttttatctggagaatatttaacatacacaaaaccagagagaatacatatttcaaagtatcactttgtatatgataaatatatatagttttagccaggtgtggtggctcatgtctgtaatcccagcactttgggaggctgaggcgggtggat

SEQ ID NO: 76450 - DNA, 341 bp, Homo sapiens
gcaatgtgagtttcctcatttccatctattgacattaccacatcattcttgtttttccttgtcaatgagcctcctcttttcactaaagtgaagtagccctagccctgaccatgtagcagaatcactggcgagatttttaagaaagttacgttattccaaccctcatcagttctaatttccagatgagctttatgtgtaactggttctgagaagtactgatcagttttgataagttagctttcttaatttactcttagtctgtttcttttcttgtcttaatttttattttattattcctgttaaatgtctataacattttcatccagccagccaacttttat

SEQ ID NO: 76451 - DNA, 1022 bp, Homo sapiens
gccttgtcagccctcaaagatatcagccgtgtttcttaaaagccccatgttttctaaggcccactagaagaaaatctgccaaaagatttgtcgtcggtttcttcgtcggttgtcatgagatagcactactgatctcgtgtttccattaaggggtgcccttggcatcttccccctgggccgtaaccaggcgactatgcttgcccattgtgtgtgtgtgaacacggggggctccctccgcacgcgcaggccggcgtgctttccagggacattcacaacgacgaggagctctgagtgtaatctcttatgataagagtgtcatatttgggagacgacgggatacagagggccgactcggacactggcgagttgggggttgtgctccccgagtccaccgagtctctgaagggggacggcggggtgagagccaccagctcctccaggtctggcttggcggccgcagcctcgggaccggccgcggggctctcccgggccgcgtccccagccgcctgcgcccctgccgcgggctgcgcgcctcccgtgacttcgatggccggcagaggctggatttcggcaaaggtcgtcatggtcgtgggcaactggatctctttggggatcaggtgtccactagcttctggaacatggcagagaagaaatgggccagtttatttacgagatttgattgggaggatggttgccaactacaccctttctcctatcagaaggataagaaacaggtgtttcgaaagttgaacatgatggaacataactttggatgttagcagtaacagtctttggaatcacctgtagccatgccccaaaacatgatagcatgttgcaaaacctctagtgcccatggccataagggagaaagagcaccagaccatctgaataacgtgaaagtggacacaggaaacaccagacacccagagaaatggagtccaaatagaaactcagaccattcttgctggagatacatcaagtgaatacctttgtagatctggacctgacccaaggaagcctgg

SEQ ID NO: 76452 - DNA, 665 bp, Homo sapiens
tgaatgatatatcaatttgaagtttctcgacctttccatcaaggatcttgaattttttctcaattatgcttgctaatgtgtcaaaggccaagtacactgtatcaaacttgccgtctgtaagatgcaagatcaatctagtgtttcagccagttcactactgacatcagactcaactttgtcccctctctttcttttcatgcaagagactttaagggtaacctcttcagttgaaactgtcttggaagtgcagccctcctcctgtgtggctagagaaagagatggcaccaggatctcttaacggcaagtgctcacggggcatgggtgattttgtctagtctggtccttttggacgtggtgatttcctgtcatcctcgtggtctgacattgcttctcactggatactggttgtggcctttgactcattagctgattgttggatctctttgtgaggttcgattttttaaaaatccatgggtccctatggactgtcacctgttgcagatgatggtgattctcttcttttttttgtctccaagcctgggtgacagagcaagactccatttcaaaaaaataaaattaaatatgaccgggcacaagcttatttccttttagcgagggtaaattttatcttgggcacttgccgtcgttttccaaacgtctcaaac

SEQ ID NO: 76453 - DNA, 1012 bp, Homo sapiens
tgaatgatatatcaatttgaagtttctcgacctttccatcaaggatcttgaattttttctcaattatgcttgctaatgtgtcaaaggccaagtacactgtatcaaacttgccgtctgtaagatgcaagatcaatctagtgtttcagccagttcactactgacatcagactcaactttgtcccctctctttcttttcatgcaagagactttaagggtaacctcttcagttgaaactgtcttggaagtgcagccctcctcctgtgtggctagagaaagagatggcaccaggatctcttaacggcaagtgctcacggggcatgggtgattttgtctagtctggtccttttggacgtggtgatttcctgtcatcctcgtggtctgacattgcttctcactggatactggttgtggcctttgactcattagctgattgttggatctctttgtgaggttcgattttttaaaaatccatgggtccctatggactgtcacctgttgcagatgatggtgattctcttcttttttttgtctccaatagttgcctggatgacttcatgggtcagtccacatgattgcaggatttcccattgctcatctgtgaatgttgattggccaacctgtctgagctttcagcagatgcatccttgagcttactttcaggaattcctcctggaattggttttccttggtggtaatttctcatggtggagcttgtttctgaggcatggtacagtgctgcggaggcaaggcaaggctgtcatggtgattttcacagcatctggatggcaaattgccttcacgtagggaaaccacatgggactgatagctttctcaagggatctccaagcatctctgaatttggggatttcatcagttactccagcctgggtgacagagcaagactccatttcaaaaaaataaaattaaatatgaccgggcacaagcttatttccttttagcgagggtaaattttatcttgggcacttgccgtcgttttccaaacgtctcaaac

SEQ ID NO: 76454 - DNA, 1074 bp, Homo sapiens
tgaatgatatatcaatttgaagtttctcgacctttccatcaaggatcttgaattttttctcaattatgcttgctaatgtgtcaaaggccaagtacactgtatcaaacttgccgtctgtaagatgcaagatcaatctagtgtttcagccagttcactactgacatcagactcaactttgtcccctctctttcttttcatgcaagagactttaagggtaacctcttcagttgaaactgtcttggaagtgcagccctcctcctgtgtggctagagaaagagatggcaccaggatctcttaacggcaagtgctcacggggcatgggtgattttgtctagtctggtccttttggacgtggtgatttcctgtcatcctcgtggtctgacattgcttctcactggatactggttgtggcctttgactcattagctgattgttggatctctttgtgaggttcgattttttaaaaatccatgggtccctatggactgtcacctgttgcagatgatggtgattctcttcttttttttgtctccaatagttgcctggatgacttcatgggtcagtccacatgattgcaggatttcccattgctcatctgtgaatgttgattggccaacctgtctgagctttcagcagatgcatccttgagcttactttcaggaattcctcctggaattggttttccttggtggtaatttctcatggtggagcttgtttctgaggcatggtacagtgctgcggaggcaaggcaaggctgtcatggtgattttcacagcatctggatggcaaattgccttcacgtagggaaaccacatgggactgatagctttctcaagggatctccaagcatctctgaatttggggatttcatcagttactcctggaatcaaaatgagtgtggagtcataatatatattttttttgagacaaagtctcactctccagcctgggtgacagagcaagactccatttcaaaaaaataaaattaaatatgaccgggcacaagcttatttccttttagcgagggtaaattttatcttgggcacttgccgtcgttttccaaacgtctcaaac

SEQ ID NO: 76455 - DNA, 495 bp, Homo sapiens
atctggatgaagaaagggtaagctgatacattgacgagtattactcagcaataaaaagaaaccatttatacatgtaacatgaatgaatctcagaaacactatgctgactggaagaaattagacacaaaaatatgcatacgattttatgccatttatataaaatcttaaatatatacaaaatttagccaaagctaatagaactcaggactggggagagattgagtgggaaaggacaggaaggagctttcctagagtgacagaaaagtcctatattttgataagtgttcaacagtatgccttaatttttaaaagtttaatgggtaaaagggaaacacaaattgcaaagtttctggaaaatgatgataagaaaagtactacataatactacataccagaatctgtggaatacatttaaagcagtgagcagaggaaaattcatagccctaaacacttacataaatgaaaataaattcccaattcagaaatgaacaaagt

SEQ ID NO: 76456 - DNA, 1369 bp, Homo sapiens
agagtttacacatctgttcacttttgctccaatatgctcttttgacttaacgtcaagctttgggttgatgtgggtagggtagtgtcaaactgctttgagaggaatgggaccagttctgctgcctaagaaggtctgtctggatgtttataggcagcacctctgaagtggcctaaattcaccctgatctgatagttttcctgcttagaaagtgtgccttggccagatcagtatcccacatgggagtgttccctaggttgtagctgtgattgtttccagatgaccagattgtttttctgaaaatgagcatatttttagtcatgtcgattagctgttcttctacatcacattgttactctttctgatgatgattctagggttaacattggaaccatctcaaaataattacaaagttttagatgggtttacaatgtcttctaaacaatgtaatctaaaaataattgagtcagatgctaacgagatactgcaggcataactgctgtttttctgacaactgattgtgaaaccttaaaacctgcatacctcttcttacagtgaggagtatgcaaaatctggaaagatattctattttttttatataggtagataggatcgccatttatttcctatttagatatactgacattcatccatatgaaaatatgcaggtcattagcttactataatttacttttgacttaatggggcataaataaaactttcatagtacacatgaggtggatatttgatacacagaacatttgcggtgggctttctgtgggttagatgtaaagcccacatattttaatattcactattttaaatgagcaatgcatgaggggaatgcagtgtcagtacctggcctatttttaaactagtgtaatcaccctagtcataccattcagtatgtttgctttttaaaataagtaaccacaattaagttgttgtagcccttgcacttcaagagatctagtctttactttcagttgtctgttaggtccattctgtttactagacggatgttaataaaaactatgcgagcctgaatgaattctcagccaaatttagtcttgtctctcatcttgattggattaattccaaattctaaaatgattcagtccacaatagctctaggggatgaagaatttgccttactttgcccagttcctaagactgtgagttgtcaaatccctagactgtaagctcttcaaggagcaagaggcgcattttctccgtgtcatgtaatttttctaaggtgtttggcagcactctgtaccctgtggagtactcagtaccttttgtttgatgttgctgacaagacctgaaaaaaaatcccttaaaaaaaaaacccattaaagtgtagcaaaaccga

SEQ ID NO: 76457 - DNA, 1513 bp, Homo sapiens
agagtttacacatctgttcacttttgctccaatatgctcttttgacttaacgtcaagctttgggttgatgtgggtagggtagtgtcaaactgctttgagaggaatgggaccagttctgctgcctaagaaggtctgtctggatgtttataggcagcacctctgaagtggcctaaattcaccctgatctgatagttttcctgcttagaaagtgtgccttggccagatcagtatcccacatgggagtgttccctaggttgtagctgtgattgtttccagatgaccagattgtttttctgaaaatgagcatatttttagtcatgtcgattagctgttcttctacatcacattgttactctttctgatgatgattctagggttaacattggaaccatctcaaaataattacaaagttttagatgggtttacaatgtcttctaaacaatgtaatctaaaaataattgagtcagatgctaacgagatactgcaggcataactgctgtttttctgacaactgattgtgaaaccttaaaacctgcatacctcttcttacagtgaggagtatgcaaaatctggaaagatattctattttttttatataggtagataggatcgccatttatttcctatttagatatactgacattcatccatatgaaaatatgcaggtcattagcttactataatttacttttgacttaatggggcataaataaaactttcatagtacacatgaggtggatatttgatacacagaacatttgcggtgggctttctgtgggttagatgtaaagcccacatattttaatattcactattttaaatgagcaatgcatgaggggaatgcagtgtcagtacctggcctatttttaaactagtgtaatcaccctagtcataccattcagtatgtttgctttttaaaataagtaaccacaattaagttgttgtagcccttgcacttcaagagatctagtctttactttcagttgtctgttaggtccattctgtttactagacggatgttaataaaaactatgcgagcctgaatgaattctcagccaaatttagtcttgtctctcatcttgattggattaattccaaattctaaaatgattcagtccacaatagctctaggggatgaagaatttgccttactttgcccagttcctaagactgtgagttgtcaaatccctagactgtaagctcttcaaggagcaagaggcgcattttctccgtgtcatgtaatttttctaaggtgtttggcagcactctgtaccctgtggagtactcagtaccttttgtttgatgttgctgacaagacctgaaaaaaaatcccttaaaaaaaaaacccattaaagtgtagcaaaaccgatgtattattttttctcttttctcataaaccataagatatgtatatcaaaatgataatttatatgaagcatctgctatccttcacataagtatagtttatatgaactacaaatacctttcatcaacattaaagaagcttaaattg

SEQ ID NO: 76458 - DNA, 1046 bp, Homo sapiens
agagtttacacatctgttcacttttgctccaatatgctcttttgacttaacgtcaagctttgggttgatgtgggtagggtagtgtcaaactgctttgagaggaatgggaccagttctgctgcctaagaaggtctgtctggatgtttataggcagcacctctgaagtggcctaaattcaccctgatctgatagttttcctgcttagaaagtgtgccttggccagatcagtatcccacatgggagtgttccctaggttgtagctgtgattgtttccagatgaccagattgtttttctgaaaatgagcatatttttagtcatgtcgattagctgttcttctacatcacattgttactctttctgatgatgattctagggttaacattggaaccatctcaaaataattacaaagttttagatgggtttacaatgtcttctaaacaatgtaatctaaaaataattgagtcagatgctaacgagatactgcaggcataactgctgtttttctgacaactgattgtgaaaccttaaaacctgcatacctcttcttacagtgaggagtatgcaaaatctggaaagatattctattttttttatataggtagataggatcgccatttatttcctatttagatatactgacattcatccatatgaaaatatgcaggtcattagcttactataatttacttttgacttaatggggcataaataaaactttcatagtacacatgaggtggatatttgatacacagaacatttgcggtgggctttctgtgggttagatgtaaagcccacatattttaatattcactattttaaatgagcaatgcatgaggggaatgcagtgtcagtacctggcctatttttaaactagtgtaatcaccctagtcataccattcagtatgtttgctttttaaaataagtaaccacaattaagttgttgtagcccttgcacttcaagagatctagtctttactttcagttgtctgttaggtccattctgtttactagacggatgttaataaaaactatgcgagcctgaatg

SEQ ID NO: 76459 - DNA, 795 bp, Homo sapiens
tcgggataatatctatggattatatggggagagtggatcgccaggtaagggtataagatatactgacattcatccatatgaaaatatgcaggtcattagcttactataatttacttttgacttaatggggcataaataaaactttcatagtacacatgaggtggatatttgatacacagaacatttgcggtgggctttctgtgggttagatgtaaagcccacatattttaatattcactattttaaatgagcaatgcatgaggggaatgcagtgtcagtacctggcctatttttaaactagtgtaatcaccctagtcataccattcagtatgtttgctttttaaaataagtaaccacaattaagttgttgtagcccttgcacttcaagagatctagtctttactttcagttgtctgttaggtccattctgtttactagacggatgttaataaaaactatgcgagcctgaatgaattctcagccaaatttagtcttgtctctcatcttgattggattaattccaaattctaaaatgattcagtccacaatagctctaggggatgaagaatttgccttactttgcccagttcctaagactgtgagttgtcaaatccctagactgtaagctcttcaaggagcaagaggcgcattttctccgtgtcatgtaatttttctaaggtgtttggcagcactctgtaccctgtggagtactcagtaccttttgtttgatgttgctgacaagacctgaaaaaaaatcccttaaaaaaaaaacccattaaagtgtagcaaaaccga

SEQ ID NO: 76460 - DNA, 1601 bp, Homo sapiens
agagtttacacatctgttcacttttgctccaatatgctcttttgacttaacgtcaagctttgggttgatgtgggtagggtagtgtcaaactgctttgagaggaatgggaccagttctgctgcctaagaaggtctgtctggatgtttataggcagcacctctgaagtggcctaaattcaccctgatctgatagttttcctgcttagaaagtgtgccttggccagatcagtatcccacatgggagtgttccctaggttgtagctgtgattgtttccagatgaccagattgtttttctgaaaatgagcatatttttagtcatgtcgattagctgttcttctacatcacattgttactctttctgatgatgattctagggttaacattggaaccatctcaaaataattacaaagttttagatgggtttacaatgtcttctaaacaatgtaatctaaaaataattgagtcagatgctaacgagatactgcaggcataactgctgtttttctgacaactgattgtgaaaccttaaaacctgcatacctcttcttacagtgaggagtatgcaaaatctggaaagatattctattttttttatataggtagataggatcgccatttatttcctatttagatatactgacattcatccatatgaaaatatgcaggtcattagcttactataatttacttttgacttaatggggcataaataaaactttcatagtacacatgaggtggatatttgatacacagaacatttgcggtgggctttctgtgggttagatgtaaagcccacatattttaatattcactattttaaatgagcaatgcatgaggggaatgcagtgtcagtacctggcctatttttaaactagtgtaatcaccctagtcataccattcagtatgtttgctttttaaaataagtaaccacaattaagttgttgtagcccttgcacttcaagagatctagtctttactttcagttgtctgttaggtccattctgtttactagacggatgttaataaaaactatgcgagcctgaatgaattctcagccaaatttagtcttgtctctcatcttgattggattaattccaaattctaaaatgattcagtccacaatagctctaggggatgaagaatttgccttactttgcccagttcctaagactgtgagttgtcaaatccctagactgtaagctcttcaaggagcaagaggcgcattttctccgtgtcatgtaatttttctaaggtgtttggcagcactctgtaccctgtggagtactcagtaccttttgtttgatgttgctgacaagacctgaaaaaaaatcccttaaaaaaaaaacccattaaagtgtagcaaaaccgatgtattattttttctcttttctcataaaccataagatatgtatatcaaaatgataatttatatgaagcatctgctatccttcacataagtatagtttatatgaactacaaatacctttcatcaacattaaagaagcttaaattgaaaaaaccaaaacatctgacaccaaacttactaatcactcactagactaaccatcaacaaccagcatatgaccaatcaaaaaaagagg

SEQ ID NO: 76461 - DNA, 1651 bp, Homo sapiens
agagtttacacatctgttcacttttgctccaatatgctcttttgacttaacgtcaagctttgggttgatgtgggtagggtagtgtcaaactgctttgagaggaatgggaccagttctgctgcctaagaaggtctgtctggatgtttataggcagcacctctgaagtggcctaaattcaccctgatctgatagttttcctgcttagaaagtgtgccttggccagatcagtatcccacatgggagtgttccctaggttgtagctgtgattgtttccagatgaccagattgtttttctgaaaatgagcatatttttagtcatgtcgattagctgttcttctacatcacattgttactctttctgatgatgattctagggttaacattggaaccatctcaaaataattacaaagttttagatgggtttacaatgtcttctaaacaatgtaatctaaaaataattgagtcagatgctaacgagatactgcaggcataactgctgtttttctgacaactgattgtgaaaccttaaaacctgcatacctcttcttacagtgaggagtatgcaaaatctggaaagatattctattttttttatataggtagataggatcgccatttatttcctatttagatatactgacattcatccatatgaaaatatgcaggtcattagcttactataatttacttttgacttaatggggcataaataaaactttcatagtacacatgaggtggatatttgatacacagaacatttgcggtgggctttctgtgggttagatgtaaagcccacatattttaatattcactattttaaatgagcaatgcatgaggggaatgcagtgtcagtacctggcctatttttaaactagtgtaatcaccctagtcataccattcagtatgtttgctttttaaaataagtaaccacaattaagttgttgtagcccttgcacttcaagagatctagtctttactttcagttgtctgttaggtccattctgtttactagacggatgttaataaaaactatgcgagcctgaatgaattctcagccaaatttagtcttgtctctcatcttgattggattaattccaaattctaaaatgattcagtccacaatagctctaggggatgaagaatttgccttactttgcccagttcctaagactgtgagttgtcaaatccctagactgtaagctcttcaaggagcaagaggcgcattttctccgtgtcatgtaatttttctaaggtgtttggcagcactctgtaccctgtggagtactcagtaccttttgtttgatgttgctgacaagacctgaaaaaaaatcccttaaaaaaaaaacccattaaagtgtagcaaaaccgaaaaaaaaaaaaaaaaaaaaaatcctgtggtttgacacaaggatgggcacatatatcaatggaacaaaacagagagtccagaaatggacccacacacttatgatcagttgatttttgacagaggttcaaaggcaatccaatagagaaagcatagtctctcatcgaatggtattgaaacaattggatatacatatgcaaaaaagaatatttatacttcattagaaaataacccaaaatgggtcatagtctaaaatgtaaaatgtaaaactataaagcttctgga

SEQ ID NO: 76462 - DNA, 1097 bp, Homo sapiens
agagtttacacatctgttcacttttgctccaatatgctcttttgacttaacgtcaagctttgggttgatgtgggtagggtagtgtcaaactgctttgagaggaatgggaccagttctgctgcctaagaaggtctgtctggatgtttataggcagcacctctgaagtggcctaaattcaccctgatctgatagttttcctgcttagaaagtgtgccttggccagatcagtatcccacatgggagtgttccctaggttgtagctgtgattgtttccagatgaccagattgtttttctgaaaatgagcatatttttagtcatgtcgattagctgttcttctacatcacattgttactctttctgatgatgattctagggttaacattggaaccatctcaaaataattacaaagttttagatgggtttacaatgtcttctaaacaatgtaatctaaaaataattgagtcagatgctaacgagatactgcaggcataactgctgtttttctgacaactgattgtgaaaccttaaaacctgcatacctcttcttacagtgaggagtatgcaaaatctggaaagatattctattttttttatataggtagataggatcgccatttatttcctatttagatatactgacattcatccatatgaaaatatgcaggtcattagcttactataatttacttttgacttaatggggcataaataaaactttcatagtacacatgaggtggatatttgatacacagaacatttgcggtgggctttctgtgggttagatgtaaagcccacatattttaatattcactattttaaatgagcaatgcatgaggggaatgcagtgtcagtacctggcctatttttaaactagtgtaatcaccctagtcataccattcagtatgtttgctttttaaaataagtaaccacaattaagttgttgtagcccttgcacttcaagagatctagtctttactttcagttgtctgttaggtccattctgtttactagacggatgttaataaaaactatgcgagcctgaatggtatgactagggtgattacactagtttaaaaataggccaggtacgtcgacg

SEQ ID NO: 76463 - DNA, 421 bp, Homo sapiens
tgttaagtccatttagcaagatcacaggatacaagattagtatacaaaaattaacttcttcattcttatactatggttttactgtatagttcatgattacttaatgtaatttttagaaacaaataagctggatgatatttaatcttattcaaacaaagcactttcctttaaagtgatcatcaaaactttaaaacagtgctatttacaatagcataaaaaatatcgccatttatttcctatttagatatactgacattcatccatatgaaaatatgcaggtcattagcttactataatttacttttgacttaatggggcataaataaaactttcatagtacacatgaggtggatatttgatacacagaacatttgcggtgggctttctgtgggttagatgtaaagcccacatattttaatat

SEQ ID NO: 76464 - DNA, 403 bp, Homo sapiens
tgggagtgtcccaattttcccagtacagtctgtcacagcttcccttggctaggaaaggaaaatccactgaccccttgtgcttcctggttgaggtgataccccgccctgctttggctcgccgtccttgggctgcacccactgtccaaccagtcccaatgagatgaaccaggtacctcagttggaaatgcagaaatcacctgtcttcggtgtcgatcatgctgtgagctacagacctgagctgttcctattcagccatcttcgcttgtgctgctttaattaatgtgtacatttgattcatatgctgaatttgctgtggcatcatttcttgattgtttgtatattatctgatagcatgcaatcaatacttgattaaagcttagagtttacatctcctaaactatta

SEQ ID NO: 76465 - DNA, 638 bp, Homo sapiens
ttaaggcattgactattgttttatttctttagcaaaatgagagcaaacaactgcttcctttttagaaagcactccccacatataacaacaatttgttctctctggagggcccagatctatgaccttactaacatccagcaatcccaaatccaagtgcctgtggtaccaggcagataaggtaaagaagtgaagcaggccaagtgagactgcagtggtctggtgctaccattcccatctggaggagcatctgattctaaaccccacccaatttgtgccatgcgggttgctggcccagtgtttccagaacttccagtttttcaagagatgttccatatcccagtttttaaatgtcagatcatattatgaatgctaggccagcgaaataaaacatctgtggagcaaagcaatccacatgttgccattttgtgaccttggccacagcttattcttgccatctattgcaatgtactggtttacattcccacttaaagtgtacatttcattgaacttgcctagggaatgtacctattaggttaaatatccattatctctgtgtgaggtttccttaaggggctaaccataaagctttattatgtgatacctcctttcctttggaacaattaaaaagagtgcaaaga

SEQ ID NO: 76466 - DNA, 3884 bp, Homo sapiens
aacacaggctgagcagtcaggcccacagcatctgaccccaggcccagctcgtcctggctggcctgggtcggcctctggagtatggtctggcgggtgccccctttcttgctccccatcctcttcttggcttctcatgtgggcgcggcggtggacctgacgctgctggccaacctgcggctcacggacccccagcgcttcttcctgacttgcgtgtctggggaggccggggcggggaggggctcggacgcctggggcccgcccctgctgctggagaaggacgaccgtatcgtgcgcaccccgcccgggccacccctgcgcctggcgcgcaacggttcgcaccaggtcacgcttcgcggcttctccaagccctcggacctcgtgggcgtcttctcctgcgtgggcggtgctggggcgcggcgcacgcgcgtcatctacgtgcacaacagccctggagcccacctgcttccagacaaggtcacacacactgtgaacaaaggtgacaccgctgtactttctgcacgtgtgcacaaggagaagcagacagacgtgatctggaagagcaacggatcctacttctacaccctggactggcatgaagcccaggatgggcggttcctgctgcagctcccaaatgtgcagccaccatcgagcggcatctacagtgccacttacctggaagccagccccctgggcagcgccttctttcggctcatcgtgcggggttgtggggctgggcgctgggggccaggctgtaccaaggagtgcccaggttgcctacatggaggtgtctgccacgaccatgacggcgaatgtgtatgcccccctggcttcactggcacccgctgtgaacaggcctgcagagagggccgttttgggcagagctgccaggagcagtgcccaggcatatcaggctgccggggcctcaccttctgcctcccagacccctatggctgctcttgtggatctggctggagaggaagccagtgccaagaagcttgtgcccctggtcattttggggctgattgccgactccagtgccagtgtcagaatggtggcacttgtgaccggttcagtggttgtgtctgcccctctgggtggcatggagtgcactgtgagaagtcagaccggatcccccagatcctcaacatggcctcagaactggagttcaacttagagacgatgccccggatcaactgtgcagctgcagggaaccccttccccgtgcggggcagcatagagctacgcaagccagacggcactgtgctcctgtccaccaaggccattgtggagccagagaagaccacagctgagttcgaggtgccccgcttggttcttgcggacagtgggttctgggagtgccgtgtgtccacatctggcggccaagacagccggcgcttcaaggtcaatgtgaaagtgccccccgtgcccctggctgcacctcggctcctgaccaagcagagccgccagcttgtggtctccccgctggtctcgttctctggggatggacccatctccactgtccgcctgcactaccggccccaggacagtaccatggactggtcgaccattgtggtggaccccagtgagaacgtgacgttaatgaacctgaggccaaagacaggatacagtgttcgtgtgcagctgagccggccaggggaaggaggagagggggcctgggggcctcccaccctcatgaccacagactgtcctgagcctttgttgcagccgtggttggagggctggcatgtggaaggcactgaccggctgcgagtgagctggtccttgcccttggtgcccgggccactggtgggcgacggtttcctgctgcgcctgtgggacgggacacgggggcaggagcggcgggagaacgtctcatccccccaggcccgcactgccctcctgacgggactcacgcctggcacccactaccagctggatgtgcagctctaccactgcaccctcctgggcccggcctcgccccctgcacacgtgcttctgccccccagtgggcctccagccccccgacacctccacgcccaggccctctcagactccgagatccagctgacatggaagcacccggaggctctgcctgggccaatatccaagtacgttgtggaggtgcaggtggctgggggtgcaggagacccactgtggatagacgtggacaggcctgaggagacaagcaccatcatccgtggcctcaacgccagcacgcgctacctcttccgcatgcgggccagcattcaggggctcggggactggagcaacacagtagaagagtccaccctgggcaacgggctgcaggctgagggcccagtccaagagagccgggcagctgaagagggcctggatcagcagctgatcctggcggtggtgggctccgtgtctgccacctgcctcaccatcctggccgcccttttaaccctggtgtgcatccgcagaagctgcctgcatcggagacgcaccttcacctaccagtcaggctcgggcgaggagaccatcctgcagttcagctcagggaccttgacacttacccggcggccaaaactgcagcccgagcccctgagctacccagtgctagagtgggaggacatcacctttgaggacctcatcggggaggggaacttcggccaggtcatccgggccatgatcaagaaggacgggctgaagatgaacgcagccatcaaaatgctgaaagagtatgcctctgaaaatgaccatcgtgactttgcgggagaactggaagttctgtgcaaattggggcatcaccccaacatcatcaacctcctgggggcctgtaagaaccgaggttacttgtatatcgctattgaatatgccccctacgggaacctgctagattttctgcggaaaagccgggtcctagagactgacccagcttttgctcgagagcatgggacagcctctacccttagctcccggcagctgctgcgtttcgccagtgatgcggccaatggcatgcagtacctgagtgagaagcagttcatccacagggacctggctgcccggaatgtgctggtcggagagaacctagcctccaagattgcagacttcggcctttctcggggagaggaggtttatgtgaagaagacgatggggcgtctccctgtgcgctggatggccattgagtccctgaactacagtgtctataccaccaagagtgatgtctggtcctttggagtccttctttgggagatagtgagccttggaggtacaccctactgtggcatgacctgtgccgagctctatgaaaagctgccccagggctaccgcatggagcagcctcgaaactgtgacgatgaagtgtacgagctgatgcgtcagtgctggcgggaccgtccctatgagcgacccccctttgcccagattgcgctacagctaggccgcatgctggaagccaggaaggcctatgtgaacatgtcgctgtttgagaacttcacttacgcgggcattgatgccacagctgaggaggcctgagctgccatccagccagaacgtggctctgctggccggagcaaactctgctgtctaacctgtgaccagtctgacccttacagcctctgacttaagctgcctcaaggaatttttttaacttaagggagaaaaaaagggatctggggatggggtgggcttaggggaactgggttcccatgctttgtaggtgtctcatagctatcctgggcatccttctttctagttcagctgccccacaggtgtgtttcccatcccactgctcccccaacacaaacccccactccagctccttcgcttaagccagcactcacaccactaacatgccctgttcagctactcccactcccggcctgtcattcagaaaaaaataaatgttctaataagctcca

SEQ ID NO: 76467 - DNA, 3755 bp, Homo sapiens
aacacaggctgagcagtcaggcccacagcatctgaccccaggcccagctcgtcctggctggcctgggtcggcctctggagtatggtctggcgggtgccccctttcttgctccccatcctcttcttggcttctcatgtgggcgcggcggtggacctgacgctgctggccaacctgcggctcacggacccccagcgcttcttcctgacttgcgtgtctggggaggccggggcggggaggggctcggacgcctggggcccgcccctgctgctggagaaggacgaccgtatcgtgcgcaccccgcccgggccacccctgcgcctggcgcgcaacggttcgcaccaggtcacgcttcgcggcttctccaagccctcggacctcgtgggcgtcttctcctgcgtgggcggtgctggggcgcggcgcacgcgcgtcatctacgtgcacaacagccctggagcccacctgcttccagacaaggtcacacacactgtgaacaaaggtgacaccgctgtactttctgcacgtgtgcacaaggagaagcagacagacgtgatctggaagagcaacggatcctacttctacaccctggactggcatgaagcccaggatgggcggttcctgctgcagctcccaaatgtgcagccaccatcgagcggcatctacagtgccacttacctggaagccagccccctgggcagcgccttctttcggctcatcgtgcggggttgtggggctgggcgctgggggccaggctgtaccaaggagtgcccaggttgcctacatggaggtgtctgccacgaccatgacggcgaatgtgtatgcccccctggcttcactggcacccgctgtgaacaggcctgcagagagggccgttttgggcagagctgccaggagcagtgcccaggcatatcaggctgccggggcctcaccttctgcctcccagacccctatggctgctcttgtggatctggctggagaggaagccagtgccaagaagaccggatcccccagatcctcaacatggcctcagaactggagttcaacttagagacgatgccccggatcaactgtgcagctgcagggaaccccttccccgtgcggggcagcatagagctacgcaagccagacggcactgtgctcctgtccaccaaggccattgtggagccagagaagaccacagctgagttcgaggtgccccgcttggttcttgcggacagtgggttctgggagtgccgtgtgtccacatctggcggccaagacagccggcgcttcaaggtcaatgtgaaagtgccccccgtgcccctggctgcacctcggctcctgaccaagcagagccgccagcttgtggtctccccgctggtctcgttctctggggatggacccatctccactgtccgcctgcactaccggccccaggacagtaccatggactggtcgaccattgtggtggaccccagtgagaacgtgacgttaatgaacctgaggccaaagacaggatacagtgttcgtgtgcagctgagccggccaggggaaggaggagagggggcctgggggcctcccaccctcatgaccacagactgtcctgagcctttgttgcagccgtggttggagggctggcatgtggaaggcactgaccggctgcgagtgagctggtccttgcccttggtgcccgggccactggtgggcgacggtttcctgctgcgcctgtgggacgggacacgggggcaggagcggcgggagaacgtctcatccccccaggcccgcactgccctcctgacgggactcacgcctggcacccactaccagctggatgtgcagctctaccactgcaccctcctgggcccggcctcgccccctgcacacgtgcttctgccccccagtgggcctccagccccccgacacctccacgcccaggccctctcagactccgagatccagctgacatggaagcacccggaggctctgcctgggccaatatccaagtacgttgtggaggtgcaggtggctgggggtgcaggagacccactgtggatagacgtggacaggcctgaggagacaagcaccatcatccgtggcctcaacgccagcacgcgctacctcttccgcatgcgggccagcattcaggggctcggggactggagcaacacagtagaagagtccaccctgggcaacgggctgcaggctgagggcccagtccaagagagccgggcagctgaagagggcctggatcagcagctgatcctggcggtggtgggctccgtgtctgccacctgcctcaccatcctggccgcccttttaaccctggtgtgcatccgcagaagctgcctgcatcggagacgcaccttcacctaccagtcaggctcgggcgaggagaccatcctgcagttcagctcagggaccttgacacttacccggcggccaaaactgcagcccgagcccctgagctacccagtgctagagtgggaggacatcacctttgaggacctcatcggggaggggaacttcggccaggtcatccgggccatgatcaagaaggacgggctgaagatgaacgcagccatcaaaatgctgaaagagtatgcctctgaaaatgaccatcgtgactttgcgggagaactggaagttctgtgcaaattggggcatcaccccaacatcatcaacctcctgggggcctgtaagaaccgaggttacttgtatatcgctattgaatatgccccctacgggaacctgctagattttctgcggaaaagccgggtcctagagactgacccagcttttgctcgagagcatgggacagcctctacccttagctcccggcagctgctgcgtttcgccagtgatgcggccaatggcatgcagtacctgagtgagaagcagttcatccacagggacctggctgcccggaatgtgctggtcggagagaacctagcctccaagattgcagacttcggcctttctcggggagaggaggtttatgtgaagaagacgatggggcgtctccctgtgcgctggatggccattgagtccctgaactacagtgtctataccaccaagagtgatgtctggtcctttggagtccttctttgggagatagtgagccttggaggtacaccctactgtggcatgacctgtgccgagctctatgaaaagctgccccagggctaccgcatggagcagcctcgaaactgtgacgatgaagtgtacgagctgatgcgtcagtgctggcgggaccgtccctatgagcgacccccctttgcccagattgcgctacagctaggccgcatgctggaagccaggaaggcctatgtgaacatgtcgctgtttgagaacttcacttacgcgggcattgatgccacagctgaggaggcctgagctgccatccagccagaacgtggctctgctggccggagcaaactctgctgtctaacctgtgaccagtctgacccttacagcctctgacttaagctgcctcaaggaatttttttaacttaagggagaaaaaaagggatctggggatggggtgggcttaggggaactgggttcccatgctttgtaggtgtctcatagctatcctgggcatccttctttctagttcagctgccccacaggtgtgtttcccatcccactgctcccccaacacaaacccccactccagctccttcgcttaagccagcactcacaccactaacatgccctgttcagctactcccactcccggcctgtcattcagaaaaaaataaatgttctaataagctcca

SEQ ID NO: 76468 - DNA, 3875 bp, Homo sapiens
aacacaggctgagcagtcaggcccacagcatctgaccccaggcccagctcgtcctggctggcctgggtcggcctctggagtatggtctggcgggtgccccctttcttgctccccatcctcttcttggcttctcatgtgggcgcggcggtggacctgacgctgctggccaacctgcggctcacggacccccagcgcttcttcctgacttgcgtgtctggggaggccggggcggggaggggctcggacgcctggggcccgcccctgctgctggagaaggacgaccgtatcgtgcgcaccccgcccgggccacccctgcgcctggcgcgcaacggttcgcaccaggtcacgcttcgcggcttctccaagccctcggacctcgtgggcgtcttctcctgcgtgggcggtgctggggcgcggcgcacgcgcgtcatctacgtgcacaacagccctggagcccacctgcttccagacaaggtcacacacactgtgaacaaaggtgacaccgctgtactttctgcacgtgtgcacaaggagaagcagacagacgtgatctggaagagcaacggatcctacttctacaccctggactggcatgaagcccaggatgggcggttcctgctgcagctcccaaatgtgcagccaccatcgagcggcatctacagtgccacttacctggaagccagccccctgggcagcgccttctttcggctcatcgtgcggggttgtggggctgggcgctgggggccaggctgtaccaaggagtgcccaggttgcctacatggaggtgtctgccacgaccatgacggcgaatgtgtatgcccccctggcttcactggcacccgctgtgaacaggcctgcagagagggccgttttgggcagagctgccaggagcagtgcccaggcatatcaggctgccggggcctcaccttctgcctcccagacccctatggctgctcttgtggatctggctggagaggaagccagtgccaagaagaccggatcccccagatcctcaacatggcctcagaactggagttcaacttagagacgatgccccggatcaactgtgcagctgcagggaaccccttccccgtgcggggcagcatagagctacgcaagccagacggcactgtgctcctgtccaccaaggccattgtggagccagagaagaccacagctgagttcgaggtgccccgcttggttcttgcggacagtgggttctgggagtgccgtgtgtccacatctggcggccaagacagccggcgcttcaaggtcaatgtgaaagtgccccccgtgcccctggctgcacctcggctcctgaccaagcagagccgccagcttgtggtctccccgctggtctcgttctctggggatggacccatctccactgtccgcctgcactaccggccccaggacagtaccatggactggtcgaccattgtggtggaccccagtgagaacgtgacgttaatgaacctgaggccaaagacaggatacagtgttcgtgtgcagctgagccggccaggggaaggaggagagggggcctgggggcctcccaccctcatgaccacagactgtcctgagcctttgttgcagccgtggttggagggctggcatgtggaaggcactgaccggctgcgagtgagctggtccttgcccttggtgcccgggccactggtgggcgacggtttcctgctgcgcctgtgggacgggacacgggggcaggagcggcgggagaacgtctcatccccccaggcccgcactgccctcctgacgggactcacgcctggcacccactaccagctggatgtgcagctctaccactgcaccctcctgggcccggcctcgccccctgcacacgtgcttctgccccccagtgggcctccagccccccgacacctccacgcccaggccctctcagactccgagatccagctgacatggaagcacccggaggctctgcctgggccaatatccaagtacgttgtggaggtgcaggtggctgggggtgcaggagacccactgtggatagacgtggacaggcctgaggagacaagcaccatcatccgtggcctcaacgccagcacgcgctacctcttccgcatgcgggccagcattcaggggctcggggactggagcaacacagtagaagagtccaccctgggcaacgggctgcaggctgagggcccagtccaagagagccgggcagctgaagagggcctggatcagcagctgatcctggcggtggtgggctccgtgtctgccacctgcctcaccatcctggccgcccttttaaccctggtgtgcatccgcagaagctgcctgcatcggagacgcaccttcacctaccagtcaggctcgggcgaggagaccatcctgcagttcagctcagggaccttgacacttacccggcggccaaaactgcagcccgagcccctgagctacccagtgctagagtgggaggacatcacctttgaggacctcatcggggaggggaacttcggccaggtcatccgggccatgatcaagaaggacgggctgaagatgaacgcagccatcaaaatgctgaaagagtatgcctctgaaaatgaccatcgtgactttgcgggagaactggaagttctgtgcaaattggggcatcaccccaacatcatcaacctcctgggggcctgtaagaaccgaggttacttgtatatcgctattgaatatgccccctacgggaacctgctagattttctgcggaaaagccgggtcctagagactgacccagcttttgctcgagagcatgggacagcctctacccttagctcccggcagctgctgcgtttcgccagtgatgcggccaatggcatgcagtacctgagtgagaagcagttcatccacagggacctggctgcccggaatgtgctggtcggagagaacctagcctccaagattgcagacttcggcctttctcggggagaggaggtttatgtgaagaagacgatggggcgtctccctgtgcgctggatggccattgagtccctgaactacagtgtctataccaccaagagtgatgtctggtcctttggagtccttctttgggagatagtgagccttggaggtacaccctactgtggcatgacctgtgccgagctctatgaaaagctgccccagggctaccgcatggagcagcctcgaaactgtgacgatgaagtgtacgagctgatgcgtcagtgctggcgggaccgtccctatgagcgacccccctttgcccagattgcgctacagctaggccgcatgctggaagccaggaaggcctatgtgaacatgtcgctgtttgagaacttcacttacgcgggcattgatgccacagctgaggaggcctgagctgccatccagccagaacgtggctctgctggccggagcaaactctgctgtctaacctgtgaccagtctgacccttacagcctctgacttaagctgcctcaaggaatttttttaacttaagggagaaaaaaagggatctggggatggggtgggcttaggggaactgggttcccatgctttgtaggtgtctcatagctatcctgggcatccttctttctagttcagctgccccacaggtgtgtttcccatcccactgctcccccaacacaaacccccactccagctccttcgcttaagccagcactcacaccactaacatgccctgttcagctactcccactcccggcctgtcattcagaaaaaaataaatgttctaataagctccaaaaaaacggcacgagctcgtgccgaattcaacgcggtataccttaccagcaacatctacatctttgtgagtttgttcgaaattaaattgaaatacatttgacatctatttccactctcca

SEQ ID NO: 76469 - DNA, 3865 bp, Homo sapiens
aacacaggctgagcagtcaggcccacagcatctgaccccaggcccagctcgtcctggctggcctgggtcggcctctggagtatggtctggcgggtgccccctttcttgctccccatcctcttcttggcttctcatgtgggcgcggcggtggacctgacgctgctggccaacctgcggctcacggacccccagcgcttcttcctgacttgcgtgtctggggaggccggggcggggaggggctcggacgcctggggcccgcccctgctgctggagaaggacgaccgtatcgtgcgcaccccgcccgggccacccctgcgcctggcgcgcaacggttcgcaccaggtcacgcttcgcggcttctccaagccctcggacctcgtgggcgtcttctcctgcgtgggcggtgctggggcgcggcgcacgcgcgtcatctacgtgcacaacagccctggagcccacctgcttccagacaaggtcacacacactgtgaacaaaggtgacaccgctgtactttctgcacgtgtgcacaaggagaagcagacagacgtgatctggaagagcaacggatcctacttctacaccctggactggcatgaagcccaggatgggcggttcctgctgcagctcccaaatgtgcagccaccatcgagcggcatctacagtgccacttacctggaagccagccccctgggcagcgccttctttcggctcatcgtgcggggttgtggggctgggcgctgggggccaggctgtaccaaggagtgcccaggttgcctacatggaggtgtctgccacgaccatgacggcgaatgtgtatgcccccctggcttcactggcacccgctgtgaacaggcctgcagagagggccgttttgggcagagctgccaggagcagtgcccaggcatatcaggctgccggggcctcaccttctgcctcccagacccctatggctgctcttgtggatctggctggagaggaagccagtgccaagaagaccggatcccccagatcctcaacatggcctcagaactggagttcaacttagagacgatgccccggatcaactgtgcagctgcagggaaccccttccccgtgcggggcagcatagagctacgcaagccagacggcactgtgctcctgtccaccaaggccattgtggagccagagaagaccacagctgagttcgaggtgccccgcttggttcttgcggacagtgggttctgggagtgccgtgtgtccacatctggcggccaagacagccggcgcttcaaggtcaatgtgaaagtgccccccgtgcccctggctgcacctcggctcctgaccaagcagagccgccagcttgtggtctccccgctggtctcgttctctggggatggacccatctccactgtccgcctgcactaccggccccaggacagtaccatggactggtcgaccattgtggtggaccccagtgagaacgtgacgttaatgaacctgaggccaaagacaggatacagtgttcgtgtgcagctgagccggccaggggaaggaggagagggggcctgggggcctcccaccctcatgaccacagactgtcctgagcctttgttgcagccgtggttggagggctggcatgtggaaggcactgaccggctgcgagtgagctggtccttgcccttggtgcccgggccactggtgggcgacggtttcctgctgcgcctgtgggacgggacacgggggcaggagcggcgggagaacgtctcatccccccaggcccgcactgccctcctgacgggactcacgcctggcacccactaccagctggatgtgcagctctaccactgcaccctcctgggcccggcctcgccccctgcacacgtgcttctgccccccagtgggcctccagccccccgacacctccacgcccaggccctctcagactccgagatccagctgacatggaagcacccggaggctctgcctgggccaatatccaagtacgttgtggaggtgcaggtggctgggggtgcaggagacccactgtggatagacgtggacaggcctgaggagacaagcaccatcatccgtggcctcaacgccagcacgcgctacctcttccgcatgcgggccagcattcaggggctcggggactggagcaacacagtagaagagtccaccctgggcaacgggctgcaggctgagggcccagtccaagagagccgggcagctgaagagggcctggatcagcagctgatcctggcggtggtgggctccgtgtctgccacctgcctcaccatcctggccgcccttttaaccctggtgtgcatccgcagaagctgcctgcatcggagacgcaccttcacctaccagtcaggctcgggcgaggagaccatcctgcagttcagctcagggaccttgacacttacccggcggccaaaactgcagcccgagcccctgagctacccagtgctagagtgggaggacatcacctttgaggacctcatcggggaggggaacttcggccaggtcatccgggccatgatcaagaaggacgggctgaagatgaacgcagccatcaaaatgctgaaagagtatgcctctgaaaatgaccatcgtgactttgcgggagaactggaagttctgtgcaaattggggcatcaccccaacatcatcaacctcctgggggcctgtaagaaccgaggttacttgtatatcgctattgaatatgccccctacgggaacctgctagattttctgcggaaaagccgggtcctagagactgacccagcttttgctcgagagcatgggacagcctctacccttagctcccggcagctgctgcgtttcgccagtgatgcggccaatggcatgcagtacctgagtgagaagcagttcatccacagggacctggctgcccggaatgtgctggtcggagagaacctagcctccaagattgcagacttcggcctttctcggggagaggaggtttatgtgaagaagacgatggtgagtctcattcaaccctcacccttagggcttgtgcctggccctgccccacaggagcctcaaacaggcccttcctccacactcagcccctcaaacccattctctcctaggggcgtctccctgtgcgctggatggccattgagtccctgaactacagtgtctataccaccaagagtgatgtctggtcctttggagtccttctttgggagatagtgagccttggaggtacaccctactgtggcatgacctgtgccgagctctatgaaaagctgccccagggctaccgcatggagcagcctcgaaactgtgacgatgaagtgtacgagctgatgcgtcagtgctggcgggaccgtccctatgagcgacccccctttgcccagattgcgctacagctaggccgcatgctggaagccaggaaggcctatgtgaacatgtcgctgtttgagaacttcacttacgcgggcattgatgccacagctgaggaggcctgagctgccatccagccagaacgtggctctgctggccggagcaaactctgctgtctaacctgtgaccagtctgacccttacagcctctgacttaagctgcctcaaggaatttttttaacttaagggagaaaaaaagggatctggggatggggtgggcttaggggaactgggttcccatgctttgtaggtgtctcatagctatcctgggcatccttctttctagttcagctgccccacaggtgtgtttcccatcccactgctcccccaacacaaacccccactccagctccttcgcttaagccagcactcacaccactaacatgccctgttcagctactcccactcccggcctgtcattcagaaaaaaataaatgttctaataagctcca

SEQ ID NO: 76470 - DNA, 3719 bp, Homo sapiens
aacacaggctgagcagtcaggcccacagcatctgaccccaggcccagctcgtcctggctggcctgggtcggcctctggagtatggtctggcgggtgccccctttcttgctccccatcctcttcttggcttctcatgtgggcgcggcggtggacctgacgctgctggccaacctgcggctcacggacccccagcgcttcttcctgacttgcgtgtctggggaggccggggcggggaggggctcggacgcctggggcccgcccctgctgctggagaaggacgaccgtatcgtgcgcaccccgcccgggccacccctgcgcctggcgcgcaacggttcgcaccaggtcacgcttcgcggcttctccaagccctcggacctcgtgggcgtcttctcctgcgtgggcggtgctggggcgcggcgcacgcgcgtcatctacgtgcacaacagccctggagcccacctgcttccagacaaggtcacacacactgtgaacaaaggtgacaccgctgtactttctgcacgtgtgcacaaggagaagcagacagacgtgatctggaagagcaacggatcctacttctacaccctggactggcatgaagcccaggatgggcggttcctgctgcagctcccaaatgtgcagccaccatcgagcggcatctacagtgccacttacctggaagccagccccctgggcagcgccttctttcggctcatcgtgcggggttgtggggctgggcgctgggggccaggctgtaccaaggagtgcccaggttgcctacatggaggtgtctgccacgaccatgacggcgaatgtgtatgcccccctggcttcactggcacccgctgtgaacaggcctgcagagagggccgttttgggcagagctgccaggagcagtgcccaggcatatcaggctgccggggcctcaccttctgcctcccagacccctatggctgctcttgtggatctggctggagaggaagccagtgccaagaagaccggatcccccagatcctcaacatggcctcagaactggagttcaacttagagacgatgccccggatcaactgtgcagctgcagggaaccccttccccgtgcggggcagcatagagctacgcaagccagacggcactgtgctcctgtccaccaaggccattgtggagccagagaagaccacagctgagttcgaggtgccccgcttggttcttgcggacagtgggttctgggagtgccgtgtgtccacatctggcggccaagacagccggcgcttcaaggtcaatgtgaaagtgccccccgtgcccctggctgcacctcggctcctgaccaagcagagccgccagcttgtggtctccccgctggtctcgttctctggggatggacccatctccactgtccgcctgcactaccggccccaggacagtaccatggactggtcgaccattgtggtggaccccagtgagaacgtgacgttaatgaacctgaggccaaagacaggatacagtgttcgtgtgcagctgagccggccaggggaaggaggagagggggcctgggggcctcccaccctcatgaccacagactgtcctgagcctttgttgcagccgtggttggagggctggcatgtggaaggcactgaccggctgcgagtgagctggtccttgcccttggtgcccgggccactggtgggcgacggtttcctgctgcgcctgtgggacgggacacgggggcaggagcggcgggagaacgtctcatccccccaggcccgcactgccctcctgacgggactcacgcctggcacccactaccagctggatgtgcagctctaccactgcaccctcctgggcccggcctcgccccctgcacacgtgcttctgccccccagtgggcctccagccccccgacacctccacgcccaggccctctcagactccgagatccagctgacatggaagcacccggaggctctgcctgggccaatatccaagtacgttgtggaggtgcaggtggctgggggtgcaggagacccactgtggatagacgtggacaggcctgaggagacaagcaccatcatccgtggcctcaacgccagcacgcgctacctcttccgcatgcgggccagcattcaggggctcggggactggagcaacacagtagaagagtccaccctgggcaacgggctgcaggctgagggcccagtccaagagagccgggcagctgaagagggcctggatcagcagctgatcctggcggtggtgggctccgtgtctgccacctgcctcaccatcctggccgcccttttaaccctggtgtgcatccgcagaagctgcctgcatcggagacgcaccttcacctaccagtcaggctcgggcgaggagaccatcctgcagttcagctcagggaccttgacacttacccggcggccaaaactgcagcccgagcccctgagctacccagtgctagagtgggaggacatcacctttgaggacctcatcggggaggggaacttcggccaggtcatccgggccatgatcaagaaggacgggctgaagatgaacgcagccatcaaaatgctgaaagagtatgcctctgaaaatgaccatcgtgactttgcgggagaactggaagttctgtgcaaattggggcatcaccccaacatcatcaacctcctgggggcctgtaagaaccgaggttacttgtatatcgctattgaatatgccccctacgggaacctgctagattttctgcggaaaagccgggtcctagagactgacccagcttttgctcgagagcatgggacagcctctacccttagctcccggcagctgctgcgtttcgccagtgatgcggccaatggcatgcagtacctgagtgagaagcagttcatccacagggacctggctgcccggaatgtgctggtcggagagaacctagcctccaagattgcagacttcggcctttctcggggagaggaggtttatgtgaagaagacgatggtgagtctcattcaaccctcacccttagggcttgtgcctggccctgccccacaggagcctcaaacaggcccttcctccacactcagcccctcaaacccattctctcctaggggcgtctccctgtgcgctggatggccattgagtccctgaactacagtgtctataccaccaagagtgatgtggcaaggtcatgcccacctgaggatcttaccagagcatgacccccaagactccctctctgtgccccctcccctgcagacagccctcttggcacactcctcctgtctctccagggatgtccatcttgatctgaacctaccccttgccccaagccctttggccttgcctgcatggctcactgcttaccacactgatcactcctctgaccactacatgcctacttcgtgcttctgccccaacactcccttgattccctccaccccctttgaactctctcccctggtctcagggctgatgcacactacacagaggctgttaaagtgtgagatgcagtcaagagtaagagctttggagcctgagttggaacgcttgctctgccactaactagctgtatggccttgggcaatctagctaacctctcagtgcctcagtgtcttcatctgtaaaatggcaagactaatagaacctgtatcatagggttggtgtgagggttaaatgaattaacatgtctgttaaatgaccagggcctggaccacggtaagtgctcaata

SEQ ID NO: 76471 - DNA, 164 bp, Homo sapiens
gtgagtagggagagagctggggcaggacagaggtgttgggtaatagtgaagggatacagtgagcaggagagggagggcaaatggtgcgagggggctgaagggagcatggcagcttctagaagaggtgggggctgaataatgtgtgctttacaccccacgcccag

SEQ ID NO: 76472 - DNA, 318 bp, Homo sapiens
ctcgtgtgcctgtctgtgcctccttccgccccctttgactcttgcgtggaccgtctaccctcttgtctcatcctgtgaagggcgaggagaccatcctgcagttcagctcagggaccttgacacttacccggcggccaaaactgcagcccgagcccctgagctacccagtgctagagtgggaggacatcacctttgaggacctcatcggggaggggaacttcggccaggtcatccgggccatgatcaagaaggacgggctgaagatgaacgcagccatcaaaatgctgaaaggtccactggggcgacccctggcccagc

SEQ ID NO: 76473 - DNA, 327 bp, Homo sapiens
ccaaggtggggcttgctggaaggagtcttggaaggtgtttcaggaataggactggggtaaaggtagtttcggattatgtttgtgtaagtgacgggggatgccttggagaggtttgggaatgctggcggatgcttcctgaggtagatggagaggccactcaggaattgctctcatcttcctccctgaagggcaaggtcatgcccacctgaggatcttaccagagcatgacccccaagactccctctctgtgccccctcccctgcagacagccctcttggcacactcctcctgtctctccagggatgtccatcttgatctgaacctacc

SEQ ID NO: 76474 - DNA, 209 bp, Homo sapiens
accgagagcactttgtcccctcctgcaggaggtacaccctactgtggcatgacctgtgccgagctctatgaaaagctgccccagggctaccgcatggagcagcctcgaaactgtgacgatgaagtgtgagtcaccccatccttgagctccatgatcctatctctgtgatgagtgacctcagctttgatccctgtgaccccatcacccca

SEQ ID NO: 76475 - DNA, 2104 bp, Homo sapiens
aacacaggctgagcagtcaggcccacagcatctgaccccaggcccagctcgtcctggctggcctgggtcggcctctggagtatggtctggcgggtgccccctttcttgctccccatcctcttcttggcttctcatgtggcacccactaccagctggatgtgcagctctaccactgcaccctcctgggcccggcctcgccccctgcacacgtgcttctgccccccagtgggcctccagccccccgacacctccacgcccaggccctctcagactccgagatccagctgacatggaagcacccggaggctctgcctgggccaatatccaagtacgttgtggaggtgcaggtggctgggggtgcaggagacccactgtggatagacgtggacaggcctgaggagacaagcaccatcatccgtggcctcaacgccagcacgcgctacctcttccgcatgcgggccagcattcaggggctcggggactggagcaacacagtagaagagtccaccctgggcaacgggctgcaggctgagggcccagtccaagagagccgggcagctgaagagggcctggatcagcagctgatcctggcggtggtgggctccgtgtctgccacctgcctcaccatcctggccgcccttttaaccctggtgtgcatccgcagaagctgcctgcatcggagacgcaccttcacctaccagtcaggctcgggcgaggagaccatcctgcagttcagctcagggaccttgacacttacccggcggccaaaactgcagcccgagcccctgagctacccagtgctagagtgggaggacatcacctttgaggacctcatcggggaggggaacttcggccaggtcatccgggccatgatcaagaaggacgggctgaagatgaacgcagccatcaaaatgctgaaagagtatgcctctgaaaatgaccatcgtgactttgcgggagaactggaagttctgtgcaaattggggcatcaccccaacatcatcaacctcctgggggcctgtaagaaccgaggttacttgtatatcgctattgaatatgccccctacgggaacctgctagattttctgcggaaaagccgggtcctagagactgacccagcttttgctcgagagcatgggacagcctctacccttagctcccggcagctgctgcgtttcgccagtgatgcggccaatggcatgcagtacctgagtgagaagcagttcatccacagggacctggctgcccggaatgtgctggtcggagagaacctagcctccaagattgcagacttcggcctttctcggggagaggaggtttatgtgaagaagacgatggggcgtctccctgtgcgctggatggccattgagtccctgaactacagtgtctataccaccaagagtgatgtctggtcctttggagtccttctttgggagatagtgagccttggaggtacaccctactgtggcatgacctgtgccgagctctatgaaaagctgccccagggctaccgcatggagcagcctcgaaactgtgacgatgaagtgtacgagctgatgcgtcagtgctggcgggaccgtccctatgagcgacccccctttgcccagattgcgctacagctaggccgcatgctggaagccaggaaggcctatgtgaacatgtcgctgtttgagaacttcacttacgcgggcattgatgccacagctgaggaggcctgagctgccatccagccagaacgtggctctgctggccggagcaaactctgctgtctaacctgtgaccagtctgacccttacagcctctgacttaagctgcctcaaggaatttttttaacttaagggagaaaaaaagggatctggggatggggtgggcttaggggaactgggttcccatgctttgtaggtgtctcatagctatcctgggcatccttctttctagttcagctgccccacaggtgtgtttcccatcccactgctcccccaacacaaacccccactccagctccttcgcttaagccagcactcacaccactaacatgccctgttcagctactcccactcccggcctgtcattcagaaaaaaataaatgttctaataagctcca

SEQ ID NO: 76476 - DNA, 1442 bp, Homo sapiens
ctttgactcttgcgtggaccgtctaccctcttgtctcatcctgtgaagggcgaggagaccatcctgcagttcagctcagggaccttgacacttacccggcggccaaaactgcagcccgagcccctgagctacccagtgctagagtgggaggacatcacctttgaggacctcatcggggaggggaacttcggccaggtcatccgggccatgatcaagaaggacgggctgaagatgaacgcagccatcaaaatgctgaaagagtatgcctctgaaaatgaccatcgtgactttgcgggagaactggaagttctgtgcaaattggggcatcaccccaacatcatcaacctcctgggggcctgtaagaaccgaggttacttgtatatcgctattgaatatgccccctacgggaacctgctagattttctgcggaaaagccgggtcctagagactgacccagcttttgctcgagagcatgggacagcctctacccttagctcccggcagctgctgcgtttcgccagtgatgcggccaatggcatgcagtacctgagtgagaagcagttcatccacagggacctggctgcccggaatgtgctggtcggagagaacctagcctccaagattgcagacttcggcctttctcggggagaggaggtttatgtgaagaagacgatggggcgtctccctgtgcgctggatggccattgagtccctgaactacagtgtctataccaccaagagtgatgtctggtcctttggagtccttctttgggagatagtgagccttggaggtacaccctactgtggcatgacctgtgccgagctctatgaaaagctgccccagggctaccgcatggagcagcctcgaaactgtgacgatgaagtgtacgagctgatgcgtcagtgctggcgggaccgtccctatgagcgacccccctttgcccagattgcgctacagctaggccgcatgctggaagccaggaaggcctatgtgaacatgtcgctgtttgagaacttcacttacgcgggcattgatgccacagctgaggaggcctgagctgccatccagccagaacgtggctctgctggccggagcaaactctgctgtctaacctgtgaccagtctgacccttacagcctctgacttaagctgcctcaaggaatttttttaacttaagggagaaaaaaagggatctggggatggggtgggcttaggggaactgggttcccatgctttgtaggtgtctcatagctatcctgggcatccttctttctagttcagctgccccacaggtgtgtttcccatcccactgctcccccaacacaaacccccactccagctccttcgcttaagccagcactcacaccactaacatgccctgttcagctactcccactcccggcctgtcattcagaaaaaaataaatgttctaataagctcca

SEQ ID NO: 76477 - DNA, 1391 bp, Homo sapiens
ccgtcacgccacagactgggcagctcagggaccttgacacttacccggcggccaaaactgcagcccgagcccctgagctacccagtgctagagtgggaggacatcacctttgaggacctcatcggggaggggaacttcggccaggtcatccgggccatgatcaagaaggacgggctgaagatgaacgcagccatcaaaatgctgaaagagtatgcctctgaaaatgaccatcgtgactttgcgggagaactggaagttctgtgcaaattggggcatcaccccaacatcatcaacctcctgggggcctgtaagaaccgaggttacttgtatatcgctattgaatatgccccctacgggaacctgctagattttctgcggaaaagccgggtcctagagactgacccagcttttgctcgagagcatgggacagcctctacccttagctcccggcagctgctgcgtttcgccagtgatgcggccaatggcatgcagtacctgagtgagaagcagttcatccacagggacctggctgcccggaatgtgctggtcggagagaacctagcctccaagattgcagacttcggcctttctcggggagaggaggtttatgtgaagaagacgatggggcgtctccctgtgcgctggatggccattgagtccctgaactacagtgtctataccaccaagagtgatgtctggtcctttggagtccttctttgggagatagtgagccttggaggtacaccctactgtggcatgacctgtgccgagctctatgaaaagctgccccagggctaccgcatggagcagcctcgaaactgtgacgatgaagtgtacgagctgatgcgtcagtgctggcgggaccgtccctatgagcgacccccctttgcccagattgcgctacagctaggccgcatgctggaagccaggaaggcctatgtgaacatgtcgctgtttgagaacttcacttacgcgggcattgatgccacagctgaggaggcctgagctgccatccagccagaacgtggctctgctggccggagcaaactctgctgtctaacctgtgaccagtctgacccttacagcctctgacttaagctgcctcaaggaatttttttaacttaagggagaaaaaaagggatctggggatggggtgggcttaggggaactgggttcccatgctttgtaggtgtctcatagctatcctgggcatccttctttctagttcagctgccccacaggtgtgtttcccatcccactgctcccccaacacaaacccccactccagctccttcgcttaagccagcactcacaccactaacatgccctgttcagctactcccactcccggcctgtcattcagaaaaaaataaatgttctaataagctcca

SEQ ID NO: 76478 - DNA, 1168 bp, Homo sapiens
  misc_feature (450)..(450): n is a, c, g, or t
  misc_feature (456)..(456): n is a, c, g, or t
  misc_feature (462)..(462): n is a, c, g, or t
  misc_feature (493)..(493): n is a, c, g, or t
  misc_feature (502)..(504): n is a, c, g, or t
  misc_feature (509)..(509): n is a, c, g, or t
  misc_feature (511)..(511): n is a, c, g, or t
tcttttccttccttcacttactttcccccctttcgcggtacctcgggctttgtgttctttcgctgcttcacgcccgggttcctttgttttctgttgctcactagcctctttgtctccgtggtctccttgcgttacatgctctccaaccctcatacggctcttcggtaatgcatcatgcttcttttcgtccaagttgactgccggtccatactggccacttcatgtaatctcttgaatgtgtataattgccaggctgcatcacaaccagggagcgttggctgtcctctgtgaaattgtgctcgttcccgtactatgtaccttatctctccaagaattgccagactttcgtcctttctcggggatacggaaggtttatgtcgaaataagtactactgggcctgtcttccctgtggcgctctgattgccacattgatgttcctgaactacagngtctanaccacncaagaggatgtctggtccttggagtcctctntgggagatnnntgagncntggaggtacaccctactgtggcatgacctgtgccgagctctatgaaaagctgccccagggctaccgcatggagcagcctcgaaactgtgacgatgaagtgtacgagctgatgcgtcagtgctggcgggaccgtccctatgagcgacccccctttgcccagattgcgctacagctaggccgcatgctggaagccaggaaggcctatgtgaacatgtcgctgtttgagaacttcacttacgcgggcattgatgccacagctgaggaggcctgagctgccatccagccagaacgtggctctgctggccggagcaaactctgctgtctaacctgtgaccagtctgacccttacagcctctgacttaagctgcctcaaggaatttttttaacttaagggagaaaaaaagggatctggggatggggtgggcttaggggaactgggttcccatgctttgtaggtgtctcatagctatcctgggcatccttctttctagttcagctgccccacaggtgtgtttcccatcccactgctcccccaacacaaacccccactccagctccttcgcttaagccagcactcacaccactaacatgccctgttcagctactcccactcccggcctgtcattcagaaaaaaataaatgttctaataagctcca

SEQ ID NO: 76479 - DNA, 2615 bp, Homo sapiens
caaccaacgcaaaatagctaggtacaggctggtgtgtaatcggacgaggctaccactccctggactccggagctccagggacccacctctaaggatgaagcaggggtctcagaacaccctgaggcccctgcgagagaacctttgagaaggacaacccctcagcaaggagccagtggcccagggaggtcacctgtgggccaagcaaggcagccagaaaaacccagccatctgcacctggagaaggcgtccagctggccccacaggcgggactcagggaggccaccaggggacagcagtggacaggctgtggctcctagtgaggtgggccaacaagcacaagggctggagccggcagggcctgcgcagaccttccatcttgcctgagggctcttcagattcaagaggtccagccgtggagaaacatccgggaccctcagacactgttgtttttcgggagaaaaaaccaaaggaggtgatgggaggcttttcaagacgctgctccaaactcatcaactcctcccagctgctttaccaggagtatagtgatgttgtcctgaataaggagatccagagccagcagcggctggagagcctgtccgagacacccgggcctagctctccgcggcagcctcggaaggccctggtctcctccgagtcgtacctgcagcggctctccatggcctccagcggctccctctggcaggaaatccccgtggtgcgcaacagcaccgtgctgctctccatgacccatgaagaccaaaagctgcaagaggtcaaatttgagctgattgtgtcagaggcctcctacctgcgcagtctaaacatagctgtggatcatttccaactttcaacttcactccgggccacactttccaaccaggagcaccaatggctcttctctcgtttacaggatgtgcgagacgtcagcgccacgttcctttcagacctggaagagaactttgagaacaatatcttctccttccaagtatgtgacgtagtcctgaaccacgccccagacttccgccgggtctacctgccttatgtcaccaaccagacctatcaggaacgcaccttccagagcctgatgaatagcaacagcaatttccgggaggtcttggagaagctggagagcgaccccgtctgccagcgcctttccctcaagtcctttctgattctgcccttccaacgcatcacccgcctcaaactgctgctccagaacattctgaagagaacacagcctggctcctcggaggaggcagaggccacgaaggcacaccacgccctggagcagctgatccgggactgcaataacaatgtccagagtatgcgacggacagaggagctaatctacctgagccagaagattgagtttgagtgcaaaatattcccgctcatttctcagtcacgctggctggtgaaaagtggggagctgacagccttggagttcagtgcttccccagggctacgaaggaagctgaacacgcgtccagtccacctgcacctcttcaatgactgtctgctgctgtctcggccccgagagggtagccgattcctggtatttgaccatgctcccttctcctccattcggggggaaaagtgtgaaatgaagctacatggacctcacaaaaacctgttccgactctttctgcggcagaacactcagggcgcccaggccgagttcctcttccgcacggagactcaaagtgaaaagcttcggtggatctcagccttggccatgccaagagaggagttggaccttctggagtgttacaactccccccaggtacagtgccttcgagcctacaagccccgagagaatgatgaattggcactggagaaagccgacgtggtgatggtgactcagcagagcagtgacggctggctggagggcgtgaggctctcagacggggagcgaggctggtttcctgtgcagcaggtggagttcatttccaacccagaggtccgtgcacagaacctgaaggaagctcatcgagtcaagactgccaaactacagctggtggaacagcaagcctaagtcttctctgagaggagtttcgtgagctgaagaacaagctgctcatggcaagggctggccccagaaccctgcaagagaggccttctgtggatggagaactaggccttctcaaagctcaaggacaaaatccagctaacccagtccctcggcccaggcctcctttcgtgctttgtgcttggtgggggggatttcgagggactttgcactggactctgggaacctttcatcattaaaaaaagggggaccattggggcctgagccaaggaactttccttctactgccttatagtgcttaaacattctccgcctccagggtgcagattcagagctggccagagtttcagtgatagccgtatgttaaacagaatctcacctcagtctcctggagggagatgtttaagaggggttaacacatcagatgggagggtcagcccggtgacctctaaggtatcttctaacctagaaactcaccataattatggtgcaaggtcagtgtgtctctgagatctatgtctgttggtggcaatgtgagggtgatactctctcactctaataaacttggcacttctccgagtatttt

SEQ ID NO: 76480 - DNA, 2342 bp, Homo sapiens
caaccaacgcaaaatagctaggtacaggctggtgtgtaatcggacgaggctaccactccctggactccggagctccagggacccacctctaaggatgaagcaggggtctcagaacaccctgaggcccctgcgagagaacctttgagaaggacaacccctcagcaaggagccagtggcccagggaggtcacctgtgggccaacaagcacaagggctggagccggcagggcctgcgcagaccttccatcttgcctgagggctcttcagattcaagaggtccagccgtggagaaacatccgggaccctcagacactgttgtttttcgggagaaaaaaccaaaggaggtgatgggaggcttttcaagacgctgctccaaactcatcaactcctcccagctgctttaccaggagtatagtgatgttgtcctgaataaggagatccagagccagcagcggctggagagcctgtccgagacacccgggcctagctctccgcggcagcctcggaaggccctggtctcctccgagtcgtacctgcagcggctctccatggcctccagcggctccctctggcaggaaatccccgtggtgcgcaacagcaccgtgctgctctccatgacccatgaagaccaaaagctgcaagaggtcaaatttgagctgattgtgtcagaggcctcctacctgcgcagtctaaacatagctgtggatcatttccaactttcaacttcactccgggccacactttccaaccaggagcaccaatggctcttctctcgtttacaggatgtgcgagacgtcagcgccacgttcctttcagacctggaagagaactttgagaacaatatcttctccttccaagtatgtgacgtagtcctgaaccacgccccagacttccgccgggtctacctgccttatgtcaccaaccagacctatcaggaacgcaccttccagagcctgatgaatagcaacagcaatttccgggaggtcttggagaagctggagagcgaccccgtctgccagcgcctttccctcaagtcctttctgattctgcccttccaacgcatcacccgcctcaaactgctgctccagaacattctgaagagaacacagcctggctcctcggaggaggcagaggccacgaaggcacaccacgccctggagcagctgatccgggactgcaataacaatgtccagagtatgcgacggacagaggagctaatctacctgagccagaagattgagtttgagtgcaaaatattcccgctcatttctcagtcacgctggctggtgaaaagtggggagctgacagccttggagttcagtgcttccccagggctacgaaggaagctgaacacgcgtccagtccacctgcacctcttcaatgactgtctgctgctgtctcggccccgagagggtagccgattcctggtatttgaccatgctcccttctcctccattcggggggaaaagtgtgaaatgaagctacatggacctcacaaaaacctgttccgactctttctgcggcagaacactcagggcgcccaggccgagttcctcttccgcacggagactcaaagtgaaaagcttcggtggatctcagccttggccatgccaagagaggagttggaccttctggagtgttacaactccccccaggtacagtgccttcgagcctacaagccccgagagaatgatgaattggcactggagaaagccgacgtggtgatggtgactcagcagagcagtgacggctggctggagggcgtgaggctctcagacggggagcgaggctggtttcctgtgcagcaggtggagttcatttccaacccagaggtccgtgcacagaacctgaaggaagctcatcgagtcaagactgccaaactacagctggtggaacagcaagcctaagtcttctctgagaggagtttcgtgagctgaagaacaagctgctcatggcaagggctggccccagaaccctgcaagagaggccttctgtggatggagaactaggccttctcaaagcccaaggaactttccttctactgccttatagtgcttaaacattctccgcctccagggtgcagattcagagctggccagagtttcagtgatagccgtatgttaaacagaatctcacctcagtctcctggagggagatgtttaagaggggttaacacatcagatgggagggtcagcccggtgacctctaaggtatcttctaacctagaaactcaccataattatggtgcaaggtcagtgtgtctctgagatctatgtctgttggtggcaatgtgagggtgatactctctcactctaataaacttggcacttctccgagtatttt

SEQ ID NO: 76481 - DNA, 982 bp, Homo sapiens
caaccaacgcaaaatagctaggtacaggctggtgtgtaatcggacgaggctaccactccctggactccggagctccagggacccacctctaaggatgaagcaggggtctcagaacaccctgaggcccctgcgagagaacctttgagaaggacaacccctcagcaaggagccagtggcccagggaggtcacctgtgggccaacaagcacaagggctggagccggcagggcctgcgcagaccttccatcttgcctgagggctcttcagattcaagaggtccagccgtggagaaacatccgggaccctcagacactgttgtttttcgggagaaaaaaccaaaggaggtgatgggaggcttttcaagacgctgctccaaactcatcaactcctcccagctgctttaccaggagtatagtgatgttgtcctgaataaggagatccagagccagcagcggctggagagcctgtccgagacacccgggcctagctctccgcggcagcctcggaaggccctggtctcctccgagtcgtacctgcagcggctctccatggcctccagcggctccctctggcaggaaatccccgtggtgcgcaacagcaccgtgctgctctccatgacccatgaagaccaaaagctgcaagaggtcaaatttgagctgattgtgtcagaggcctcctacctgcgcagtctaaacatagctgtggatcatttccaactttcaacttcactccgggccacactttccaaccaggagcaccaatggctcttctctcgtttacaggatgtgcgagacgtcagcgccacgttcctttcagacctggaagagaactttgagaacaatatcttctccttccaagtatgtgacgtagtcctgaaccacgccccagacttccgccgggtctacctgccttatgtcaccaaccccacggtgcgttgccacacggtgcgttgcccaacacggtgcgtgcccacacgtgcgtga

SEQ ID NO: 76482 - DNA, 2486 bp, Homo sapiens
caaccaacgcaaaatagctaggtacaggctggtgtgtaatcggacgaggctaccactccctggactccggagctccagggacccacctctaaggatgaagcaggggtctcagaacaccctgaggcccctgcgagagaacctttgagaaggacaacccctcagcaaggagccagtggcccagggaggtcacctgtgggccaacaagcacaagggctggagccggcagggcctgcgcagaccttccatcttgcctgagggctcttcagattcaagaggtccagccgtggagaaacatccgggaccctcagacactgttgtttttcgggagaaaaaaccaaaggaggtgatgggaggcttttcaagacgctgctccaaactcatcaactcctcccagctgctttaccaggagtatagtgatgttgtcctgaataaggagatccagagccagcagcggctggagagcctgtccgagacacccgggcctagctctccgcggcagcctcggaaggccctggtctcctccgagtcgtacctgcagcggctctccatggcctccagcggctccctctggcaggaaatccccgtggtgcgcaacagcaccgtgctgctctccatgacccatgaagaccaaaagctgcaagaggtcaaatttgagctgattgtgtcagaggcctcctacctgcgcagtctaaacatagctgtggatcatttccaactttcaacttcactccgggccacactttccaaccaggagcaccaatggctcttctctcgtttacaggatgtgcgagacgtcagcgccacgttcctttcagacctggaagagaactttgagaacaatatcttctccttccaagtatgtgacgtagtcctgaaccacgccccagacttccgccgggtctacctgccttatgtcaccaaccagacctatcaggaacgcaccttccagagcctgatgaatagcaacagcaatttccgggaggtcttggagaagctggagagcgaccccgtctgccagcgcctttccctcaagtcctttctgattctgcccttccaacgcatcacccgcctcaaactgctgctccagaacattctgaagagaacacagcctggctcctcggaggaggcagaggccacgaaggcacaccacgccctggagcagctgatccgggactgcaataacaatgtccagagtatgcgacggacagaggagctaatctacctgagccagaagattgagtttgagtgcaaaatattcccgctcatttctcagtcacgctggctggtgaaaagtggggagctgacagccttggagttcagtgcttccccagggctacgaaggaagctgaacacgcgtccagtccacctgcacctcttcaatgactgtctgctgctgtctcggccccgagagggtagccgattcctggtatttgaccatgctcccttctcctccattcggggggaaaagtgtgaaatgaagctacatggacctcacaaaaacctgttccgactctttctgcggcagaacactcagggcgcccaggccgagttcctcttccgcacggagactcaaagtgaaaagcttcggtggatctcagccttggccatgccaagagaggagttggaccttctggagtgttacaactccccccaggtacagtgccttcgagcctacaagccccgagagaatgatgaattggcactggagaaagccgacgtggtgatggtgactcagcagagcagtgacggctggctggagggcgtgaggctctcagacggggagcgaggctggtttcctgtgcagcaggtggagttcatttccaacccagaggtccgtgcacagaacctgaaggaagctcatcgagtcaagactgccaaactacagctggtggaacagcaagcctaagtcttctctgagaggagtttcgtgagctgaagaacaagctgctcatggcaagggctggccccagaaccctgcaagagaggccttctgtggatggagaactaggccttctcaaagctcaaggacaaaatccagctaacccagtccctcggcccaggcctcctttcgtgctttgtgcttggtgggggggatttcgagggactttgcactggactctgggaacctttcatcattaaaaaaagggggaccattggggcctgagccaaggaactttccttctactgccttatagtgcttaaacattctccgcctccagggtgcagattcagagctggccagagtttcagtgatagccgtatgttaaacagaatctcacctcagtctcctggagggagatgtttaagaggggttaacacatcagatgggagggtcagcccggtgacctctaaggtatcttctaacctagaaactcaccataattatggtgcaaggtcagtgtgtctctgagatctatgtctgttggtggcaatgtgagggtgatactctctcactctaataaacttggcacttctccgagtatttt

SEQ ID NO: 76483 - DNA, 2246 bp, Homo sapiens
caaccaacgcaaaatagctaggtacaggctggtgtgtaatcggacgaggctaccactccctggactccggagctccagggacccacctctaaggatgaagcaggggtctcagaacaccctgaggcccctgcgagagaacctttgagaaggacaacccctcagcaaggagccagtggcccagggaggtcacctgtgggccaacaagcacaagggctggagccggcagggcctgcgcagaccttccatcttgcctgagggctcttcagattcaagaggtccagccgtggagaaacatccgggaccctcagacactgttgtttttcgggagaaaaaaccaaaggaggtgatgggaggcttttcaagacgctgctccaaactcatcaactcctcccagctgctttaccaggagtatagtgatgttgtcctgaataaggagatccagagccagcagcggctggagagcctgtccgagacacccgggcctagctctccgcggcagcctcggaaggccctggtctcctccgagtcgtacctgcagcggctctccatggcctccagcggctccctctggcaggaaatccccgtggtgcgcaacagcaccgtgctgctctccatgacccatgaagaccaaaagctgcaagaggtcaaatttgagctgattgtgtcagaggcctcctacctgcgcagtctaaacatagctgtggatcatttccaactttcaacttcactccgggccacactttccaaccaggagcaccaatggctcttctctcgtttacaggatgtgcgagacgtcagcgccacgttcctttcagacctggaagagaactttgagaacaatatcttctccttccaagtatgtgacgtagtcctgaaccacgccccagacttccgccgggtctacctgccttatgtcaccaaccagacctatcaggaacgcaccttccagagcctgatgaatagcaacagcaatttccgggaggtcttggagaagctggagagcgaccccgtctgccagcgcctttccctcaagtcctttctgattctgcccttccaacgcatcacccgcctcaaactgctgctccagaacattctgaagagaacacagcctggctcctcggaggaggcagaggccacgaaggcacaccacgccctggagcagctgatccgggactgcaataacaatgtccagagtatgcgacggacagaggagctaatctacctgagccagaagattgagtttgagtgcaaaatattcccgctcatttctcagtcacgctggctggtgaaaagtggggagctgacagccttggagttcagtgcttccccagggctacgaaggaagctgaacacgcgtccagtccacctgcacctcttcaatgactgtctgctgctgtctcggccccgagagggtagccgattcctggtatttgaccatgctcccttctcctccattcggggggaaaagtgtgaaatgaagctacatggacctcacaaaaacctgttccgactctttctgcggcagaacactcagggcgcccaggccgagttcctcttccgcacggagactcagtgagatggggctgggcagaggagctgggggtgggggaagatgggcagccgagaaaagaagtgagaccaaggcagaaaatgtgtccagaagacagccacagcctcatttagcccattctggactggggaccaccatagagaaattcagactcctaaaactaatggataacttgcaggagattggggtgggagagggtacaaagtcaccaccgaggcttagcatctattttatactctttactcaagagggacaaggtctgtgtagtatcagaaaggagaaggactggtatggagtgagcaaggaattggaatactggtatctgtgagcacatgcctccatgcctgaggcagaaacccttctatgccccagctggtgggcacagatgtgaataagacaagtgctgggtgacttttactttctgtgctcccatcttccaaaccagtcctctattgaccagaaatccatagtgttgagaatgctgatttgctcatgttttcaataataataaaataaaatacattcacacagacatacatttttgagagtattaatagtacctataaaatctggaacacagtgcctgcaataatgaacatgtaaaagcctgtagctgttattgctattataaaagatatatgaacagtcatttaaaagtttgacgtatctaagtgtt

SEQ ID NO: 76484 - DNA, 396 bp, Homo sapiens
tggaagagatgcttgttcaagtggaacttgcatggaagtggcatggggaggagggtgggactgggagcaaacctcatgcttctcccatctgtgacactgccttctctctcttcctctgccctgtagatattcccgctcatttctcagtcacgctggctggtgaaaagtggggagctgacagccttggagttcagtgcttccccagggctacgaaggaagctgaacacgcgtccagtccacctgcacctcttcaatgactgtctgctgctgtctcggccccgagagtcagtgactggagtggcaggccagggcacaagaggggaaggggatgaggaaagaggggggtctgaaagggagagagaagggtcatgttcctagaagagcccttctcaatgg

SEQ ID NO: 76485 - DNA, 330 bp, Homo sapiens
agaggccgacctctaatttgaagcctagaagaagcaacaagggatgactttgcttggccctgagctgacagtctaggatgagagcaagtgacagacgacagcaaccccagctgaatgctctgtaagtcccctacccccaccatctctgtccaagatgagtcaaaacttgtggcacagggagggaagctgcagtgcccccgggaaaggagcttgtggctgagtagctgggaaaacgtttgaatgaggagacagcagagacgtgggccagattccccaagggaagtggtaagcaccccatagcttgagtcactggactgctggggcagctac

SEQ ID NO: 76486 - DNA, 1707 bp, Homo sapiens
  misc_feature (60)..(60): n is a, c, g, or t
  misc_feature (453)..(453): n is a, c, g, or t
  misc_feature (925)..(925): n is a, c, g, or t
  misc_feature (1295)..(1295): n is a, c, g, or t
  misc_feature (1382)..(1382): n is a, c, g, or t
  misc_feature (1482)..(1482): n is a, c, g, or t
  misc_feature (1577)..(1577): n is a, c, g, or t
atggtcaaggtcaagcgttagtcgggttgacgaggtgtgcccttgctgtgatgcaatacncgtggagctttgcctctgtggtcttccccactaaaactcacagccttcatctcaccgtgagaaaaaaaatcaggcaaattctgatagaggagcatcctacaatatccctcatcagtcctcctgaaaaccaccaagatcatccaaacccgagtcagaaactgtcacagcaagaggggtctaaagacacatgatgactagatgtcacgtgagaccctggatgggatcctggaacagaaaatggatattaggtaaaaacgaaggaaatccgaataatctagggactttagttcctaataatacgtcggtattggttcgctaattataacaaaattactatactaatgttaggtattaataataggggcatggcatatgggaactctgaactatatnctcaatatatctgtaaatctaaaactattttttttgaagagcatcttttttttttttttttttttaaccctgcagcaatgagctttgggatggacagcctgtgaaccagactctcctctctccaggaaatttggtgagctattcagcatctttttaatctctttcttgcttaaactagctgcagtgagagctctgttgtctgcaaccaagaatctagactaatacctgcatttagttatttacatacgtgtttaaaaaagagagagctgcaggagatttggtgtcattttccattttgagctgcgatcatttttaaaatgcaggataatgtctgcaaagtacctggggatagagtcaggactaatgagataatatctgcaaaatgctttgagttccctggagctgctgagaggcaaggaacatgcattatcatcattagaaaaaacaagctttgaaaactttggcagaaggngatataagtgaaatcagttcaattactcatgccttcaatagacaagttctataaaagttaaagtattttttttttttgtaaatcaaattcctcttcatttcctctgtcaaacattactgttctatgatctttcaattatttttggttggactccctttgacaatgtattgaagcagctttcgtttctctgcttccagattctctggcagatattctcaaacttcaaatctatctccattttgagaaaatatacaaagcatatgctttcttttaatgttacttgaaatttcaaaacaacatggtgaccaaaactaaaccaatacaatgataggaatagaagaaatattatttttatttttcaaattttttnttttatttatttacttacctatttatttttgagacagggtcttgctctgttgccaggctggaaggcagtggcacgatcacgccacancctcccaagtagctggggctacaggtgtgcccctaatgttttatttatttttgttttttgtagggagggcatctccctaggtgtctagactggtctcaantcctggctcaagcgattctcctgcctcagcctcccaaagtgctggaatttacaggcgtgaagccaccacactcggccatctttaaagatacattnaaaaaatttgtcagttatatatgagtaagcttggagtcttgcattggcatcttctgaagaagagggagaacagagctcatcatgaccctttcaacatctagcctaacgcactgttttgttttcaaagtcc

SEQ ID NO: 76487 - DNA, 331 bp, Homo sapiens
gaatacaacatttttattcaaaagagatttttaacaataattaacaataatttagccccaagccctcattttatagacagggagccagaggcacagagaagttgtgtcctatactgctatcacagagctagttggtgacagccatgaggcaatcaaccaaaatctgttaaaattgctgctaaaggggtattaacttgatattaacttaacttatcaaaggaaaaatggcagtcactctagattctgatcaggtaaaaaaagtaagaatgactgtctttaaaaattttaactaaactattccattagcttaaatgaggctgaattaaaaata

SEQ ID NO: 76488 - DNA, 439 bp, Homo sapiens
  misc_feature (434)..(435): n is a, c, g, or t
tggagatggagtctcactcttgtcacccaggctggagtgcaggaaaggcagctgaccacattcaacacggattcaggaaaagccctcagcaaatgaggaagctcttccgcctgtaagtgcaccagtgcaaacccaacactgagccgggagagactgagcccatgttcaccgagactgggaataagattagcgagcgccggctcacctcgccagtgcagtgagaagccgaggcacagactgacaaggggaagcaaagccactgtcagacagaggacacgcgtgtgcacacggaaaccccacgagtccacagaaacaccgccatggccaaggcgggagtttagggcacaggattaaagcaccacacacaggtgacaaatgaaataaaaatacacagtcctcaatagcatatcgaacacctaggactagatctaaannaaaa

SEQ ID NO: 76489 - DNA, 707 bp, Homo sapiens
  misc_feature (702)..(703): n is a, c, g, or t
caatcctatacaaactatggcagaacttgtttcaggaggcccacttaatgcaatatcaaaccatgacagacacatcacatgacaagacaatgaacatccaagcccagtgtccctcaagagcattcctacacaggaggtccttagcccggtatgagcaaatctcatttggccatgcagagaaaaggccaatgcaccatggccacagggacttacctggaaatgccaggtcatcttggcatatgaaagtcagcgtaattcactacagtaatgcggtaaggaagtgacctcatgagcatctcactaggtgcaggaaaggcagctgaccacattcaacacggattcaggaaaagccctcagcaaatgaggaagctcttccgcctgtaagtgcaccagtgcaaacccaacactgagccgggagagactgagcccatgttcaccgagactgggaataagattagcgagcgccggctcacctcgccagtgcagtgagaagccgaggcacagactgacaaggggaagcaaagccactgtcagacagaggacacgcgtgtgcacacggaaaccccacgagtccacagaaacaccgccatggccaaggcgggagtttagggcacaggattaaagcaccacacacaggtgacaaatgaaataaaaatacacagtcctcaatagcatatcgaacacctaggactagatctaaannaaaa

SEQ ID NO: 76490 - DNA, 430 bp, Homo sapiens
gtctaatttttttctcgttttgtacttagtagagtttcgatctagattactccaacttcataaaagattcaggaagtaccgaatgacctcaaggacctaatatcctcaattctaccagaactggaagaattggaagaggactctgagcatcagataagaacaccggctagataacaccttggtttccgccttgtgataccatgagcagagaacctagctgcggtatgcctggactggtgatctacagacatgttagacaatctcattctaagcctctgcacttgtggatattttttaatgcagaattagaaaactaataatgtcagattgggtaaattgtgtttttcagaaaatttgttcattgtttccaagttgtaaaatttatacatgtaaacatgttcataaatttttatattttcgacgtctataa

SEQ ID NO: 76491 - DNA, 679 bp, Homo sapiens
caaccatgaagctcctttttcctatctttgccagcctcatgctacagtaccaggtgaacacagaatttattggcttgagacgctgtttaatgggtttggggagatgcagggatcactgcaatgtggatgaaaaagagatacagaaatgcaagatgaaaaaatgttgtgttggaccaaaagtggttaaattgattaaaaactacctgcaatatggaacaccaaatgtacttaatgaagacgtccaagaaatgctaaaacctgccaagaattctagtgctgtgatacaaagaaaacatattttatctgttctcccccaaatcaaaagcactagcttttttgctaataccaactttgtcatcattccaaatgccacccctatgaactctgccaccatcagcactatgaccccaggacagatcacatacactgctacttctaccaagagtaacaccaaagaaagcagagattctgccactgcctcgccaccaccagcaccacctccaccaaacatactgccaacaccatcactggagctagaggaagcagaagagcagtaatgtggatctttcccttaaaactccaagttcctctctatttttgctatctataaaatgacatagaactgtttcctctgtcatcagtcattcaataaacactgtttgagcacctacaataaaaa

SEQ ID NO: 76492 - DNA, 670 bp, Homo sapiens
cctatctcaaagaaaaaaaagttatataaatggaatcatactgtatttaatcttttgagatcatgttttcactcagcataattctcttgagatttatccaagttatcgtgtatatcagtagacattccaaatggtacagtaatgtcacaccgagaatctgctcctccataaaagcaatgaggacattagcaaaagctgttgacataaacttattagaattgtggaaattaacaaaagcttgccacattccaaggaatgtttacctaagaaaaacagctgaatctcagtaagaacggaaagcctatagtgttttaacttgctctaatcctatacacctctccccagttccatggaagccttgaaactcaatagcttcacatttatagtagttgtggaaagtagagcttagcagccactggagagaaaagaacagatttgaagcccaaaaaggctcattcccagagaattaaccacgagttgacctaacagctcactgaaaatctccataatcaggacttcttttaattcgacctatttcagagtacactctgtatacagcttgatgtacagggcatttatttcttaaaaaacaatcagtagttcaacaaaagaaattagacttaaccaaaatgaaacttttgtgcttcaaatcataacatcaacatacata

SEQ ID NO: 76493 - DNA, 277 bp, Homo sapiens
  misc_feature (54)..(54): n is a, c, g, or t
  misc_feature (250)..(250): n is a, c, g, or t
  misc_feature (256)..(256): n is a, c, g, or t
tgcctcaagtaccctaggggtaaaatttcttccctcaattcctactgatattanagaaaacttacaatgtattttacggtcctgacaattacaggtgggattcataggagatatattgacgtgacttttggattctaaacagtgctgagataattaagcagaatctgaattaagattggaagtggccacccaggatatgataacagttaaataatctagaaactacttttttaattgcgttaggagagancaagtnttctcatggctgttctttctc

SEQ ID NO: 76494 - DNA, 1027 bp, Homo sapiens
cagggctgtgtgttccagaaggctgataccatggaagacatcaccttggcttcctggctgtctggttagtgatttgagcaatgagaggcagcagctagaaatgaaagagtagaagaagagagtgtctcctgacactgtgtgcatggtctccagtcagcctctgattccttcccagggcctgattggttcagcaccaagtgaagtcatagtcactatggtgactcacaattgtcctcagaacctagtgccaacagtctgcaagattcaaacactggccaccatgcctggcttccttctggttcaagcctgaataaggtccctcttctgtgctgtcttcctgaagccatctgtggagtcaagcagtcatggctcagggacactctgaagtaggtcccagcacatctgcatggagcatcaggaggaaggtggatgaatacttaagacccagcctggcctctaaatcggtgctgagcgttttactcagtagacagcttgggaatcatagaaacgatgcggatctgacagagtggctgtggacactgaagcaagccataccagggtggacctggcctttgccgacacgccacacaatcaacccacctctgccccctggggaggatggaaaatccaagaaaatggtgtggatcaataaatccttcccctgatgcaaccattacaagtggaagctgtgttctcactgcttttggctggacatggtctttgatcacctggtttcttgacttctgacccgtctctgtgttacccgaggccacagcagatgaactttacctactgccctccgagaaggtgtttactaacgttgtagagtctggggatgttggagacacgaggggccctgcttagagaagctggaagggcagctgagtggaacatggagaggccctgcaaccctaaatttctagggggaggggactttcaggagcccacttagaggtcttgatttgtctcccttgaagtttgggggagagcatgggtagaaattgaaatcaaataaatttaaaatgag

SEQ ID NO: 76495 - DNA, 1559 bp, Homo sapiens
aaaaccttgagtttaaaccatccctttctcttgttgggtccaaatggacagactctggttttctattgaagatttacacgcagattcctgtcataatttttcttttctatcgagccctgtcatgatgataagtgatagcaggttggttcctagatcatacaccatggacctagcacagaagtgttttcagaagagccttttccttacaaaacagcatgaaagtcattgagccaatggatactgagatttcaaactggagccaatggatacttagaggagccctgaagtgtagagtagttgctacttcttgttcactaggtctaattagcatgtcatcagtgtaacagactagtgtgttgtcttgtgaaagagaaaggtgataagatccctgtgaactaaactatgatgtagggcttgaaaattgatatacaatacgcctgaggtaggatggcgaaggtgtattcctggtcttaccagctgaaagtaaattgcttctggtggtctttactaacagttattgagaaaaaaagcattttcaaggtcaagaggtacatactaggttccaggggatatgttaatttgctcaagaaatgaaaccacatctggaacagcagctgcaattggagtcatcacctggcttagtttacaatgacccactaccatcttccaagatccatctgccttctgcataggccaaacagtcccagggcctgattggttcagcaccaagtgaagtcatagtcactatggtgactcacaattgtcctcagaacctagtgccaacagtctgcaagattcaaacactggccaccatgcctggcttccttctggttcaagcctgaataaggtccctcttctgtgctgtcttcctgaagccatctgtggagtcaagcagtcatggctcagggacactctgaagtaggtcccagcacatctgcatggagcatcaggaggaaggtggatgaatacttaagacccagcctggcctctaaatcggtgctgagcgttttactcagtagacagcttgggaatcatagaaacgatgcggatctgacagagtggctgtggacactgaagcaagccataccagggtggacctggcctttgccgacacgccacacaatcaacccacctctgccccctggggaggatggaaaatccaagaaaatggtgtggatcaataaatccttcccctgatgcaaccattacaagtggaagctgtgttctcactgcttttggctggacatggtctttgatcacctggtttcttgacttctgacccgtctctgtgttacccgaggccacagcagatgaactttacctactgccctccgagaaggtgtttactaacgttgtagagtctggggatgttggagacacgaggggccctgcttagagaagctggaagggcagctgagtggaacatggagaggccctgcaaccctaaatttctagggggaggggactttcaggagcccacttagaggtcttgatttgtctcccttgaagtttgggggagagcatgggtagaaattgaaatcaaataaatttaaaatgag

SEQ ID NO: 76496 - DNA, 1531 bp, Homo sapiens
aaaaccttgagtttaaaccatccctttctcttgttgggtccaaatggacagactctggttttctattgaagatttacacgcagattcctgtcataatttttcttttctatcgagccctgtcatgatgataagtgatagcaggttggttcctagatcatacaccatggacctagcacagaagtgttttcagaagagccttttccttacaaaacagcatgaaagtcattgagccaatggatactgagatttcaaactggagccaatggatacttagaggagccctgaagtgtagagtagttgctacttcttgttcactaggtctaattagcatgtcatcagtgtaacagactagtgtgttgtcttgtgaaagagaaaggtgataagatccctgtgaactaaactatgatgtagggcttgaaaattgatatacaatacgcctgaggtaggatggcgaaggtgtattcctggtcttaccagctgaaagtaaattgcttctggtggtctttactaacagttattgagaaaaaaagcattttcaaggtcaagaggtacatactaggttccaggggatatgttaatttgctcaagaaatgaaaccacatctggaacagcagctgcaattggagtcatcacctggcttagtttacaatgacccactaccatcttccaagatccatctgccttctgcataggccaaacagtcccagggcctgattggttcagcaccaagtgaagtcatagtcactatggtgactcacaattgtcctcagaacctagtgccaacagtctgcaagattcaaacactggccaccatgcctggcttccttctggttcaagcctgaataaggtccctcttctgtgctgtcttcctgaagccatctgtggagtcaagcagtcatggctcagggacactctgaagtaggtcccagcacatctgcatggagcatcaggaggaaggtggatgaatacttaagacccagcctggcctctaaatcggtgctgagcgttttactcagtagacagcttgggaatcatagaaacgatgcggatctgacagagtggctgtggacactgaagcaagccataccagggtggacctggcctttgccgacacgccacacaatcaacccacctctgccccctggggaggatggaaaatccaagaaaatggtgtggatcaataaatccttcccctgatgcaaccattaaaaaaaaaaaaaaaaaaaaaaaaaaaaaaaaaaaaaaaaaaaaaaaaaaaggggggcgcggcgccccgcgaagaaatatcccccgcaggggggccaccaactgttgcgccagctccccccgttttccggtgtacacaacggggcgcccccacaggagaagggcggggtatataagaacggcagaggcaccgcagggcgcggccgttaaaccacaggggggcggcggtggggaaaaacgccggcccgggcgggcacgccctggggaaggaaacccccaacctcgggggggggggacaccctggggagccagctccccagcgggg

SEQ ID NO: 76497 - DNA, 462 bp, Homo sapiens
gtaggactgctgacaggaagaaagtggtggagtcagaggtcacaatccaaagcaaggtgacagtctcttgacgaagacaccctgagtgctgaattaaggggctaaataacagtgctatagtggtttcataatcataaagcattccaggaacacaatattgcttatcaactgagctttaaaacagatatgaggcaggacatggtggctcacacctgcactcccagcaatttggcaagccaagctttgatggctctggcagaaagccttcctgttccaaactcaccacttatcatcatagtacccgcgttcaggcattaagaagaaaagagcatccaatccctctgctttcctgcatcggctcccatgcacaagcaaatgtgttgtgttagtggctatcaaatattcatgtatttgatcaaggaaatttgtatttccaaatggtaaaacaaaaatactactaaa

SEQ ID NO: 76498 - DNA, 1773 bp, Homo sapiens
gagcttcttgcccagaaacaaagtttatgctctatgtgatcagctacatctccttaggttccatacttatcaggggcttttgacatggaagaatgtgataattggggagcaaccttctgagaattcagcctttgaagtaattcaaagacagtttcttagcacacacgttaactccagacacagcagtggtgggtgcctccattgaggtttccgttttctcttctgtccatcaagggcccaacatccaactggtcccacagtgagcaggggcaactcttgcttcttcagcatctggccacttcgtttccatggtaactgccacgtgtacttttctagcagtctgtggccactccgtactcagctgaaaacactgtttcagccccctctctggtgacctcagccttctccaggtgtatctcttgatgatcttggagaccagcagccacagctgctgctactcctgcaggagactgtcaggctgtggtggggggcaggggtgttggaggagaagttgaaaatccgtgtgttctctgcccctctgctcctccatcttagcttctggaggagttaaggcaccaagggcaccaagtcaggttggcagttttgctgcccttgcccaagcctccagcaaaactagctggtcccctgctttgctgggtcccagccaggtgtgattttggttgttgattagtaaccacacattgtttttccccacctttttcattagtggaggttttgtttgtttgttttgttgtttgagacagagtctcacgctcttttcagactggagtgcagtggtgcgatgtcagctcactgcaacctccacttcccgggttcagacgattctcatgcctcagcctcctgagtagctgggattacagatgtgcaccaccacacctggctaatttttgtatttttagtagagatggggtttcaccatattggccaggctggtctcaaactcctgacctcaggcgattggcccacctcggcctcccaaagtgctgggattacaggtgtgaaccaccgtgcccggcccattagtggagttctgatgggcacggtaaatattattaatgaaagagaaattctgtatacttttttaaaaatctctttaatgaaagaatgaagagtggcagagataataattgaaagattagtttctcatggaattaatttggccttgatattcagtatttggaaatgtcttaaagaaaaccattttcattgtagaaaatccttttttaaatacttgttatatcccagggagattagtttataccttccacctcaggcagtcatcagctgctttagagaatggaatccaccctgcccctccattttttggttcctggggctcaattcaagtctggtcaagtctccctggctggggattctgtcctgggaacagatactcagttgtagtctcatgtgtctgcactcacccaagactctatatacttgcttgctcagagcatagttagggcagctcctaaaaatgcattcagcagaagactgaaaaacttcaattgcttcatttgtatgcaaatagaaaatggtagataattatatattatacgcctttgtgtaagttcatttaatacttgaagcagtctttgtctcaaaagagtatgcccttactgagaaaggatatgtgaacggtacatttattgttggggagagtggattgtttacatcatgtctggacttttgtctagttgggtagacagttctacaccagcagcccccttaataaagaagtctacacagaca

SEQ ID NO: 76499 - DNA, 2928 bp, Homo sapiens
aaaatattttccgtgtccccgcctgcagagtcagtgtgcggtttgggagaaaatgtgtcggatattttggggcggtcacgtgggcgggcgggctccgagaggccccgggacagtcccagcctagagccgtgcccccccaggagccccccagtacggcgagccccggacattgcgacgctccatccaagagactgcccgacgccgggacctcggggctccgccgcctcccttccccctcccactccagcagctacggcccagttccctcaacctgacccagtatgtagaagccagtctctgcaggcggccagcgggacttttggaggcccagtgggcaggccaggcagggcgggtacggagcctcccaggctggggcagtgggcatgggcaggggctgtggctgaagacctcgcccgcccactgcagaccccaggggactctcacaccgcagctgccatggccaccaataaggagcgactctttgcggctggtgccctggggcctggatctggctacccaggggcaggtttccccttcgccttcccaggggcactcagggggtctccgcctttcgagatgctgagccctagcttccggggcctgggccagcctgacctccccaaggagatggcctctctgtcggtggagacacagagcaccagctcagaggagatggtgcccagctcgccctcgccccctccgcctcctcgggtctacaagccatgcttcgtgtgcaatgacaagtcctctggctaccactatggggtcagctcttgtgaaggctgcaagggcttctttcgccgaagcatccagaagaacatggtgtacacgtgtcaccgcgacaaaaactgtatcatcaacaaggtgaccaggaatcgctgccagtactgccggctacagaagtgcttcgaagtgggcatgtccaaggaagctgtgcgaaatgaccggaacaagaagaagaaagaggtgaaggaagaagggtcacctgacagctatgagctgagccctcagttagaagagctcatcaccaaggtcagcaaagcccatcaggagactttcccctcgctctgccagctgggcaagtataccacgaactccagtgcagaccaccgcgtgcagctggatctggggctgtgggacaagttcagtgagctggctaccaagtgcatcatcaagatcgtggagtttgccaagcggttgcctggctttacagggctcagcattgctgaccagatcactctgctcaaagctgcctgcctagatatcctgatgctgcgtatctgcacaaggtacaccccagagcaggacaccatgaccttctccgacgggctgaccctgaaccggacccagatgcacaatgccggcttcgggcccctcacagaccttgtctttgcctttgctgggcagctcctgcccctggagatggatgacaccgagacagggctgctcagcgccatctgcctcatctgcggagaccgcatggacctggaggagcccgaaaaagtggacaagctgcaggagccactgctggaagccctgaggctgtacgcccggcgccggcggcccagccagccctacatgttcccaaggatgctaatgaaaatcaccgacctccggggcatcagcactaagggagctgaaagggccattactctgaagatggagattccaggcccgatgcctcccttaatccgagagatgctggagaaccctgaaatgtttgaggatgactcctcgcagcctggtccccaccccaatgcctctagcgaggatgaggttcctgggggccagggcaaagggggcctgaagtccccagcctgaccagggcccctgacctccccgctgtgggggttggggcttcaggcagcagactgaccatctcccagaccgccagtgactgggggaggacctgctctgccctctccccaccccttccaatgagctccttgtttttgccaaagtttctaggggtgcctctgtgttcatccccttcctgatctaaccggctccctcgccagtcccgggggcctgccctgctcccaccaggagagagggcaaagggatgagcctgggtttggactctaaaatctcagcactgccccatgggtcctagacttcccagggcaagaggaagaccctgccattccacagccccttcctctgccaggtgcttggctctctgagagcaaacaggaacactagagaccaaaaaggggacaaaggagaagggctgagcccaccttcttgctcctacccttggtgcctaatgctgtgtgatgcacctgcagggtgtgtgctagcctctgtgccccgtccttgtgccaggtcaaggtgggggcaggctgggccctgcatttctggggcaggaacagagggtgaaagggacagatagatgcaggtccattctgcacctcttggctcgggtgcagagttcaccctgtgccctccgttataagtccctcccccagccctgtcatgtgccttgggctcctcctgccctccatctcagccattggggcagggaccctcctacactacagaggggccaggggatccctctctccctagtgccttccaccctttactccccagagcagcttggcccagggaggggggatgctgcttagctgatcccgccctgacccagaggaagcctctatttatttattagcttttgtttacaccgtggaattgaccccttcctccaggggtcttgggtgggggagcccagggcccctgtgacccctcctttcttcctccaatccccagtttgtatttagctgccaaataagattcccattggctccctgtgttctcttggggggtcagggtgctgtcccctcccctctgtttacatctcccctctaccccgctgtatcgcatattgctgagttttctatttttgcaaaataaagtgatggaaactca

SEQ ID NO: 76500 - DNA, 2602 bp, Homo sapiens
aaaatattttccgtgtccccgcctgcagagtcagtgtgcggtttgggagaaaatgtgtcggatattttggggcggtcacgtgggcgggcgggctccgagaggccccgggacagtcccagcctagagccgtgcccccccaggagccccccagtacggcgagccccggacattgcgacgctccatccaagagactgcccgacgccgggacctcggggctccgccgcctcccttccccctcccactccagcagctacggcccagttccctcaacctgacccagtatgtagaagccagtctctgcaggcggccagcggcggtggagacacagagcaccagctcagaggagatggtgcccagctcgccctcgccccctccgcctcctcgggtctacaagccatgcttcgtgtgcaatgacaagtcctctggctaccactatggggtcagctcttgtgaaggctgcaagggcttctttcgccgaagcatccagaagaacatggtgtacacgtgtcaccgcgacaaaaactgtatcatcaacaaggtgaccaggaatcgctgccagtactgccggctacagaagtgcttcgaagtgggcatgtccaaggaagctgtgcgaaatgaccggaacaagaagaagaaagaggtgaaggaagaagggtcacctgacagctatgagctgagccctcagttagaagagctcatcaccaaggtcagcaaagcccatcaggagactttcccctcgctctgccagctgggcaagtataccacgaactccagtgcagaccaccgcgtgcagctggatctggggctgtgggacaagttcagtgagctggctaccaagtgcatcatcaagatcgtggagtttgccaagcggttgcctggctttacagggctcagcattgctgaccagatcactctgctcaaagctgcctgcctagatatcctgatgctgcgtatctgcacaaggtacaccccagagcaggacaccatgaccttctccgacgggctgaccctgaaccggacccagatgcacaatgccggcttcgggcccctcacagaccttgtctttgcctttgctgggcagctcctgcccctggagatggatgacaccgagacagggctgctcagcgccatctgcctcatctgcggagaccgcatggacctggaggagcccgaaaaagtggacaagctgcaggagccactgctggaagccctgaggctgtacgcccggcgccggcggcccagccagccctacatgttcccaaggatgctaatgaaaatcaccgacctccggggcatcagcactaagggagctgaaagggccattactctgaagatggagattccaggcccgatgcctcccttaatccgagagatgctggagaaccctgaaatgtttgaggatgactcctcgcagcctggtccccaccccaatgcctctagcgaggatgaggttcctgggggccagggcaaagggggcctgaagtccccagcctgaccagggcccctgacctccccgctgtgggggttggggcttcaggcagcagactgaccatctcccagaccgccagtgactgggggaggacctgctctgccctctccccaccccttccaatgagctccttgtttttgccaaagtttctaggggtgcctctgtgttcatccccttcctgatctaaccggctccctcgccagtcccgggggcctgccctgctcccaccaggagagagggcaaagggatgagcctgggtttggactctaaaatctcagcactgccccatgggtcctagacttcccagggcaagaggaagaccctgccattccacagccccttcctctgccaggtgcttggctctctgagagcaaacaggaacactagagaccaaaaaggggacaaaggagaagggctgagcccaccttcttgctcctacccttggtgcctaatgctgtgtgatgcacctgcagggtgtgtgctagcctctgtgccccgtccttgtgccaggtcaaggtgggggcaggctgggccctgcatttctggggcaggaacagagggtgaaagggacagatagatgcaggtccattctgcacctcttggctcgggtgcagagttcaccctgtgccctccgttataagtccctcccccagccctgtcatgtgccttgggctcctcctgccctccatctcagccattggggcagggaccctcctacactacagaggggccaggggatccctctctccctagtgccttccaccctttactccccagagcagcttggcccagggaggggggatgctgcttagctgatcccgccctgacccagaggaagcctctatttatttattagcttttgtttacaccgtggaattgaccccttcctccaggggtcttgggtgggggagcccagggcccctgtgacccctcctttcttcctccaatccccagtttgtatttagctgccaaataagattcccattggctccctgtgttctcttggggggtcagggtgctgtcccctcccctctgtttacatctcccctctaccccgctgtatcgcatattgctgagttttctatttttgcaaaataaagtgatggaaactca

SEQ ID NO: 76501 - DNA, 2453 bp, Homo sapiens
aaaatattttccgtgtccccgcctgcagagtcagtgtgcggtttgggagaaaatgtgtcggatattttggggcggtcacgtgggcgggcgggctccgagaggccccgggacagtcccagcctagagccgtgcccccccaggagccccccagtacggcgagccccggacattgcgacgctccatccaagagactgcccgacgccgggacctcggggctccgccgcctcccttccccctcccactccagcagctacggcccagttccctcaacctgacccagtatgtagaagccagtctctgcaggcggccagcggggcttctttcgccgaagcatccagaagaacatggtgtacacgtgtcaccgcgacaaaaactgtatcatcaacaaggtgaccaggaatcgctgccagtactgccggctacagaagtgcttcgaagtgggcatgtccaaggaagctgtgcgaaatgaccggaacaagaagaagaaagaggtgaaggaagaagggtcacctgacagctatgagctgagccctcagttagaagagctcatcaccaaggtcagcaaagcccatcaggagactttcccctcgctctgccagctgggcaagtataccacgaactccagtgcagaccaccgcgtgcagctggatctggggctgtgggacaagttcagtgagctggctaccaagtgcatcatcaagatcgtggagtttgccaagcggttgcctggctttacagggctcagcattgctgaccagatcactctgctcaaagctgcctgcctagatatcctgatgctgcgtatctgcacaaggtacaccccagagcaggacaccatgaccttctccgacgggctgaccctgaaccggacccagatgcacaatgccggcttcgggcccctcacagaccttgtctttgcctttgctgggcagctcctgcccctggagatggatgacaccgagacagggctgctcagcgccatctgcctcatctgcggagaccgcatggacctggaggagcccgaaaaagtggacaagctgcaggagccactgctggaagccctgaggctgtacgcccggcgccggcggcccagccagccctacatgttcccaaggatgctaatgaaaatcaccgacctccggggcatcagcactaagggagctgaaagggccattactctgaagatggagattccaggcccgatgcctcccttaatccgagagatgctggagaaccctgaaatgtttgaggatgactcctcgcagcctggtccccaccccaatgcctctagcgaggatgaggttcctgggggccagggcaaagggggcctgaagtccccagcctgaccagggcccctgacctccccgctgtgggggttggggcttcaggcagcagactgaccatctcccagaccgccagtgactgggggaggacctgctctgccctctccccaccccttccaatgagctccttgtttttgccaaagtttctaggggtgcctctgtgttcatccccttcctgatctaaccggctccctcgccagtcccgggggcctgccctgctcccaccaggagagagggcaaagggatgagcctgggtttggactctaaaatctcagcactgccccatgggtcctagacttcccagggcaagaggaagaccctgccattccacagccccttcctctgccaggtgcttggctctctgagagcaaacaggaacactagagaccaaaaaggggacaaaggagaagggctgagcccaccttcttgctcctacccttggtgcctaatgctgtgtgatgcacctgcagggtgtgtgctagcctctgtgccccgtccttgtgccaggtcaaggtgggggcaggctgggccctgcatttctggggcaggaacagagggtgaaagggacagatagatgcaggtccattctgcacctcttggctcgggtgcagagttcaccctgtgccctccgttataagtccctcccccagccctgtcatgtgccttgggctcctcctgccctccatctcagccattggggcagggaccctcctacactacagaggggccaggggatccctctctccctagtgccttccaccctttactccccagagcagcttggcccagggaggggggatgctgcttagctgatcccgccctgacccagaggaagcctctatttatttattagcttttgtttacaccgtggaattgaccccttcctccaggggtcttgggtgggggagcccagggcccctgtgacccctcctttcttcctccaatccccagtttgtatttagctgccaaataagattcccattggctccctgtgttctcttggggggtcagggtgctgtcccctcccctctgtttacatctcccctctaccccgctgtatcgcatattgctgagttttctatttttgcaaaataaagtgatggaaactca

SEQ ID NO: 76502 - DNA, 2208 bp, Homo sapiens
ccgctatagaggatcccgtctgagcagctgggagtaggtcattggcactcggctcctcgtagagggtcttggatagcgggcgaggaagggcagcagctggcacacctccttacgcaaggatgaggtctcctcggcagccaggcacccaggatccgcaccgaggcaaacacaaagggctccttctgcttctctgaccccacctgcagcaggtagtggataacagcccctatggcctccttcatgacgctcacgagctgcagcttctgtggctccttaagcagtgactgctcacagcgagtgcattcctggatccccaactccatgagggcatagaaggcggtcgccacatcctctttcacctccgtgcccgtcaactccagtgcagaccaccgcgtgcagctggatctggggctgtgggacaagttcagtgagctggctaccaagtgcatcatcaagatcgtggagtttgccaagcggttgcctggctttacagggctcagcattgctgaccagatcactctgctcaaagctgcctgcctagatatcctgatgctgcgtatctgcacaaggtacaccccagagcaggacaccatgaccttctccgacgggctgaccctgaaccggacccagatgcacaatgccggcttcgggcccctcacagaccttgtctttgcctttgctgggcagctcctgcccctggagatggatgacaccgagacagggctgctcagcgccatctgcctcatctgcggagaccgcatggacctggaggagcccgaaaaagtggacaagctgcaggagccactgctggaagccctgaggctgtacgcccggcgccggcggcccagccagccctacatgttcccaaggatgctaatgaaaatcaccgacctccggggcatcagcactaagggagctgaaagggccattactctgaagatggagattccaggcccgatgcctcccttaatccgagagatgctggagaaccctgaaatgtttgaggatgactcctcgcagcctggtccccaccccaatgcctctagcgaggatgaggttcctgggggccagggcaaagggggcctgaagtccccagcctgaccagggcccctgacctccccgctgtgggggttggggcttcaggcagcagactgaccatctcccagaccgccagtgactgggggaggacctgctctgccctctccccaccccttccaatgagctccttgtttttgccaaagtttctaggggtgcctctgtgttcatccccttcctgatctaaccggctccctcgccagtcccgggggcctgccctgctcccaccaggagagagggcaaagggatgagcctgggtttggactctaaaatctcagcactgccccatgggtcctagacttcccagggcaagaggaagaccctgccattccacagccccttcctctgccaggtgcttggctctctgagagcaaacaggaacactagagaccaaaaaggggacaaaggagaagggctgagcccaccttcttgctcctacccttggtgcctaatgctgtgtgatgcacctgcagggtgtgtgctagcctctgtgccccgtccttgtgccaggtcaaggtgggggcaggctgggccctgcatttctggggcaggaacagagggtgaaagggacagatagatgcaggtccattctgcacctcttggctcgggtgcagagttcaccctgtgccctccgttataagtccctcccccagccctgtcatgtgccttgggctcctcctgccctccatctcagccattggggcagggaccctcctacactacagaggggccaggggatccctctctccctagtgccttccaccctttactccccagagcagcttggcccagggaggggggatgctgcttagctgatcccgccctgacccagaggaagcctctatttatttattagcttttgtttacaccgtggaattgaccccttcctccaggggtcttgggtgggggagcccagggcccctgtgacccctcctttcttcctccaatccccagtttgtatttagctgccaaataagattcccattggctccctgtgttctcttggggggtcagggtgctgtcccctcccctctgtttacatctcccctctaccccgctgtatcgcatattgctgagttttctatttttgcaaaataaagtgatggaaactca

SEQ ID NO: 76503 - DNA, 1349 bp, Homo sapiens
ctcggcccgactatctctctgtggggcacgacctccggggctcagcactaagtggagctgaaagggccattactctgaagatggagattccaggcccgatgcctcccttaatccgagagatgctggagaaccctgaaatgtttgaggatgactcctcgcagcctggtccccaccccaatgcctctagcgaggatgaggttcctgggggccagggcaaagggggcctgaagtccccagcctgaccagggcccctgacctccccgctgtgggggttggggcttcaggcagcagactgaccatctcccagaccgccagtgactgggggaggacctgctctgccctctccccaccccttccaatgagctccttgtttttgccaaagtttctaggggtgcctctgtgttcatccccttcctgatctaaccggctccctcgccagtcccgggggcctgccctgctcccaccaggagagagggcaaagggatgagcctgggtttggactctaaaatctcagcactgccccatgggtcctagacttcccagggcaagaggaagaccctgccattccacagccccttcctctgccaggtgcttggctctctgagagcaaacaggaacactagagaccaaaaaggggacaaaggagaagggctgagcccaccttcttgctcctacccttggtgcctaatgctgtgtgatgcacctgcagggtgtgtgctagcctctgtgccccgtccttgtgccaggtcaaggtgggggcaggctgggccctgcatttctggggcaggaacagagggtgaaagggacagatagatgcaggtccattctgcacctcttggctcgggtgcagagttcaccctgtgccctccgttataagtccctcccccagccctgtcatgtgccttgggctcctcctgccctccatctcagccattggggcagggaccctcctacactacagaggggccaggggatccctctctccctagtgccttccaccctttactccccagagcagcttggcccagggaggggggatgctgcttagctgatcccgccctgacccagaggaagcctctatttatttattagcttttgtttacaccgtggaattgaccccttcctccaggggtcttgggtgggggagcccagggcccctgtgacccctcctttcttcctccaatccccagtttgtatttagctgccaaataagattcccattggctccctgtgttctcttggggggtcagggtgctgtcccctcccctctgtttacatctcccctctaccccgctgtatcgcatattgctgagttttctatttttgcaaaataaagtgatggaaactca

SEQ ID NO: 76504 - DNA, 399 bp, Homo sapiens
ttgatccatgcaaagatttccttaccctgcaccccctgccacacatgtgggactcctcagctctcttttcgtcttagcctctgcccctatgacctgatcctagacttttggatgccctgtctcctcctgacttcccgggactacccctgccaagcctcagatcctccacctctgccttctccatgcctgcttcaggttgcactcactggggacctaacctcctcactttccactcattccctcttttccccatcccccagaaacagcactaaccctcctccaccccccacctccagatgctgcgtatctgcacaaggtacaccccagagcaggacaccatgaccttctccgacgggctgaccctgaaccggacccagatgcacaatgccggcttcgggc

SEQ ID NO: 76505 - DNA, 825 bp, Homo sapiens
aaaaaaaacctgtaacatatacagtgtacttagaattgtgctgaattaaaaattccattctgcagttgcagtagtcacatttcagattgccacatgtggccaatgactactgtattcctatcattgcaaagttctattggacagtccaggcttagaaggatgtctggaacatagtgtttgataaatattagctgtggtaataaatgttattaagagaacaggactaggaacaagtgacaagctctggacattcgagagtggggtacttggggagtggggttggaagttgtgtgcattgcgctcgctgaagagacagcctgaaagaatgggatgaatgggcagcaagcctggtagagaaggccaggtagaggttccaggcagaggagtggcacccaggaagcctagtgagaagaggatgagctggggacggagaggtggtgggcctgtgctgggcgccccctaggggagtcaggggcagttgagaaaggttagggagatggccttaagggccatgtgcctctgtcctcctgagcctctctctttctctctccattgtaggagctgaaagggccattactctgaagatggagattccaggcccgatgcctcccttaatccgagagatgctggagaaccctgaaatgtttgaggatgactcctcgcagcctggtccccaccccaatgcctctagcgaggatgaggttcctgggggccagggcaaagggggcctgaagtccccagcctgaccagggcccctgacctccccgctgtgggggttggggcttcaggcagcagactgaccatctcccagaccgccagtgactg

SEQ ID NO: 76506 - DNA, 3415 bp, Homo sapiens
  misc_feature (3415)..(3415): n is a, c, g, or t
aaaatattttccgtgtccccgcctgcagagtcagtgtgcggtttgggagaaaatgtgtcggatattttggggcggtcacgtgggcgggcgggctccgagaggccccgggacagtcccagcctagagccgtgcccccccaggagccccccagtacggcgagccccggacattgcgacgctccatccaagagactgcccgacgccgggacctcggggctccgccgcctcccttccccctcccactccagcagctacggcccagttccctcaacctgacccagtatgtagaagccagtctctgcaggcggccagcgggacttttggaggcccagtgggcaggccaggcagggcgggtacggagcctcccaggctggggcagtgggcatgggcaggggctgtggctgaagacctcgcccgcccactgcagaccccaggggactctcacaccgcagctgccatggccaccaataaggagcgactctttgcggctggtgccctggggcctggatctggctacccaggggcaggtttccccttcgccttcccaggggcactcagggggtctccgcctttcgagatgctgagccctagcttccggggcctgggccagcctgacctccccaaggagatggcctctctgtcggtggagacacagagcaccagctcagaggagatggtgcccagctcgccctcgccccctccgcctcctcgggtctacaagccatgcttcgtgtgcaatgacaagtcctctggctaccactatggggtcagctcttgtgaaggctgcaagggcttctttcgccgaagcatccagaagaacatggtgtacacgtgtcaccgcgacaaaaactgtatcatcaacaaggtgaccaggaatcgctgccagtactgccggctacagaagtgcttcgaagtgggcatgtccaaggaagctgtgcgaaatgaccggaacaagaagaagaaagaggtgaaggaagaagggtcacctgacagctatgagctgagccctcagttagaagagctcatcaccaaggtcagcaaagcccatcaggagactttcccctcgctctgccagctgggcaagtataccacgaactccagtgcagaccaccgcgtgcagctggatctggggctgtgggacaagttcagtgagctggctaccaagtgcatcatcaagatcgtggagtttgccaagcggttgcctggctttacagggctcagcattgctgaccagatcactctgctcaaagctgcctgcctagatatcctgatgctgcgtatctgcacaaggtacaccccagagcaggacaccatgaccttctccgacgggctgaccctgaaccggacccagatgcacaatgccggcttcgggcccctcacagaccttgtctttgcctttgctgggcagctcctgcccctggagatggatgacaccgagacagggctgctcagcgccatctgcctcatctgcggagaccgcatggacctggaggagcccgaaaaagtggacaagctgcaggagccactgctggaagccctgaggctgtacgcccggcgccggcggcccagccagccctacatgttcccaaggatgctaatgaaaatcaccgacctccggggcatcagcactaagggagctgaaagggccattactctgaagatggagattccaggcccgatgcctcccttaatccgagagatgctggagaaccctgaaatgtttgaggatgactcctcgcagcctggtccccaccccaatgcctctagcgaggatgaggttcctgggggccagggcaaagggggcctgaagtccccagcctgaccagggcccctgacctccccgctgtgggggttggggcttcaggcagcagactgaccatctcccagaccgccagtgactgggggaggacctgctctgccctctccccaccccttccaatgagctccttgtttttgccaaagtttctaggggtgcctctgtgttcatccccttcctgatctaaccggctccctcgccagtcccgggggcctgccctgctcccaccaggagagagggcaaagggatgagcctgggtttggactctaaaatctcagcactgccccatgggtcctagacttcccagggcaagaggaagaccctgccattccacagccccttcctctgccaggtgcttggctctctgagagcaaacaggaacactagagaccaaaaaggggacaaaggagaagggctgagcccaccttcttgctcctacccttggtgcctaatgctgtgtgatgcacctgcagggtgtgtgctagcctctgtgccccgtccttgtgccaggtcaaggtgggggcaggctgggccctgcatttctggggcaggaacagagggtgaaagggacagatagatgcaggtccattctgcacctcttggctcgggtgcagagttcaccctgtgccctccgttataagtccctcccccagccctgtcatgtgccttgggctcctcctgccctccatctcagccattggggcagggaccctcctacactacagaggggccaggggatccctctctccctagtgccttccaccctttactccccagagcagcttggcccagggaggggggatgctgcttagctgatcccgccctgacccagaggaagcctctatttatttattagcttttgtttacaccgtggaattgaccccttcctccaggggtcttgggtgggggagcccagggcccctgtgacccctcctttcttcctccaatccccagtttgtatttagctgccaaataagattcccattggctccctgtgttctcttggggggtcagggtgctgtcccctcccctctgtttacatctcccctctaccccgctgtatcgcatattgctgagttttctatttttgcaaaataaagtgatggaaactcaaaaaaaaaaaaaaaaaaaaaaaaagaaaaaaaaaaaaaaaaaaaaaaggggggggggcgcgcgaaaaaaaattccccgggggggccccaaaatttagggcggtccccagttttttttgtgaaaaaagggggccccaattgagggggggtggtttatataaaaagaaaggagggggcgcggggtttaaaaaaggtcgcgtgacggggaaaacaatcgggtaacccacgcggcaactcttggggagagacgagcaccccctaatactctgcggggggggggggacaactagtgtgtgcggacacacaacaaaccccacagagaattatttaaacgtccctaaggggaaaagatttaacattttgacacgcgttatacgtgtcggtcaaacagcacacgcatattacagcggcggtcaaaaagtttgcgcacacggcgaatataattctcacgagcaacaattttatcgcgaagtgagtacaataaaagn

SEQ ID NO: 76507 - DNA, 2679 bp, Homo sapiens
agataagagctggacggaggctaaagcggcagccccagcttcgcgccccgcccagtccctttcccctgctggggatcccccctcttccccgcccaccccttacccgcatgcagcccagcgccctatgctagccctccccctccccccctgctggagcggggcgccgccgggggaggagggggaatcggctgcgggtccttggtgtttccagcacccagtttcccttcaagccgggtcgcgatgtacgactgtatggaaacgtttgccccgggtccgcgacggctgtacggggcggccgggcccggggccggcttgctgcgcagagccaccggcggctcctgtttcgccggacttgaatcttttgcctggccgcaacccgccagcctgcaatcggtggagacacagagcaccagctcagaggagatggtgcccagctcgccctcgccccctccgcctcctcgggtctacaagccatgcttcgtgtgcaatgacaagtcctctggctaccactatggggtcagctcttgtgaaggctgcaagggcttctttcgccgaagcatccagaagaacatggtgtacacgtgtcaccgcgacaaaaactgtatcatcaacaaggtgaccaggaatcgctgccagtactgccggctacagaagtgcttcgaagtgggcatgtccaaggaagctgtgcgaaatgaccggaacaagaagaagaaagaggtgaaggaagaagggtcacctgacagctatgagctgagccctcagttagaagagctcatcaccaaggtcagcaaagcccatcaggagactttcccctcgctctgccagctgggcaagtataccacgaactccagtgcagaccaccgcgtgcagctggatctggggctgtgggacaagttcagtgagctggctaccaagtgcatcatcaagatcgtggagtttgccaagcggttgcctggctttacagggctcagcattgctgaccagatcactctgctcaaagctgcctgcctagatatcctgatgctgcgtatctgcacaaggtacaccccagagcaggacaccatgaccttctccgacgggctgaccctgaaccggacccagatgcacaatgccggcttcgggcccctcacagaccttgtctttgcctttgctgggcagctcctgcccctggagatggatgacaccgagacagggctgctcagcgccatctgcctcatctgcggagaccgcatggacctggaggagcccgaaaaagtggacaagctgcaggagccactgctggaagccctgaggctgtacgcccggcgccggcggcccagccagccctacatgttcccaaggatgctaatgaaaatcaccgacctccggggcatcagcactaagggagctgaaagggccattactctgaagatggagattccaggcccgatgcctcccttaatccgagagatgctggagaaccctgaaatgtttgaggatgactcctcgcagcctggtccccaccccaatgcctctagcgaggatgaggttcctgggggccagggcaaagggggcctgaagtccccagcctgaccagggcccctgacctccccgctgtgggggttggggcttcaggcagcagactgaccatctcccagaccgccagtgactgggggaggacctgctctgccctctccccaccccttccaatgagctccttgtttttgccaaagtttctaggggtgcctctgtgttcatccccttcctgatctaaccggctccctcgccagtcccgggggcctgccctgctcccaccaggagagagggcaaagggatgagcctgggtttggactctaaaatctcagcactgccccatgggtcctagacttcccagggcaagaggaagaccctgccattccacagccccttcctctgccaggtgcttggctctctgagagcaaacaggaacactagagaccaaaaaggggacaaaggagaagggctgagcccaccttcttgctcctacccttggtgcctaatgctgtgtgatgcacctgcagggtgtgtgctagcctctgtgccccgtccttgtgccaggtcaaggtgggggcaggctgggccctgcatttctggggcaggaacagagggtgaaagggacagatagatgcaggtccattctgcacctcttggctcgggtgcagagttcaccctgtgccctccgttataagtccctcccccagccctgtcatgtgccttgggctcctcctgccctccatctcagccattggggcagggaccctcctacactacagaggggccaggggatccctctctccctagtgccttccaccctttactccccagagcagcttggcccagggaggggggatgctgcttagctgatcccgccctgacccagaggaagcctctatttatttattagcttttgtttacaccgtggaattgaccccttcctccaggggtcttgggtgggggagcccagggcccctgtgacccctcctttcttcctccaatccccagtttgtatttagctgccaaataagattcccattggctccctgtgttctcttggggggtcagggtgctgtcccctcccctctgtttacatctcccctctaccccgctgtatcgcatattgctgagttttctatttttgcaaaataaagtgatggaaactca

SEQ ID NO: 76508 - DNA, 2592 bp, Homo sapiens
aaaatattttccgtgtccccgcctgcagagtcagtgtgcggtttgggagaaaatgtgtcggatattttggggcggtcacgtgggcgggcgggctccgagaggccccgggacagtcccagcctagagccgtgcccccccaggagccccccagtacggcgagccccggacattgcgacgctccatccaagagactgcccgacgccgggacctcggggctccgccgcctcccttccccctcccactccagcagctacggcccagttccctcaacctgacccagtatgtagaagccagtctctgcaggcggccagcgggacttttggaggcccagtgggcaggccaggcagggcgggtacggagcctcccaggctggggcagtgggcatgggcaggggctgtggctgaagacctcgcccgcccactgcagaccccaggggactctcacaccgcagctgccatggccaccaataaggagcgactctttgcggctggtgccctggggcctggatctggctacccaggggcaggtttccccttcgccttcccaggggcactcagggggtctccgcctttcgagatgctgagccctagcttccggggcctgggccagcctgacctccccaaggagatggcctctctgtcggtggagacacagagcaccagctcagaggagatggtgcccagctcgccctcgccccctccgcctcctcgggtctacaagccatgcttcgtgtgcaatgacaagtcctctggctaccactatggggtcagctcttgtgaaggctgcaagggcttctttcgccgaagcatccagaagaacatggtgtacacgtgtcaccgcgacaaaaactgtatcatcaacaaggtgaccaggaatcgctgccagtactgccggctacagaagtgcttcgaagtgggcatgtccaaggaagctgtgcgaaatgaccggaacaagaagaagaaagaggtgaaggaagaagggtcacctgacagctatgagctgagccctcagttagaagagctcatcaccaaggtcagcaaagcccatcaggagactttcccctcgctctgccagctgggcaagtataccacgaactccagtgcagaccaccgcgtgcagctggatctggggctgtgggacaagttcagtgagctggctaccaagtgcatcatcaagatcgtggagtttgccaagcggttgcctggctttacagggctcagcattgctgaccagatcactctgctcaaagctgcctgcctagatatcctgatgctgcgtatctgcacaaggtacaccccagagcaggacaccatgaccttctccgacgggctgaccctgaaccggacccagatgcacaatgccggcttcgggcccctcacagaccttgtctttgcctttgctgggcagctcctgcccctggagatggatgacaccgagacagggctgctcagcgccatctgcctcatctgcggagaccgcatggacctggaggagcccgaaaaagtggacaagctgcaggagccactgctggaagccctgaggctgtacgcccggcgccggcggcccagccagccctacatgttcccaaggatgctaatgaaaatcaccgacctccggggcatcagcactaagggagctgaaagggccattactctgaagatggagattccaggcccgatgcctcccttaatccgagagatgctggagaaccctgaaatgtttgaggatgactcctcgcagcctggtccccaccccaatgcctctagcgaggatgaggttcctgggggccagggcaaagggggcctgaagtccccagcctgaccagggcccctgacctccccgctgtgggggttggggcttcaggcagcagactgaccatctcccagaccgccagtgactgggggaggacctgctctgccctctccccaccccttccaatgagctccttgtttttgccaaagtttctaggggtgcctctgtgttcatccccttcctgatctaaccggctccctcgccagtcccgggggcctgccctgctcccaccaggagagagggcaaagggatgagcctgggtttggactctaaaatctcagcactgccccatgggtcctagacttcccagggcaagaggaagaccctgccattccacagccccttcctctgccaggtgcttggctctctgagagcaaacaggaacactagagaccaaaaaggggacaaaggagaagggctgagcccaccttcttgctcctacccttggtgcctaatgctgtgtgatgcacctgcagggtgtgtgctagcctctgtgccccgtccttgtgccaggtcaaggtgggaagtcgacttcccaccgggaaaagaagctttctttaaaactaaaagggttttttggggggggagttggcggggaggaaataaggctaacagaggttgacctaaaattagccttacaaaggagaaaggaccacattgcttacttgaaacagacaatgaaaacaaccaaagtgatatataaaatagttgatgagaactagacttatgactgtagtttactagagtttagttttcagttgctgaagtagctcattttct

SEQ ID NO: 76509 - DNA, 1478 bp, Homo sapiens
  misc_feature (1253)..(1253): n is a, c, g, or t
  misc_feature (1431)..(1431): n is a, c, g, or t
  misc_feature (1449)..(1449): n is a, c, g, or t
  misc_feature (1458)..(1458): n is a, c, g, or t
agataagagctggacggaggctaaagcggcagccccagcttcgcgccccgcccagtccctttcccctgctggggatcccccctcttccccgcccaccccttacccgcatgcagcccagcgccctatgctagccctccccctccccccctgctggagcggggcgccgccgggggaggagggggaatcggctgcgggtccttggtgtttccagcacccagtttcccttcaagccgggtcgcgatgtacgactgtatggaaacgtttgccccgggtccgcgacggctgtacggggcggccgggcccggggccggcttgctgcgcagagccaccggcggctcctgtttcgccggacttgaatcttttgcctggccgcaacccgccagcctgcaatcggtggagacacagagcaccagctcagaggagatggtgcccagctcgccctcgccccctccgcctcctcgggtctacaagccatgcttcgtgtgcaatgacaagtcctctggctaccactatggggtcagctcttgtgaaggctgcaagggcttctttcgccgaagcatccagaagaacatggtgtacacgtgtcaccgcgacaaaaactgtatcatcaacaaggtgaccaggaatcgctgccagtactgccggctacagaagtgcttcgaagtgggcatgtccaaggaagctgtgcgaaatgaccggaacaagaagaagaaagaggtgaaggaagaagggtcacctgacagctatgagctgagccctcagttagaagagctcatcaccaaggtcagcaaagcccatcaggagactttcccctcgctctgccagctgggcaagtataccacgaactccagtgcagaccaccgcgtgcagctggatctggggctgtgggacaagttcagtgagctggctaccaagtgcatcatcaagatcgtggagtttgccaagcggttgcctggctttacagggctcagcattgctgaccagatcactctgctcaaagctgcctgcctagatatcctgatgctgcgtatctgcacaaggtacaccccagagcaggacaccatgaccttctccgacgggctgaccctgaaccggacccagatgcacaatgccggcttcgggcccctcacagaccttgtctttgcctttgctgggcagctcctgcccctggagatggatgacaccgagacagggctgctcagcgccatctgcctcatctgcggagaccgcatggacctggaggaacagcagtntgccgacggtcatattgcactcaacagttaagtccaaaacattcggttcagagttagcttttccccattttggcaatcagttcgtcacaaatcttggtgagttcttctatttctttattcttctgctccagcgtccttttcagggcgtccactcgcagctgctccttccgcagctggnctggtgggcggcttgctnctgctgggncttgctcgaacctgagcaat

SEQ ID NO: 76510 - DNA, 346 bp, Homo sapiens
tacaagtttacagatcacaaggtcactgaaataaatcactatgtgaaaaaaaacagctatgaaatagttgaagaattttccttctagtttaaaggaaaacctggaaaatattttcatctatatgtctagcaatctccttattcaacaacatttcacaacagggagctgtatcattcattttggaaaaaagcataaggagtactagataacaaagggccaaataaaacaacagtttatgggaaatgtgccaccaactgacaagaggagatgaagagtttctatacgtcaataaccagttctcttcattcacttacccatttatttattcaacaacaacttattgagc

SEQ ID NO: 76511 - DNA, 481 bp, Homo sapiens
taattgccttttcttgtctttaaaatcatcaccagggctgggcacttactgtgtgcaggcgctgttctatggactcaggatacatcagctaccgaagcaaagatccctaaccttgtgaaactgacattctggtgggaggacagatccaataaaaactaaaataaataagtcaatgatgtagtgtgttaaaaagtgatcggtgctggctgggcgccgtggctcatgcctatgatcccaacactttgggaagccgaggcaggcggatcacctgaggtcaggagttcgagaccagcctggccaacatggtgaaaccctgtctctagtaaaaatacaaaattagctgggtgtgatggcacacacctgtaatcccagctactctggaggctgaggcaggagaatcgcttgaacccggaagccgagttcgtgactcagatgtcccccacaccccacctggcaccaccttctggacggggatcctctg

SEQ ID NO: 76512 - DNA, 721 bp, Homo sapiens
agctctggcttcgtttgtgaaacccgacgggatgaagggctaggctcgcctccagagtagtgtagtttctcccgccgtgggcacccggccccttgctaccccgcaaaatctcgcgaccatttactctggccatccgaaggcgcgtgcctgggttgcactcccgtgtccggccctcgaggttcttgcctagggaagacccgagccctagggccgtacttaagctgcctgcgtgcaggacccgggttttgcttttgctaatttcctccccaccccagggctgggcacttactgtgtgcaggcgctgttctatggactcaggatacatcagctaccgaagcaaagatccctaaccttgtgaaactgacattctggtgggaggacagatccaataaaaactaaaataaataagtcaatgatgtagtgtgttaaaaagtgatcggtgctggctgggcgccgtggctcatgcctatgatcccaacactttgggaagccgaggcaggcggatcacctgaggtcaggagttcgagaccagcctggccaacatggtgaaaccctgtctctagtaaaaatacaaaattagctgggtgtgatggcacacacctgtaatcccagctactctggaggctgaggcaggagaatcgcttgaacccggaagccgagttcgtgactcagatgtcccccacaccccacctggcaccaccttctggacggggatcctctg

SEQ ID NO: 76513 - DNA, 268 bp, Homo sapiens
gattgttccattcgattctattcggtgattccattcgattccatttgataatgattccaatcgagaccattcgatgattccattcaattccattcaataatgatccctttcgagtccattcaatgattccgtttttttccgtttgatgttgattccattcgattccattcgatgataattccattcgattctatgcgatgattccattccattccatttgaagatgattccattcgagaccattcgatgattgcattcaattcattcg

SEQ ID NO: 76514 - DNA, 313 bp, Homo sapiens
aaaaaaatatttttttttcttaagcaaccattgcttcagtttttttcctacatacagctaagtaagacactcttacattcactaaggtgctaattaaaatgataatcaattcatttaatcctggatggtagaactgttgtcattaattcaactttaaaaagtaaatgatttccaggtaaaagtttactaactatcaagagtagagagctaattgctgataataatgttagcaaatatgtcctaggtagtaataataacattagtactactactagtagtactagtagaagtaatagtggtactagtaatagta

SEQ ID NO: 76515 - DNA, 519 bp, Homo sapiens
aaaaaaaaaaaaaaactgggcgcagtggctcacgcctgtaattccagcactttgtgaggccgaggcaggcagatcacttgaggccaggagtttgaaaccagcctggctaacattgcgaaactccatctctactaaaaatacaaaaattagccaggcgcagtggtgggcgcctgtaattccagctactcgggaggctgaggcaggagagtggcttgaactcgggaggcggaggttgcaatgagctgaaatcgagccattgcacttcagcctgggtgacagaacaagactgtctcagaaaaaaaaaaaagaactttctttgatatctacaaagggattctgtgtggagattttgaactctgagccatgaatctagtcataaactggggaacggcattccaggaagaggaatcggaatatataaaagataaaaactggagagcaagttacgcataagaagcaaaaacagtgctatatacttggagcactgggcatcagagtttggagcggagtcagaaactc

SEQ ID NO: 76516 - DNA, 418 bp, Homo sapiens
cttgggttttgcttttgttctatgagagctccccatcctgccttaccccagtgatacagattggagggttcagaaaatgggcatgtttgtaaacatatgacagaaatgagccaggcatggtggctcacgtctgtaatcccagcactttgggaggccaaggcaggagggttgcttgacaccaggagtttgagaccagctgggcaacatagtaagatcctgtctctataaaaaataactttaaaaaaattagcggagtgtggtgacacaccagtagtcccagctacttgcaacactgagatgggaggctcacttgagcccaggagctcgaggttacggtcagctgcagtcatgcctccgcactcctgtctgggcgatgagatcatgtctctgaaaaaagaaacagtaaaagtaaaattta

SEQ ID NO: 76517 - DNA, 3759 bp, Homo sapiens
agcgggctgtgcgcggtgaactcggcggctgcactggcggcagctggaggtgtaatagtgcgggtagtgggtttggagaagttccgaggcggcggtggcgccggtcaggacaaggatagcggaaccgggccctgggcttgtcgctcaccatgccgacagtagaggagctttaccgcaattatggcatcctggccgatgccacggagcaagtgggccagcataaagatgcctatcaagtgatattggatggtgtgaaaggtggtactaaggaaaagcgattagcagctcaatttattccgaaattctttaagcattttccagaattggctgattctgctatcaatgcacagttagacctctgtgaggatgaagatgtatctattcgacgtcaagcaattaaagaactgcctcaatttgccactggagaaaatccttcctcgagtggccagataatactaacgcaacttttgccagaacagatgactctgccagaatttaaccctagtgaacaatgccccctattaagtatatttaaaatggatgcaaaagggacttttaggtgggttgttcagcccaaatacttcaaggagaggacattgttagagaacgagcaattaaattcctttctacaaaacttaagactttaccagatgaagtcttaacaaaggaagtggaagagcttatactaactgaatccaaaaaggtcctagaagatgtgactggtgaagaatttgttctatttatgaagatactgtctgggttaaaaagcttacagacagtgagtggaagacagcaacttgtagagttggtggctgaacaggccgacctagaacagaccttcaatccctcggatcctgactgtgtggacaggctcttacagtgcactcggcaggcagtacccctcttctctaaaaatgtccattccacaaggtttgtgacatatttctgtgagcaggttctccctaacctcggtaccttgactaccccagtggaaggtcttgatatacagttggaggtattgaaattgttggcggagatgagttcattttgtggtgacatggaaaaactagaaacaaatttaaggaaactatttgataagttattggaatacatgcccctccctccagaagaggcagaaaatggagagaatgctggtaatgaagaacccaagctacagttcagttatgtggaatgtttgttgtacagttttcaccagttgggccgaaaacttccagatttcttaacagccaaactgaatgcagaaaagctcaaagatttcaaaatcaggctgcagtactttgcacggggcctgcaagtttatatcagacaacttcgcttagctctccagggtaaaacgggtgaggccttaaaaacagaagagaacaagattaaagtcgttgcattgaaaataacaaacaatatcaatgttttaatcaaggatctcttccacattcctccttcttataagagcacagtaacactatcctggaaacctgtacaaaaggttgagattgggcaaaagagagccagtgaagatacaacttcaggttcaccacccaagaaatcttcagcaggaccaaaaagagatgccaggcagatttataaccctcccagtgggaaatatagcagcaatttgggcaactttaattatgagagagaggagccttcaggggaagtagaggtggccgaggttggggcacacgaggaaatcgtagtcggggaagactctactgaataagacatcagcattcttcagcattgtcatgagcttaatatacttaaattctactactcattggattgccggggatgtccctttaaacagactgctgccttcagctaaaaacttaatgttctttatacctttgtatgtatgacctacttttgtaacagaccatggttgtgtccaaggtaaaaccacagtgatatttttggatgctttgtctgcaatcttgacttgtttttgcagtatcattattcagacttcaaattgtgaatcttttaaacatcttgataatttgttgttgagagctgttcattctaaaatgtaatgaaattcagtctagttctgctgataaagatcatcagttttgaaaggttactgattttcctcttccctcttagttttttacccaatatatggagaagagtaatggtcaatcttaacattttgttttaattgtttaataaagctgctgggcagtggtgcagcattcctacctagtgtcataaaagcaaaatacttacatagctttcttaaaatataggaatgacattacatttttaggagaaagtaagttgctttgcaccgcctacttaattcttttccatatattgtgatacaaacttttgaatatggaatcttactatttgaatagaaatgtgtatgtataatatacatacatacataagcatatatgtgtgtgtgtgtgtgtatatatatatatatgcatgctgtgaaacttgactacacaacataaatcactttttaaattccaggaacgggtagtctgacacggtgattatccttttgaggctgaatccgttattaacttgttatttaggtttttactcccagtagcaagggattctaagttagttgcacttacatgattattgttatttaaaactaagaataaaggctgcattttcaaagataaattggaattgctgttggtgaaataacaaccaaaatactgaatctgatgtacatacaggtttctacaggaagagatggtataatttacaatttggagatttaataaccagggctacccagaaaaagtgacttgataacatggtaccaataagtaagggatgctctctcggtttgcttttgccactttcaagattttaacttctcaggttattaatcaaaattattgtataagttagccaatagaatttttaggttaaaacaacagatggggggtttgtggagtgtttaatgtcatgggcatttttagtagcatagaccctttgttctgcatttgaatgtttcgtatatttttgtttcacagttaatcttccaagtttactattcaagtcagaaattcagatgacatttctagtggtttgctgttttggttttttatgttttttggttttttttgaggtttcatttcttacacaggtgttttcatcaccatcaattttacactgggggaaaaacaattcctttattagaattactgcacatgtgtatggggaaaatagttctgaaaggctagaatgatacaagtgagcaaaagttggtcagcttggctatggagtggtggcaataatctctaaacattccaaaagaccatgagctgaacctaaactcccttggaatctgaacaaaggaatataaaattgccatttgaaaactgaccagctaatctggacctcagagatagatcagccagtggcccaaagccatttcaagtacagaaattatagagactacagctaaataaatttgaacattaaatataattttaccactttttgtctttataagcatatttgtaaactcagaactgagcagaagtgactttactttctcaagtttgatactgagttgactgttcccttatccctcacccttccccttccctttcctaaggcaatagtgcacaacttaggttatttttgcttccgaatttgaatgaaaaacttaatgccatggatttttttcttttgcaagacacctgtttatcatcttgtttaaatgtaaatgtccccttatgcttttgaaataaatttccttttgtaatt

SEQ ID NO: 76518 - DNA, 3674 bp, Homo sapiens
agcgggctgtgcgcggtgaactcggcggctgcactggcggcagctggaggtgtaatagtgcgggtagtgggtttggagaagttccgaggcggcggtggcgccggtcaggacaaggatagcggaaccgggccctgggcttgtcgctcaccatgccgacagtagaggagctttaccgcaattatggcatcctggccgatgccacggagcaagtgggccagcataaagatgcctatcaagtgatattggatggtgtgaaaggtggtactaaggaaaagcgattagcagctcaatttattccgaaattctttaagcattttccagaattggctgattctgctatcaatgcacagttagacctctgtgaggatgaagatgtatctattcgacgtcaagcaattaaagaactgcctcaatttgccactggagaaaatccttcctcgagtggccagataatactaacgcaacttttgccagaacagatgactctgccagaatttaaccctagtgaacaatgccccctattaagtatatttaaaatggatgcaaaagggacttttaggtgggttgttcagcccaaatacttcaaggagaggacattgttagagaacgagcaattaaattcctttctacaaaacttaagactttaccagatgaagtcttaacaaaggaagtggaagagcttatactaactgaatccaaaaaggtcctagaagatgtgactggtgaagaatttgttctatttatgaagatactgtctgggttaaaaagcttacagacagtgagtggaagacagcaacttgtagagttggtggctgaacaggccgacctagaacagaccttcaatccctcggatcctgactgtgtggacaggctcttacagtgcactcggcaggcagtacccctcttctctaaaaatgtccattccacaaggtttgtgacatatttctgtgagcaggttctccctaacctcggtaccttgactaccccagtggaaggtcttgatatacagttggaggtattgaaattgttggcggagatgagttcattttgtggtgacatggaaaaactagaaacaaatttaaggaaactatttgataagttattggaatacatgcccctccctccagaagaggcagaaaatggagagaatgctggtaatgaagaacccaagctacagttcagttatgtggaatgtttgttgtacagttttcaccagttgggccgaaaacttccagatttcttaacagccaaactgaatgcagaaaagctcaaagatttcaaaatcaggctgcagtactttgcacggggcctgcaagtttatatcagacaacttcgcttagctctccagggtaaaacgggtgaggccttaaaaacagaagagaacaagattaaagtcgttgcattgaaaataacaaacaatatcaatgttttaatcaaggcaaaagagagccagtgaagatacaacttcaggttcaccacccaagaaatcttcagcaggaccaaaaagagatgccaggcagatttataaccctcccagtgggaaatatagcagcaatttgggcaactttaattatgagagagaggagccttcaggggaagtagaggtggccgaggttggggcacacgaggaaatcgtagtcggggaagactctactgaataagacatcagcattcttcagcattgtcatgagcttaatatacttaaattctactactcattggattgccggggatgtccctttaaacagactgctgccttcagctaaaaacttaatgttctttatacctttgtatgtatgacctacttttgtaacagaccatggttgtgtccaaggtaaaaccacagtgatatttttggatgctttgtctgcaatcttgacttgtttttgcagtatcattattcagacttcaaattgtgaatcttttaaacatcttgataatttgttgttgagagctgttcattctaaaatgtaatgaaattcagtctagttctgctgataaagatcatcagttttgaaaggttactgattttcctcttccctcttagttttttacccaatatatggagaagagtaatggtcaatcttaacattttgttttaattgtttaataaagctgctgggcagtggtgcagcattcctacctagtgtcataaaagcaaaatacttacatagctttcttaaaatataggaatgacattacatttttaggagaaagtaagttgctttgcaccgcctacttaattcttttccatatattgtgatacaaacttttgaatatggaatcttactatttgaatagaaatgtgtatgtataatatacatacatacataagcatatatgtgtgtgtgtgtgtgtatatatatatatatgcatgctgtgaaacttgactacacaacataaatcactttttaaattccaggaacgggtagtctgacacggtgattatccttttgaggctgaatccgttattaacttgttatttaggtttttactcccagtagcaagggattctaagttagttgcacttacatgattattgttatttaaaactaagaataaaggctgcattttcaaagataaattggaattgctgttggtgaaataacaaccaaaatactgaatctgatgtacatacaggtttctacaggaagagatggtataatttacaatttggagatttaataaccagggctacccagaaaaagtgacttgataacatggtaccaataagtaagggatgctctctcggtttgcttttgccactttcaagattttaacttctcaggttattaatcaaaattattgtataagttagccaatagaatttttaggttaaaacaacagatggggggtttgtggagtgtttaatgtcatgggcatttttagtagcatagaccctttgttctgcatttgaatgtttcgtatatttttgtttcacagttaatcttccctccccaagtttgctattcaaatcaactgcctgaatgacatttctagtagtctgatgtatttttctgaggaatagtttgtgattccaatgcaggtgtcttcattaccattacctctacactgcagaagaagcaaaactcctttattagaattactgcacatgtgtatggggaaaatagttctgaaaggctagaatgatacaagtgagcaaaagttggtcagcttggctatggagtggtggcaataatctctaaacattccaaaagaccatgagctgaacctaaactcccttggaatctgaacaaaggaatataaaattgccatttgaaaactgaccagctaatctggacctcagagatagatcagccagtggcccaaagccatttcaagtacagaaattatagagactacagctaaataaatttgaacattaaatataattttaccactttttgtctttataagcatatttgtaaactcagaactgagcagaagtgactttactttctcaagtttgatactgagttgactgttcccttatccctcacccttccccttccctttcctaaggcaatagtgcacaacttaggttatttttgcttccgaatttgaatgaaaaacttaatgccatggatttttttcttttgcaagacacctgtttatcatcttgtttaaatgtaaatgtccccttatgcttttgaaataaatttccttttgtaatt

SEQ ID NO: 76519 - DNA, 5121 bp, Homo sapiens
  misc_feature (675)..(675): n is a, c, g, or t
agtttagaagttaatgaagagatttgatctcatttacatatgattaaaagtccagccttgtgataacttcgatcagttttcttcatgggacgacacctttgaggaccatttctctgtggctataaaagtgactgaccaatggatgagagactcttgttctgtacatcacaagtgacttgatttttcagcaaaagatatgcttagtttatatcagtagctgaaacacactcagacgcacatacacacatagcacctatttggcagtattctgagaagcttatgtagctgataaagcagtgaaaaaaactcagcctttagatctacatttgtgtgagtccagttgcgtgaaatactgtgatcaaaacaaaaattgcatatttattgcattcaaagggacattttgtagtctaacctgattttcgaaattgattattgataatttaagatatttttcatagttatatgagttacctttagtaatgatagacaataaataaagaactaagaagttgtcatgaaagtcatagccagagcaggtagataagagaaagaaataaagggcatccaaactagaatggagaagtcaaattgttctctatgcagatgacatgatgttatatatataaaaacaaaactaaagactctaccaaaaaactcatagaactgataaatttngaaaagttagaagatacaaaattagtatacaaaaatcagtagcatttctatgcatgaacagtgaactagctgaaaaagaaatcaaggtaaccccatttataatagctgtgaaaaaaatctaggaataaattaaccaagaaggtaaaatatttctatacaaggaaaactacaaaacactgatgaaagaaattgaaggagatacaaacaaattgaaagacactccgtactcatggattagaggaattaatatattttaaatgaccatgctacccaaagtgatctccagattcaatacaacttctatcaaaataactgacattcttcacagaaattgccaccaaaaaaaattcttaaaatttatatggaaccacaagaccccaaatagccaaagcaatactgagcaaaaagaacaaagctggagttatcacactaccagatctcaaaatataaatcaaaaatgtagtaaccaaaacagcctgatactggcataaaaatagatacagagcaatggaacagaacagagaaccagaaattaatccacgtatctacagccaactgattttttacaaaggtggcaagaatactcattggagggacaaaaaaaaaagggacagtctcttcaataaatggtgctgagaaaactgggtatccatatgcagaagaatgaaactagatccgcacctcccaccctgtacaaaaaccaactcaaaatggatgaaagacctaaatgtaagacctaaaacaataaaactaccataagagaaaacaagaagcacttcaggacattggtctgggaaaagattttatgactgagacctaaaagcacaggcaacaaaaacatgggatcatatcaaattaaaaagcttctgtgcagcagaggaaaccatcaacagtgaaaagacagcttacagaatgggagaaaatatttgtaaactactcatgcaacagaggattaatattcagaatatagaagatattcaaacatcttaatagcaaaacaaatctagattaaaaatgggcaaatcatctgaacagacatttctcaaaagaagacgtacaaatggccaataaatgtatgaaaaaattctaaacactaagcatcagggtaatgcacatcaaaaccacaatgagtaagttggaagttcagggaagagattttatctcatttacatatgattaaaagtcagacattggcacccccatgtttattgtagcactattcattagccaagacatggaatcaacccagaatcaacaggtgcatcaacaggtgaatggctaaacaagatgtggtattatacacaatgggatactattcagccataaaaaaagaatgtcctttcatttgcagcaacatggaaggaactggaggactttatagtaggtgaaataagccagcaatggaaaattaaacaatgcatgttctcactcatgtggaagttttaaaaagttaatcttatagaagtaaaaattaggacagcgcatactagaggctgagaagatagggggaaggaagggatagggagagatttgtgggaggatgcaaaataacataggaataagccctagtgttgtgtaccactatagcatgactatagttaatatatactttaaaatagaagaatattgaatgttcccaacacaaagaaattataggtgtttgagatgatggatatgcttgttaccctgagctgataactgtacattctttgtatcaaagtattctaccccacgaatatgtagaattattattcgtgaatttgaagaattaagttttttaaaaagtgtacgggctgggcacagtggctcacacctgtagtcccagcactgaggcaggacgatcccttgaggcctgcagtttgagatcagcctggcaacaaaatgaggacctgtctctacaaaaaaaaaaaatagccaaacatggtggtgtgcatctgtagccctagctactggggagtctgaggcagaaagatcactctagtccagaagttcaatgttatggtgaactgtgaacgcaccactgcactccagcctgagcaacacagcaagaccctccaaaaaaagtgtagttatcgtaacatcaccttgaaacaactttgttactgggatacatttaattaagcaactaccatgaatgtagtcggtaccttgccttacgtgcttcagtatatatgttgttcttgttttatgtacaggctaaatttgtagattgaatagcagaatattagttctgttcttatagggcctactgctgtattcagagttatgagctacgtttcttctgcgtttgctgcaccatgaaatcctaagcaagacctaaacccttgttcgctttttcgtagagcagagagagaggagccttcaggggaagtagaggtggccgaggttggggcacacgaggaaatcgtagtcggggaagactctactgaataagacatcagcattcttcagcattgtcatgagcttaatatacttaaattctactactcattggattgccggggatgtccctttaaacagactgctgccttcagctaaaaacttaatgttctttatacctttgtatgtatgacctacttttgtaacagaccatggttgtgtccaaggtaaaaccacagtgatatttttggatgctttgtctgcaatcttgacttgtttttgcagtatcattattcagacttcaaattgtgaatcttttaaacatcttgataatttgttgttgagagctgttcattctaaaatgtaatgaaattcagtctagttctgctgataaagatcatcagttttgaaaggttactgattttcctcttccctcttagttttttacccaatatatggagaagagtaatggtcaatcttaacattttgttttaattgtttaataaagctgctgggcagtggtgcagcattcctacctagtgtcataaaagcaaaatacttacatagctttcttaaaatataggaatgacattacatttttaggagaaagtaagttgctttgcaccgcctacttaattcttttccatatattgtgatacaaacttttgaatatggaatcttactatttgaatagaaatgtgtatgtataatatacatacatacataagcatatatgtgtgtgtgtgtgtgtatatatatatatatgcatgctgtgaaacttgactacacaacataaatcactttttaaattccaggaacgggtagtctgacacggtgattatccttttgaggctgaatccgttattaacttgttatttaggtttttactcccagtagcaagggattctaagttagttgcacttacatgattattgttatttaaaactaagaataaaggctgcattttcaaagataaattggaattgctgttggtgaaataacaaccaaaatactgaatctgatgtacatacaggtttctacaggaagagatggtataatttacaatttggagatttaataaccagggctacccagaaaaagtgacttgataacatggtaccaataagtaagggatgctctctcggtttgcttttgccactttcaagattttaacttctcaggttattaatcaaaattattgtataagttagccaatagaatttttaggttaaaacaacagatggggggtttgtggagtgtttaatgtcatgggcatttttagtagcatagaccctttgttctgcatttgaatgtttcgtatatttttgtttcacagttaatcttccctccccaagtttgctattcaaatcaactgcctgaatgacatttctagtagtctgatgtatttttctgaggaatagtttgtgattccaatgcaggtgtcttcattaccattacctctacactgcagaagaagcaaaactcctttattagaattactgcacatgtgtatggggaaaatagttctgaaaggctagaatgatacaagtgagcaaaagttggtcagcttggctatggagtggtggcaataatctctaaacattccaaaagaccatgagctgaacctaaactcccttggaatctgaacaaaggaatataaaattgccatttgaaaactgaccagctaatctggacctcagagatagatcagccagtggcccaaagccatttcaagtacagaaattatagagactacagctaaataaatttgaacattaaatataattttaccactttttgtctttataagcatatttgtaaactcagaactgagcagaagtgactttactttctcaagtttgatactgagttgactgttcccttatccctcacccttccccttccctttcctaaggcaatagtgcacaacttaggttatttttgcttccgaatttgaatgaaaaacttaatgccatggatttttttcttttgcaagacacctgtttatcatcttgtttaaatgtaaatgtccccttatgcttttgaaataaatttccttttgtaatt

SEQ ID NO: 76520 - DNA, 3988 bp, Homo sapiens
agcgggctgtgcgcggtgaactcggcggctgcactggcggcagctggaggtgtaatagtgcgggtagtgggtttggagaagttccgaggcggcggtggcgccggtcaggacaaggatagcggaaccgggccctgggcttgtcgctcaccatgccgacagtagaggagctttaccgcaattatggcatcctggccgatgccacggagcaagtgggccagcataaagatgcctatcaagtgatattggatggtgtgaaaggtggtactaaggaaaagcgattagcagctcaatttattccgaaattctttaagcattttccagaattggctgattctgctatcaatgcacagttagacctctgtgaggatgaagatgtatctattcgacgtcaagcaattaaagaactgcctcaatttgccactggagaaaatccttcctcgagtggccagataatactaacgcaacttttgccagaacagatgactctgccagaatttaaccctagtgaacaatgccccctattaagtatatttaaaatggatgcaaaagggacttttaggtgggttgttcagcccaaatacttcaaggagaggacattgttagagaacgagcaattaaattcctttctacaaaacttaagactttaccagatgaagtcttaacaaaggaagtggaagagcttatactaactgaatccaaaaaggtcctagaagatgtgactggtgaagaatttgttctatttatgaagatactgtctgggttaaaaagcttacagacagtgagtggaagacagcaacttgtagagttggtggctgaacaggccgacctagaacagaccttcaatccctcggatcctgactgtgtggacaggctcttacagtgcactcggcaggcagtacccctcttctctaaaaatgtccattccacaaggtttgtgacatatttctgtgagcaggttctccctaacctcggtaccttgactaccccagtggaaggtcttgatatacagttggaggtattgaaattgttggcggagatgagttcattttgtggtgacatggaaaaactagaaacaaatttaaggaaactatttgataagttattggaatacatgcccctccctccagaagaggcagaaaatggagagaatgctggtaatgaagaacccaagctacagttcagttatgtggaatgtttgttgtacagttttcaccagttgggccgaaaacttccagatttcttaacagccaaactgaatgcagaaaagctcaaagatttcaaaatcaggctgcagtactttgcacggggcctgcaagtttatatcagacaacttcgcttagctctccagggtaaaacgggtgaggccttaaaaacagaagagaacaagattaaagtcgttgcattgaaaataacaaacaatatcaatgttttaatcaaggatctcttccacattcctccttcttataagagcacagtaacactatcctggaaacctgtacaaaaggttgagattgggcaaaagagagccagtgaagatacaacttcaggttcaccacccaagaaatcttcagcaggaccaaaaagagatgccaggcagatttataaccctcccagtgggaaatatagcagcaatttgggcaactttaattatgagagagaggagccttcaggggaagtagaggtggccgaggttggggcacacgaggaaatcgtagtcggggaagactctactgaataagacatcagcattcttcagcattgtcatgagcttaatatacttaaattctactactcattggattgccggggatgtccctttaaacagactgctgccttcagctaaaaacttaatgttctttatacctttgtatgtatgacctacttttgtaacagaccatggttgtgtccaaggtaaaaccacagtgatatttttggatgctttgtctgcaatcttgacttgtttttgcagtatcattattcagacttcaaattgtgaatcttttaaacatcttgataatttgttgttgagagctgttcattctaaaatgtaatgaaattcagtctagttctgctgataaagatcatcagttttgaaaggttactgattttcctcttccctcttagttttttacccaatatatggagaagagtaatggtcaatcttaacattttgttttaattgtttaataaagctgctgggcagtggtgcagcattcctacctagtgtcataaaagcaaaatacttacatagctttcttaaaatataggaatgacattacatttttaggagaaagtaagttgctttgcaccgcctacttaattcttttccatatattgtgatacaaacttttgaatatggaatcttactatttgaatagaaatgtgtatgtataatatacatacatacataagcatatatgtgtgtgtgtgtgtgtatatatatatatatgcatgctgtgaaacttgactacacaacataaatcactttttaaattccaggaacgggtagtctgacacggtgattatccttttgaggctgaatccgttattaacttgttatttaggtttttactcccagtagcaagggattctaagttagttgcacttacatgattattgttatttaaaactaagaataaaggctgcattttcaaagataaattggaattgctgttggtgaaataacaaccaaaatactgaatctgatgtacatacaggtttctacaggaagagatggtataatttacaatttggagatttaataaccagggctacccagaaaaagtgacttgataacatggtaccaataagtaagggatgctctctcggtttgcttttgccactttcaagattttaacttctcaggttattaatcaaaattattgtataagttagccaatagaatttttaggttaaaacaacagatggggggtttgtggagtgtttaatgtcatgggcatttttagtagcatagaccctttgttctgcatttgaatgtttcgtatatttttgtttcacagttaatcttccctccccaagtttgctattcaaatcaactgcctgaatgacatttctagtagtctgatgtatttttctgaggaatagtttgtgattccaatgcaggtgtcttcattaccattacctctacactgcagaagaagcaaaactcctttattagaattactgcacatgtgtatggggaaaatagttctgaaaggctagaatgatacaagtgagcaaaagttggtcagcttggctatggagtggtggcaataatctctaaacattccaaaagaccatgagctgaacctaaactcccttggaatctgaacaaaggaatataaaattgccatttgaaaactgaccagctaatctggacctcagagatagatcagccagtggcccaaagccatttcaagtacagaaattatagagactacagctaaataaatttgaacattaaatataattttaccactttttgtctttataagcatatttgtaaactcagaactgagcagaagtgactttactttctcaagtttgatactgagttgactgttcccttatccctcacccttccccttccctttcctaaggcaatagtgcacaacttaggttatttttgcttccgaatttgaatgaaaaacttaatgccatggatttttttcttttgcaagacacctgtttatcatcttgtttaaatgtaaatgtccccttatgcttttgaaataaatttccttttgtaattaaaaaaaacgaccacacagaaagacgcacaaacaacaaacacacaacaaaaaaaaaacttggcggggcggcacagcgccagagaagtgtctaaacaccacttgttggggcggcgcccataagaatacgaccggcgacagcggtcgcaaaaacccccgaagaaatggcggggtccccaataaaacgcggacccgcctgacaaccagcgggtggggcagcggtacacaggccgggcgac

SEQ ID NO: 76521 - DNA, 3253 bp, Homo sapiens
ttgttgcctaatcttaaaaaacatctttaaagggcacccacatttctttggttaatagtataaaaaagactgcattgacatggttaagttcccaggaccctcagttgttcagagatgactggtatcattacctgcaaaagtgtcttgaccttgatggagcttatgttgataaataaagtttatattttttattctttatctttttattccatttttccatgaacttattgaagccccttcgtagatcacctattgaggttatatctggggcatgctggggtgtgcactatatcgtatttgtagtcagaatacttgatgctgtagcgctcagcatttattgaatgaaattctgctataatatttgagcgaatatttgtttttcgacaatgcattttctttggatttcttacagaaaaatgtccattccacaaggtttgtgacatatttctgtgagcaggttctccctaacctcggtaccttgactaccccagtggaaggtcttgatatacagttggaggtattgaaattgttggcggagatgagttcattttgtggtgacatggaaaaactagaaacaaatttaaggaaactatttgataagttattggaatacatgcccctccctccagaagaggcagaaaatggagagaatgctggtaatgaagaacccaagctacagttcagttatgtggaatgtttgttgtacagttttcaccagttgggccgaaaacttccagatttcttaacagccaaactgaatgcagaaaagctcaaagatttcaaaatcaggctgcagtactttgcacggggcctgcaagtttatatcagacaacttcgcttagctctccagggtaaaacgggtgaggccttaaaaacagaagagaacaagattaaagtcgttgcattgaaaataacaaacaatatcaatgttttaatcaaggatctcttccacattcctccttcttataagagcacagtaacactatcctggaaacctgtacaaaaggttgagattgggcaaaagagagccagtgaagatacaacttcaggttcaccacccaagaaatcttcagcaggaccaaaaagagatgccaggcagatttataaccctcccagtgggaaatatagcagcaatttgggcaactttaattatgagagagaggagccttcaggggaagtagaggtggccgaggttggggcacacgaggaaatcgtagtcggggaagactctactgaataagacatcagcattcttcagcattgtcatgagcttaatatacttaaattctactactcattggattgccggggatgtccctttaaacagactgctgccttcagctaaaaacttaatgttctttatacctttgtatgtatgacctacttttgtaacagaccatggttgtgtccaaggtaaaaccacagtgatatttttggatgctttgtctgcaatcttgacttgtttttgcagtatcattattcagacttcaaattgtgaatcttttaaacatcttgataatttgttgttgagagctgttcattctaaaatgtaatgaaattcagtctagttctgctgataaagatcatcagttttgaaaggttactgattttcctcttccctcttagttttttacccaatatatggagaagagtaatggtcaatcttaacattttgttttaattgtttaataaagctgctgggcagtggtgcagcattcctacctagtgtcataaaagcaaaatacttacatagctttcttaaaatataggaatgacattacatttttaggagaaagtaagttgctttgcaccgcctacttaattcttttccatatattgtgatacaaacttttgaatatggaatcttactatttgaatagaaatgtgtatgtataatatacatacatacataagcatatatgtgtgtgtgtgtgtgtatatatatatatatgcatgctgtgaaacttgactacacaacataaatcactttttaaattccaggaacgggtagtctgacacggtgattatccttttgaggctgaatccgttattaacttgttatttaggtttttactcccagtagcaagggattctaagttagttgcacttacatgattattgttatttaaaactaagaataaaggctgcattttcaaagataaattggaattgctgttggtgaaataacaaccaaaatactgaatctgatgtacatacaggtttctacaggaagagatggtataatttacaatttggagatttaataaccagggctacccagaaaaagtgacttgataacatggtaccaataagtaagggatgctctctcggtttgcttttgccactttcaagattttaacttctcaggttattaatcaaaattattgtataagttagccaatagaatttttaggttaaaacaacagatggggggtttgtggagtgtttaatgtcatgggcatttttagtagcatagaccctttgttctgcatttgaatgtttcgtatatttttgtttcacagttaatcttccctccccaagtttgctattcaaatcaactgcctgaatgacatttctagtagtctgatgtatttttctgaggaatagtttgtgattccaatgcaggtgtcttcattaccattacctctacactgcagaagaagcaaaactcctttattagaattactgcacatgtgtatggggaaaatagttctgaaaggctagaatgatacaagtgagcaaaagttggtcagcttggctatggagtggtggcaataatctctaaacattccaaaagaccatgagctgaacctaaactcccttggaatctgaacaaaggaatataaaattgccatttgaaaactgaccagctaatctggacctcagagatagatcagccagtggcccaaagccatttcaagtacagaaattatagagactacagctaaataaatttgaacattaaatataattttaccactttttgtctttataagcatatttgtaaactcagaactgagcagaagtgactttactttctcaagtttgatactgagttgactgttcccttatccctcacccttccccttccctttcctaaggcaatagtgcacaacttaggttatttttgcttccgaatttgaatgaaaaacttaatgccatggatttttttcttttgcaagacacctgtttatcatcttgtttaaatgtaaatgtccccttatgcttttgaaataaatttccttttgtaatt

SEQ ID NO: 76522 - DNA, 2755 bp, Homo sapiens
gggagtttttcattttcccttatctcacctaatttaacagtcttcatcccagtcctaatgaaatattttagatttttattatgttcctataacttaaactgatttattttaaaacaacttctatgtgcatgtgaccttactcattttttagctacattctaacctgtcaagggaacacagattatttgctttctttgctacatctagatttgtttagagtcaagcaataggaatacgcattatctatagatttaaaccaaggaattctgtaaagactgtagaggtgattctgatagaagtgtaattactctagttctatgacagaatggattatgcctcatagaagttattggcaatttgtcttaattttcctttccctttgtagaacaagattaaagtcgttgcattgaaaataacaaacaatatcaatgttttaatcaaggatctcttccacattcctccttcttataagagcacagtaacactatcctggaaacctgtacaaaaggttgagattgggcaaaagagagccagtgaagatacaacttcaggttcaccacccaagaaatcttcagcaggaccaaaaagagatgccaggcagatttataaccctcccagtgggaaatatagcagcaatttgggcaactttaattatgagagagaggagccttcaggggaagtagaggtggccgaggttggggcacacgaggaaatcgtagtcggggaagactctactgaataagacatcagcattcttcagcattgtcatgagcttaatatacttaaattctactactcattggattgccggggatgtccctttaaacagactgctgccttcagctaaaaacttaatgttctttatacctttgtatgtatgacctacttttgtaacagaccatggttgtgtccaaggtaaaaccacagtgatatttttggatgctttgtctgcaatcttgacttgtttttgcagtatcattattcagacttcaaattgtgaatcttttaaacatcttgataatttgttgttgagagctgttcattctaaaatgtaatgaaattcagtctagttctgctgataaagatcatcagttttgaaaggttactgattttcctcttccctcttagttttttacccaatatatggagaagagtaatggtcaatcttaacattttgttttaattgtttaataaagctgctgggcagtggtgcagcattcctacctagtgtcataaaagcaaaatacttacatagctttcttaaaatataggaatgacattacatttttaggagaaagtaagttgctttgcaccgcctacttaattcttttccatatattgtgatacaaacttttgaatatggaatcttactatttgaatagaaatgtgtatgtataatatacatacatacataagcatatatgtgtgtgtgtgtgtgtatatatatatatatgcatgctgtgaaacttgactacacaacataaatcactttttaaattccaggaacgggtagtctgacacggtgattatccttttgaggctgaatccgttattaacttgttatttaggtttttactcccagtagcaagggattctaagttagttgcacttacatgattattgttatttaaaactaagaataaaggctgcattttcaaagataaattggaattgctgttggtgaaataacaaccaaaatactgaatctgatgtacatacaggtttctacaggaagagatggtataatttacaatttggagatttaataaccagggctacccagaaaaagtgacttgataacatggtaccaataagtaagggatgctctctcggtttgcttttgccactttcaagattttaacttctcaggttattaatcaaaattattgtataagttagccaatagaatttttaggttaaaacaacagatggggggtttgtggagtgtttaatgtcatgggcatttttagtagcatagaccctttgttctgcatttgaatgtttcgtatatttttgtttcacagttaatcttccctccccaagtttgctattcaaatcaactgcctgaatgacatttctagtagtctgatgtatttttctgaggaatagtttgtgattccaatgcaggtgtcttcattaccattacctctacactgcagaagaagcaaaactcctttattagaattactgcacatgtgtatggggaaaatagttctgaaaggctagaatgatacaagtgagcaaaagttggtcagcttggctatggagtggtggcaataatctctaaacattccaaaagaccatgagctgaacctaaactcccttggaatctgaacaaaggaatataaaattgccatttgaaaactgaccagctaatctggacctcagagatagatcagccagtggcccaaagccatttcaagtacagaaattatagagactacagctaaataaatttgaacattaaatataattttaccactttttgtctttataagcatatttgtaaactcagaactgagcagaagtgactttactttctcaagtttgatactgagttgactgttcccttatccctcacccttccccttccctttcctaaggcaatagtgcacaacttaggttatttttgcttccgaatttgaatgaaaaacttaatgccatggatttttttcttttgcaagacacctgtttatcatcttgtttaaatgtaaatgtccccttatgcttttgaaataaatttccttttgtaatt

SEQ ID NO: 76523 - DNA, 2282 bp, Homo sapiens
actcactgacattatgatggacccttgttcatgtggtcgagactgggcaacatacagccgaaggagatacaacttcaggttcaccacccaagaaatcttcagcaggaccaaaaagagatgccaggcagatttataaccctcccagtgggaaatatagcagcaatttgggcaactttaattatgagagagaggagccttcaggggaagtagaggtggccgaggttggggcacacgaggaaatcgtagtcggggaagactctactgaataagacatcagcattcttcagcattgtcatgagcttaatatacttaaattctactactcattggattgccggggatgtccctttaaacagactgctgccttcagctaaaaacttaatgttctttatacctttgtatgtatgacctacttttgtaacagaccatggttgtgtccaaggtaaaaccacagtgatatttttggatgctttgtctgcaatcttgacttgtttttgcagtatcattattcagacttcaaattgtgaatcttttaaacatcttgataatttgttgttgagagctgttcattctaaaatgtaatgaaattcagtctagttctgctgataaagatcatcagttttgaaaggttactgattttcctcttccctcttagttttttacccaatatatggagaagagtaatggtcaatcttaacattttgttttaattgtttaataaagctgctgggcagtggtgcagcattcctacctagtgtcataaaagcaaaatacttacatagctttcttaaaatataggaatgacattacatttttaggagaaagtaagttgctttgcaccgcctacttaattcttttccatatattgtgatacaaacttttgaatatggaatcttactatttgaatagaaatgtgtatgtataatatacatacatacataagcatatatgtgtgtgtgtgtgtgtatatatatatatatgcatgctgtgaaacttgactacacaacataaatcactttttaaattccaggaacgggtagtctgacacggtgattatccttttgaggctgaatccgttattaacttgttatttaggtttttactcccagtagcaagggattctaagttagttgcacttacatgattattgttatttaaaactaagaataaaggctgcattttcaaagataaattggaattgctgttggtgaaataacaaccaaaatactgaatctgatgtacatacaggtttctacaggaagagatggtataatttacaatttggagatttaataaccagggctacccagaaaaagtgacttgataacatggtaccaataagtaagggatgctctctcggtttgcttttgccactttcaagattttaacttctcaggttattaatcaaaattattgtataagttagccaatagaatttttaggttaaaacaacagatggggggtttgtggagtgtttaatgtcatgggcatttttagtagcatagaccctttgttctgcatttgaatgtttcgtatatttttgtttcacagttaatcttccctccccaagtttgctattcaaatcaactgcctgaatgacatttctagtagtctgatgtatttttctgaggaatagtttgtgattccaatgcaggtgtcttcattaccattacctctacactgcagaagaagcaaaactcctttattagaattactgcacatgtgtatggggaaaatagttctgaaaggctagaatgatacaagtgagcaaaagttggtcagcttggctatggagtggtggcaataatctctaaacattccaaaagaccatgagctgaacctaaactcccttggaatctgaacaaaggaatataaaattgccatttgaaaactgaccagctaatctggacctcagagatagatcagccagtggcccaaagccatttcaagtacagaaattatagagactacagctaaataaatttgaacattaaatataattttaccactttttgtctttataagcatatttgtaaactcagaactgagcagaagtgactttactttctcaagtttgatactgagttgactgttcccttatccctcacccttccccttccctttcctaaggcaatagtgcacaacttaggttatttttgcttccgaatttgaatgaaaaacttaatgccatggatttttttcttttgcaagacacctgtttatcatcttgtttaaatgtaaatgtccccttatgcttttgaaataaatttccttttgtaatt

SEQ ID NO: 76524 - DNA, 2169 bp, Homo sapiens
acccacgcgtccgcgaccacgcgtcctcccagtgggaaatatagcagcaatttgggcaactttaattatgagagagaggagccttcaggggaagtagaggtggccgaggttggggcacacgaggaaatcgtagtcggggaagactctactgaataagacatcagcattcttcagcattgtcatgagcttaatatacttaaattctactactcattggattgccggggatgtccctttaaacagactgctgccttcagctaaaaacttaatgttctttatacctttgtatgtatgacctacttttgtaacagaccatggttgtgtccaaggtaaaaccacagtgatatttttggatgctttgtctgcaatcttgacttgtttttgcagtatcattattcagacttcaaattgtgaatcttttaaacatcttgataatttgttgttgagagctgttcattctaaaatgtaatgaaattcagtctagttctgctgataaagatcatcagttttgaaaggttactgattttcctcttccctcttagttttttacccaatatatggagaagagtaatggtcaatcttaacattttgttttaattgtttaataaagctgctgggcagtggtgcagcattcctacctagtgtcataaaagcaaaatacttacatagctttcttaaaatataggaatgacattacatttttaggagaaagtaagttgctttgcaccgcctacttaattcttttccatatattgtgatacaaacttttgaatatggaatcttactatttgaatagaaatgtgtatgtataatatacatacatacataagcatatatgtgtgtgtgtgtgtgtatatatatatatatgcatgctgtgaaacttgactacacaacataaatcactttttaaattccaggaacgggtagtctgacacggtgattatccttttgaggctgaatccgttattaacttgttatttaggtttttactcccagtagcaagggattctaagttagttgcacttacatgattattgttatttaaaactaagaataaaggctgcattttcaaagataaattggaattgctgttggtgaaataacaaccaaaatactgaatctgatgtacatacaggtttctacaggaagagatggtataatttacaatttggagatttaataaccagggctacccagaaaaagtgacttgataacatggtaccaataagtaagggatgctctctcggtttgcttttgccactttcaagattttaacttctcaggttattaatcaaaattattgtataagttagccaatagaatttttaggttaaaacaacagatggggggtttgtggagtgtttaatgtcatgggcatttttagtagcatagaccctttgttctgcatttgaatgtttcgtatatttttgtttcacagttaatcttccctccccaagtttgctattcaaatcaactgcctgaatgacatttctagtagtctgatgtatttttctgaggaatagtttgtgattccaatgcaggtgtcttcattaccattacctctacactgcagaagaagcaaaactcctttattagaattactgcacatgtgtatggggaaaatagttctgaaaggctagaatgatacaagtgagcaaaagttggtcagcttggctatggagtggtggcaataatctctaaacattccaaaagaccatgagctgaacctaaactcccttggaatctgaacaaaggaatataaaattgccatttgaaaactgaccagctaatctggacctcagagatagatcagccagtggcccaaagccatttcaagtacagaaattatagagactacagctaaataaatttgaacattaaatataattttaccactttttgtctttataagcatatttgtaaactcagaactgagcagaagtgactttactttctcaagtttgatactgagttgactgttcccttatccctcacccttccccttccctttcctaaggcaatagtgcacaacttaggttatttttgcttccgaatttgaatgaaaaacttaatgccatggatttttttcttttgcaagacacctgtttatcatcttgtttaaatgtaaatgtccccttatgcttttgaaataaatttccttttgtaatt

SEQ ID NO: 76525 - DNA, 3038 bp, Homo sapiens
agcgggctgtgcgcggtgaactcggcggctgcactggcggcagctggaggtgtaatagtgcgggtagtgggtttggagaagttccgaggcggcggtggcgccggtcaggacaaggatagcggaaccgggccctgggcttgtcgctcaccatgccgacagtagaggagctttaccgcaattatggcatcctggccgatgccacggagcaagtgggccagcataaagatgcctatcaagtgatattggatggtgtgaaaggtggtactaaggaaaagcgattagcagctcaatttattccgaaattctttaagcattttccagaattggctgattctgctatcaatgcacagttagacctctgtgaggatgaagatgtatctattcgacgtcaagcaattaaagaactgcctcaatttgccactggagaaaatccttcctcgagtggccagataatactaacgcaacttttgccagaacagatgactctgccagaatttaaccctagtgaacaatgccccctattaagtatatttaaaatggatgcaaaagggacttttaggtgggttgttcagcccaaatacttcaaggagaggacattgttagagaacgagcaattaaattcctttctacaaaacttaagactttaccagatgaagtcttaacaaaggaagtggaagagcttatactaactgaatccaaaaaggtcctagaagatgtgactggtgaagaatttgttctatttatgaagatactgtctgggttaaaaagcttacagacagtgagtggaagacagcaacttgtagagttggtggctgaacaggccgacctagaacagaccttcaatccctcggatcctgactgtgtggacaggctcttacagtgcactcggcaggcagtacccctcttctctaaaaatgtccattccacaaggtttgtgacatatttctgtgagcaggttctccctaacctcggtaccttgactaccccagtggaaggtcttgatatacagttggaggtattgaaattgttggcggagatgagttcattttgtggtgacatggaaaaactagaaacaaatttaaggaaactatttgataagttattggaatacatgcccctccctccagaagaggcagaaaatggagagaatgctggtaatgaagaacccaagctacagttcagttatgtggaatgtttgttgtacagttttcaccagttgggccgaaaacttccagatttcttaacagccaaactgaatgcagaaaagctcaaagatttcaaaatcaggctgcagtactttgcacggggcctgcaagtttatatcagacaacttcgcttagctctccagggtaaaacgggtgaggccttaaaaacagaagagaacaagattaaagtcgttgcattgaaaataacaaacaatatcaatgttttaatcaaggatctcttccacattcctccttcttataagagcacagtaacactatcctggaaacctgtacaaaaggttgagattgggcaaaagagagccagtgaagatacaacttcaggttcaccacccaagaaatcttcagcaggaccaaaaagagatgccaggcagatttataaccctcccagtgggaaatatagcagcaatttgggcaactttaattatgagagagaggagccttcaggggaagtagaggtggccgaggttggggcacacgaggaaatcgtagtcggggaagactctactgaataagacatcagcattcttcagcattgtcatgagcttaatatacttaaattctactactcattggattgccggggatgtccctttgaggctgaatccgttattaacttgttatttaggtttttactcccagtagcaagggattctaagttagttgcacttacatgattattgttatttaaaactaagaataaaggctgcattttcaaagataaattggaattgctgttggtgaaataacaaccaaaatactgaatctgatgtacatacaggtttctacaggaagagatggtataatttacaatttggagatttaataaccagggctacccagaaaaagtgacttgataacatggtaccaataagtaagggatgctctctcggtttgcttttgccactttcaagattttaacttctcaggttattaatcaaaattattgtataagttagccaatagaatttttaggttaaaacaacagatggggggtttgtggagtgtttaatgtcatgggcatttttagtagcatagaccctttgttctgcatttgaatgtttcgtatatttttgtttcacagttaatcttccctccccaagtttgctattcaaatcaactgcctgaatgacatttctagtagtctgatgtatttttctgaggaatagtttgtgattccaatgcaggtgtcttcattaccattacctctacactgcagaagaagcaaaactcctttattagaattactgcacatgtgtatggggaaaatagttctgaaaggctagaatgatacaagtgagcaaaagttggtcagcttggctatggagtggtggcaataatctctaaacattccaaaagaccatgagctgaacctaaactcccttggaatctgaacaaaggaatataaaattgccatttgaaaactgaccagctaatctggacctcagagatagatcagccagtggcccaaagccatttcaagtacagaaattatagagactacagctaaataaatttgaacattaaatataattttaccactttttgtctttataagcatatttgtaaactcagaactgagcagaagtgactttactttctcaagtttgatactgagttgactgttcccttatccctcacccttccccttccctttcctaaggcaatagtgcacaacttaggttatttttgcttccgaatttgaatgaaaaacttaatgccatggatttttttcttttgcaagacacctgtttatcatcttgtttaaatgtaaatgtccccttatgcttttgaaataaatttccttttgtaatt

SEQ ID NO: 76526 - DNA, 1540 bp, Homo sapiens
aagcagtggtatcaacgcagagtgcccattacggccggggctttcttaaaatataggaatgacattacatttttaggagaaagtaagttgctttgcaccgcctacttaattcttttccatatattgtgatacaaacttttgaatatggaatcttactatttgaatagaaatgtgtatgtataatatacatacatacataagcatatatgtgtgtgtgtgtgtgtatatatatatatatgcatgctgtgaaacttgactacacaacataaatcactttttaaattccaggaacgggtagtctgacacggtgattatccttttgaggctgaatccgttattaacttgttatttaggtttttactcccagtagcaagggattctaagttagttgcacttacatgattattgttatttaaaactaagaataaaggctgcattttcaaagataaattggaattgctgttggtgaaataacaaccaaaatactgaatctgatgtacatacaggtttctacaggaagagatggtataatttacaatttggagatttaataaccagggctacccagaaaaagtgacttgataacatggtaccaataagtaagggatgctctctcggtttgcttttgccactttcaagattttaacttctcaggttattaatcaaaattattgtataagttagccaatagaatttttaggttaaaacaacagatggggggtttgtggagtgtttaatgtcatgggcatttttagtagcatagaccctttgttctgcatttgaatgtttcgtatatttttgtttcacagttaatcttccctccccaagtttgctattcaaatcaactgcctgaatgacatttctagtagtctgatgtatttttctgaggaatagtttgtgattccaatgcaggtgtcttcattaccattacctctacactgcagaagaagcaaaactcctttattagaattactgcacatgtgtatggggaaaatagttctgaaaggctagaatgatacaagtgagcaaaagttggtcagcttggctatggagtggtggcaataatctctaaacattccaaaagaccatgagctgaacctaaactcccttggaatctgaacaaaggaatataaaattgccatttgaaaactgaccagctaatctggacctcagagatagatcagccagtggcccaaagccatttcaagtacagaaattatagagactacagctaaataaatttgaacattaaatataattttaccactttttgtctttataagcatatttgtaaactcagaactgagcagaagtgactttactttctcaagtttgatactgagttgactgttcccttatccctcacccttccccttccctttcctaaggcaatagtgcacaacttaggttatttttgcttccgaatttgaatgaaaaacttaatgccatggatttttttcttttgcaagacacctgtttatcatcttgtttaaatgtaaatgtccccttatgcttttgaaataaatttccttttgtaatt

SEQ ID NO: 76527 - DNA, 1432 bp, Homo sapiens
tgaaacaacgctttgatgtaacaaaaaggcggtggtacggtcggaattccgggaatatcgaatgtgtatgtataatatacatacatacataagcatatatgtgtgtgtgtgtgtgtatatatatatatatgcatgctgtgaaacttgactacacaacataaatcactttttaaattccaggaacgggtagtctgacacggtgattatccttttgaggctgaatccgttattaacttgttatttaggtttttactcccagtagcaagggattctaagttagttgcacttacatgattattgttatttaaaactaagaataaaggctgcattttcaaagataaattggaattgctgttggtgaaataacaaccaaaatactgaatctgatgtacatacaggtttctacaggaagagatggtataatttacaatttggagatttaataaccagggctacccagaaaaagtgacttgataacatggtaccaataagtaagggatgctctctcggtttgcttttgccactttcaagattttaacttctcaggttattaatcaaaattattgtataagttagccaatagaatttttaggttaaaacaacagatggggggtttgtggagtgtttaatgtcatgggcatttttagtagcatagaccctttgttctgcatttgaatgtttcgtatatttttgtttcacagttaatcttccctccccaagtttgctattcaaatcaactgcctgaatgacatttctagtagtctgatgtatttttctgaggaatagtttgtgattccaatgcaggtgtcttcattaccattacctctacactgcagaagaagcaaaactcctttattagaattactgcacatgtgtatggggaaaatagttctgaaaggctagaatgatacaagtgagcaaaagttggtcagcttggctatggagtggtggcaataatctctaaacattccaaaagaccatgagctgaacctaaactcccttggaatctgaacaaaggaatataaaattgccatttgaaaactgaccagctaatctggacctcagagatagatcagccagtggcccaaagccatttcaagtacagaaattatagagactacagctaaataaatttgaacattaaatataattttaccactttttgtctttataagcatatttgtaaactcagaactgagcagaagtgactttactttctcaagtttgatactgagttgactgttcccttatccctcacccttccccttccctttcctaaggcaatagtgcacaacttaggttatttttgcttccgaatttgaatgaaaaacttaatgccatggatttttttcttttgcaagacacctgtttatcatcttgtttaaatgtaaatgtccccttatgcttttgaaataaatttccttttgtaatt

SEQ ID NO: 76528 - DNA, 974 bp, Homo sapiens
tttcgagcggccgcccgggcatggtaccaataagtaagggatgctctctcggtttgcttttgccactttcaagattttaacttctcaggttattaatcaaaattattgtataagttagccaatagaatttttaggttaaaacaacagatggggggtttgtggagtgtttaatgtcatgggcatttttagtagcatagaccctttgttctgcatttgaatgtttcgtatatttttgtttcacagttaatcttccctccccaagtttgctattcaaatcaactgcctgaatgacatttctagtagtctgatgtatttttctgaggaatagtttgtgattccaatgcaggtgtcttcattaccattacctctacactgcagaagaagcaaaactcctttattagaattactgcacatgtgtatggggaaaatagttctgaaaggctagaatgatacaagtgagcaaaagttggtcagcttggctatggagtggtggcaataatctctaaacattccaaaagaccatgagctgaacctaaactcccttggaatctgaacaaaggaatataaaattgccatttgaaaactgaccagctaatctggacctcagagatagatcagccagtggcccaaagccatttcaagtacagaaattatagagactacagctaaataaatttgaacattaaatataattttaccactttttgtctttataagcatatttgtaaactcagaactgagcagaagtgactttactttctcaagtttgatactgagttgactgttcccttatccctcacccttccccttccctttcctaaggcaatagtgcacaacttaggttatttttgcttccgaatttgaatgaaaaacttaatgccatggatttttttcttttgcaagacacctgtttatcatcttgtttaaatgtaaatgtccccttatgcttttgaaataaatttccttttgtaatt

SEQ ID NO: 76529 - DNA, 866 bp, Homo sapiens
  misc_feature (32)..(32): n is a, c, g, or t
cggcggggtgggtgagagggggggcggggcgnatgggcgacggcgaatggagggagtgtttaatgtcatgggcatttttagtagcatagaccctttgttctgcatttgaatgtttcgtatatttttgtttcacagttaatcttccctccccaagtttgctattcaaatcaactgcctgaatgacatttctagtagtctgatgtatttttctgaggaatagtttgtgattccaatgcaggtgtcttcattaccattacctctacactgcagaagaagcaaaactcctttattagaattactgcacatgtgtatggggaaaatagttctgaaaggctagaatgatacaagtgagcaaaagttggtcagcttggctatggagtggtggcaataatctctaaacattccaaaagaccatgagctgaacctaaactcccttggaatctgaacaaaggaatataaaattgccatttgaaaactgaccagctaatctggacctcagagatagatcagccagtggcccaaagccatttcaagtacagaaattatagagactacagctaaataaatttgaacattaaatataattttaccactttttgtctttataagcatatttgtaaactcagaactgagcagaagtgactttactttctcaagtttgatactgagttgactgttcccttatccctcacccttccccttccctttcctaaggcaatagtgcacaacttaggttatttttgcttccgaatttgaatgaaaaacttaatgccatggatttttttcttttgcaagacacctgtttatcatcttgtttaaatgtaaatgtccccttatgcttttgaaataaatttccttttgtaatt

SEQ ID NO: 76530 - DNA, 1739 bp, Homo sapiens
  misc_feature (1662)..(1662): n is a, c, g, or t
  misc_feature (1676)..(1676): n is a, c, g, or t
  misc_feature (1682)..(1682): n is a, c, g, or t
  misc_feature (1699)..(1699): n is a, c, g, or t
  misc_feature (1726)..(1726): n is a, c, g, or t
  misc_feature (1738)..(1738): n is a, c, g, or t
agcgggctgtgcgcggtgaactcggcggctgcactggcggcagctggaggtgtaatagtgcgggtagtgggtttggagaagttccgaggcggcggtggcgccggtcaggacaaggatagcggaaccgggccctgggcttgtcgctcaccatgccgacagtagaggagctttaccgcaattatggcatcctggccgatgccacggagcaagtgggccagcataaagatgcctatcaagtgatattggatggtgtgaaaggtggtactaaggaaaagcgattagcagctcaatttattccgaaattctttaagcattttccagaattggctgattctgctatcaatgcacagttagacctctgtgaggatgaagatgtatctattcgacgtcaagcaattaaagaactgcctcaatttgccactggagaaaatccttcctcgagtggccagataatactaacgcaacttttgccagaacagatgactctgccagaatttaaccctagtgaacaatgccccctattaagtatatttaaaatggatgcaaaagggacttttaggtgggttgttcagcccaaatacttcaaggagaggacattgttagagaacgagcaattaaattcctttctacaaaacttaagactttaccagatgaagtcttaacaaaggaagtggaagagcttatactaactgaatccaaaaaggtcctagaagatgtgactggtgaagaatttgttctatttatgaagatactgtctgggttaaaaagcttacagacagtgagtggaagacagcaacttgtagagttggtggctgaacaggccgacctagaacagaccttcaatccctcggatcctgactgtgtggacaggctcttacagtgcactcggcaggcagtacccctcttctctaaaaatgtccattccacaaggtttgtgacatatttctgtgagcaggttctccctaacctcggtaccttgactaccccagtggaaggtcttgatatacagttggaggtattgaaattgttggcggagatgagttcattttgtggtgacatggaaaaactagaaacaaatttaaggaaactatttgataagttattggaatacatgcccctccctccagaagaggcagaaaatggagagaatgctggtaatgaagaacccaagctacagttcagttatgtggaatgtttgttgtacagttttcaccagttgggccgaaaacttccagatttcttaacagccaaactgaatgcagaaaagctcaaagatttcaaaatcaggctgcagtactttgcacggggcctgcaagtttatatcagacaacttcgcttagctctccagggtaaaacgggtgaggccttaaaaacagaagagaacaagattaaagtcgttgcattgaaaataacaaacaatatcaatgttttaatcaaggatctcttccacattcctccttcttataagagcacagtaacactatcctggaaacctgtacaaaaggttgagattgggcaaaagagagccagtgaagatacaacttcaggttcaccacccaagaaatcttcagcaggaccaaaaagagatgccaggcagatttataaccctcccagtgggaaatatagcagcaatttgggcaactttaattatgaaccaaaaangaacctccaggggnaaattnaaagttgcccaaggttngggcccaccaaagaaatcctttttccngggggggggggng

SEQ ID NO: 76531 - DNA, 812 bp, Homo sapiens
  misc_feature (32)..(32): n is a, c, g, or t
cggcggggtgggtgagagggggggcggggcgnatgggcgacggcgaatggagggagtgtttaatgtcatgggcatttttagtagcatagaccctttgttctgcatttgaatgtttcgtatatttttgtttcacagttaatcttccctccccaagtttgctattcaaatcaactgcctgaatgacatttctagtagtctgatgtatttttctgaggaatagtttgtgattccaatgcaggtgtcttcattaccattacctctacactgcagaagaagcaaaactcctttattagaattactgcacatgtgtatggggaaaatagttctgaaaggctagaatgatacaagtgagcaaaagttggtcagcttggctatggagtggtggcaataatctctaaacattccaaaagaccatgagctgaacctaaactcccttggaatctgaacaaaggaatataaaattgccatttgcatttcaagtacagaaattatagagactacagctaaataaatttgaacattaaatataattttaccactttttgtctttataagcatatttgtaaactcagaactgagcagaagtgactttactttctcaagtttgatactgagttgactgttcccttatccctcacccttccccttccctttcctaaggcaatagtgcacaacttaggttatttttgcttccgaatttgaatgaaaaacttaatgccatggatttttttcttttgcaagacacctgtttatcatcttgtttaaatgtaaatgtccccttatgcttttgaaataaatttccttttgtaatt

SEQ ID NO: 76532 - DNA, 316 bp, Homo sapiens
attgcaaaatctgtatatttttctctcttaggaatacatgcccctccctccagaagaggcagaaaatggagagaatgctggtaatgaagaacccaagctacagttcagttatgtggaatgtttgttgtacagttttcaccagttgggccgaaaacttccagatttcttaacagccaaactgaatgcagaaaagctcaaagatttcaaaatcaggtgatatatgattgaggtggctcaatccttggcaaaggtggtagctatcctgaagttccttgggttttgcttttgttctatgagagctccccatcctgcctta

SEQ ID NO: 76533 - DNA, 447 bp, Homo sapiens
atttattgaatgaaattctgctataatatttgagcgaatatttgtttttcgacaatgcattttctttggatttcttacagaaaaatgtccattccacaaggtttgtgacatatttctgtgagcaggttctccctaacctcggtaccttgactaccccagtggaaggtcttgatatacagttggaggtaagcaaaaatttcagctttagcactgataaggcattcttatattttaacaaaaatgtaaaccactaacttagatccgatttctaagggagcagtttaaatgtctggtaatggccagccagtaatctccctagaccagaattaattgcattaggactgcttcatggattcaattaaagtttgctgcaatgggaaagccttacctgtagttttattatagtcagtctctacttttgtagccttaatatttttaaataaggtg

SEQ ID NO: 76534 - DNA, 3751 bp, Homo sapiens
agcgggctgtgcgcggtgaactcggcggctgcactggcggcagctggaggtgtaatagtgcgggtagtgggtttggagaagttccgaggcggcggtggcgccggtcaggacaaggatagcggaaccgggccctgggcttgtcgctcaccatgccgacagtagaggagctttaccgcaattatggcatcctggccgatgccacggagcaagtgggccagcataaagatgcctatcaagtgatattggatggtgtgaaaggtggtactaaggaaaagcgattagcagctcaatttattccgaaattctttaagcattttccagaattggctgattctgctatcaatgcacagttagacctctgtgaggatgaagatgtatctattcgacgtcaagcaattaaagaactgcctcaatttgccactggagaaaatccttcctcgagtggccagataatactaacgcaacttttgccagaacagatgactctgccagaatttaaccctagtgaacaatgccccctattaagtatatttaaaatggatgcaaaagggacttttaggtgggttgttcagcccaaatacttcaaggagaggacattgttagagaacgagcaattaaattcctttctacaaaacttaagactttaccagatgaagtcttaacaaaggaagtggaagagcttatactaactgaatccaaaaaggtcctagaagatgtgactggtgaagaatttgttctatttatgaagatactgtctgggttaaaaagcttacagacagtgagtggaagacagcaacttgtagagttggtggctgaacaggccgacctagaacagaccttcaatccctcggatcctgactgtgtggacaggctcttacagtgcactcggcaggcagtacccctcttctctaaaaatgtccattccacaaggtttgtgacatatttctgtgagcaggttctccctaacctcggtaccttgactaccccagtggaaggtcttgatatacagttggaggtattgaaattgttggcggagatgagttcattttgtggtgacatggaaaaactagaaacaaatttaaggaaactatttgataagttattggaatacatgcccctccctccagaagaggcagaaaatggagagaatgctggtaatgaagaacccaagctacagttcagttatgtggaatgtttgttgtacagttttcaccagttgggccgaaaacttccagatttcttaacagccaaactgaatgcagaaaagctcaaagatttcaaaatcaggctgcagtactttgcacggggcctgcaagtttatatcagacaacttcgcttagctctccagggtaaaacgggtgaggccttaaaaacagaagagaacaagattaaagtcgttgcattgaaaataacaaacaatatcaatgttttaatcaaggatctcttccacattcctccttcttataagagcacagtaacactatcctggaaacctgtacaaaaggttgagattgggcaaaagagagccagtgaagatacaacttcaggttcaccacccaagaaatcttcagcaggaccaaaaagagatgccaggcagatttataaccctcccagtgggaaatatagcagcaatttgggcaactttaattatgagagagaggagccttcaggggaagtagaggtggccgaggttggggcacacgaggaaatcgtagtcggggaagactctactgaataagacatcagcattcttcagcattgtcatgagcttaatatacttaaattctactactcattggattgccggggatgtccctttaaacagactgctgccttcagctaaaaacttaatgttctttatacctttgtatgtatgacctacttttgtaacagaccatggttgtgtccaaggtaaaaccacagtgatatttttggatgctttgtctgcaatcttgacttgtttttgcagtatcattattcagacttcaaattgtgaatcttttaaacatcttgataatttgttgttgagagctgttcattctaaaatgtaatgaaattcagtctagttctgctgataaagatcatcagttttgaaaggttactgattttcctcttccctcttagttttttacccaatatatggagaagagtaatggtcaatcttaacattttgttttaattgtttaataaagctgctgggcagtggtgcagcattcctacctagtgtcataaaagcaaaatacttacatagctttcttaaaatataggaatgacattacatttttaggagaaagtaagttgctttgcaccgcctacttaattcttttccatatattgtgatacaaacttttgaatatggaatcttactatttgaatagaaatgtgtatgtataatatacatacatacataagcatatatgtgtgtgtgtgtgtgtatatatatatatatgcatgctgtgaaacttgactacacaacataaatcactttttaaattccaggaacgggtagtctgacacggtgattatccttttgaggctgaatccgttattaacttgttatttaggtttttactcccagtagcaagggattctaagttagttgcacttacatgattattgttatttaaaactaagaataaaggctgcattttcaaagataaattggaattgctgttggtgaaataacaaccaaaatactgaatctgatgtacatacaggtttctacaggaagagatggtataatttacaatttggagatttaataaccagggctacccagaaaaagtgacttgataacatggtaccaataagtaagggatgctctctcggtttgcttttgccactttcaagattttaacttctcaggttattaatcaaaattattgtataagttagccaatagaatttttaggttaaaacaacagatggggggtttgtggagtgtttaatgtcatgggcatttttagtagcatagaccctttgttctgcatttgaatgtttcgtatatttttgtttcacagttaatcttccctccccaagtttgctattcaaatcaactgcctgaatgacatttctagtagtctgatgtatttttctgaggaatagtttgtgattccaatgcaggtgtcttcattaccattacctctacactgcagaagaagcaaaactcctttattagaattactgcacatgtgtatggggaaaatagttctgaaaggctagaatgatacaagtgagcaaaagttggtcagcttggctatggagtggtggcaataatctctaaacattccaaaagaccatgagctgaacctaaactcccttggaatctgaacaaaggaatataaaattgccatttgaaaactgaccagctaatctggacctcagagatagatcagccagtggcccaaagccatttcaagtacagaaattatagagactacagctaaataaatttgaacattaaatataattttaccactttttgtctttataagcatatttgtaaactcagaactgagcagaagtgactttactttctcaagtttgatactgagttgactgttcccttatccctcacccttccccttccctttcctaaggcaatagtgcacaacttaggttatttttgcttccgaatttgaatgaaaaacttaatgccatggatttttttcttttgcaagacacctgtttatcatcttgtttaaatgtaaatgtccccttatgcttttgaaataaatttccttttgtaatt

SEQ ID NO: 76535 - DNA, 2669 bp, Homo sapiens
gatcccctactgttccacagggggaatacatgcccctccctccagaagaggcagaaaatggagagaatgctggtaatgaagaacccaagctacagttcagttatgtggaatgtttgttgtacagttttcaccagttgggccgaaaacttccagatttcttaacagccaaactgaatgcagaaaagctcaaagatttcaaaatcaggctgcagtactttgcacggggcctgcaagtttatatcagacaacttcgcttagctctccagggtaaaacgggtgaggccttaaaaacagaagagaacaagattaaagtcgttgcattgaaaataacaaacaatatcaatgttttaatcaaggatctcttccacattcctccttcttataagagcacagtaacactatcctggaaacctgtacaaaaggttgagattgggcaaaagagagccagtgaagatacaacttcaggttcaccacccaagaaatcttcagcaggaccaaaaagagatgccaggcagatttataaccctcccagtgggaaatatagcagcaatttgggcaactttaattatgagagagaggagccttcaggggaagtagaggtggccgaggttggggcacacgaggaaatcgtagtcggggaagactctactgaataagacatcagcattcttcagcattgtcatgagcttaatatacttaaattctactactcattggattgccggggatgtccctttaaacagactgctgccttcagctaaaaacttaatgttctttatacctttgtatgtatgacctacttttgtaacagaccatggttgtgtccaaggtaaaaccacagtgatatttttggatgctttgtctgcaatcttgacttgtttttgcagtatcattattcagacttcaaattgtgaatcttttaaacatcttgataatttgttgttgagagctgttcattctaaaatgtaatgaaattcagtctagttctgctgataaagatcatcagttttgaaaggttactgattttcctcttccctcttagttttttacccaatatatggagaagagtaatggtcaatcttaacattttgttttaattgtttaataaagctgctgggcagtggtgcagcattcctacctagtgtcataaaagcaaaatacttacatagctttcttaaaatataggaatgacattacatttttaggagaaagtaagttgctttgcaccgcctacttaattcttttccatatattgtgatacaaacttttgaatatggaatcttactatttgaatagaaatgtgtatgtataatatacatacatacataagcatatatgtgtgtgtgtgtgtgtatatatatatatatgcatgctgtgaaacttgactacacaacataaatcactttttaaattccaggaacgggtagtctgacacggtgattatccttttgaggctgaatccgttattaacttgttatttaggtttttactcccagtagcaagggattctaagttagttgcacttacatgattattgttatttaaaactaagaataaaggctgcattttcaaagataaattggaattgctgttggtgaaataacaaccaaaatactgaatctgatgtacatacaggtttctacaggaagagatggtataatttacaatttggagatttaataaccagggctacccagaaaaagtgacttgataacatggtaccaataagtaagggatgctctctcggtttgcttttgccactttcaagattttaacttctcaggttattaatcaaaattattgtataagttagccaatagaatttttaggttaaaacaacagatggggggtttgtggagtgtttaatgtcatgggcatttttagtagcatagaccctttgttctgcatttgaatgtttcgtatatttttgtttcacagttaatcttccctccccaagtttgctattcaaatcaactgcctgaatgacatttctagtagtctgatgtatttttctgaggaatagtttgtgattccaatgcaggtgtcttcattaccattacctctacactgcagaagaagcaaaactcctttattagaattactgcacatgtgtatggggaaaatagttctgaaaggctagaatgatacaagtgagcaaaagttggtcagcttggctatggagtggtggcaataatctctaaacattccaaaagaccatgagctgaacctaaactcccttggaatctgaacaaaggaatataaaattgccatttgaaaactgaccagctaatctggacctcagagatagatcagccagtggcccaaagccatttcaagtacagaaattatagagactacagctaaataaatttgaacattaaatataattttaccactttttgtctttataagcatatttgtaaactcagaactgagcagaagtgactttactttctcaagtttgatactgagttgactgttcccttatccctcacccttccccttccctttcctaaggcaatagtgcacaacttaggttatttttgcttccgaatttgaatgaaaaacttaatgccatggatttttttcttttgcaagacacctgtttatcatcttgtttaaatgtaaatgtccccttatgcttttgaaataaatttccttttgtaatt

SEQ ID NO: 76536 - DNA, 3544 bp, Homo sapiens
agcgggctgtgcgcggtgaactcggcggctgcactggcggcagctggaggtgtaatagtgcgggtagtgggtttggagaagttccgaggcggcggtggcgccggtcaggacaaggatagcggaaccgggccctgggcttgtcgctcaccatgccgacagtagaggagctttaccgcaattatggcatcctggccgatgccacggagcaagtgggccagcataaagatgcctatcaagtgatattggatggtgtgaaaggtggtactaaggaaaagcgattagcagctcaatttattccgaaattctttaagcattttccagaattggctgattctgctatcaatgcacagttagacctctgtgaggatgaagatgtatctattcgacgtcaagcaattaaagaactgcctcaatttgccactggagaaaatccttcctcgagtggccagataatactaacgcaacttttgccagaacagatgactctgccagaatttaaccctagtgaacaatgccccctattaagtatatttaaaatggatgcaaaagggacttttaggtgggttgttcagcccaaatacttcaaggagaggacattgttagagaacgagcaattaaattcctttctacaaaacttaagactttaccagatgaagtcttaacaaaggaagtggaagagcttatactaactgaatccaaaaaggtcctagaagatgtgactggtgaagaatttgttctatttatgaagatactgtctgggttaaaaagcttacagacagtgagtggaagacagcaacttgtagagttggtggctgaacaggccgacctagaacagaccttcaatccctcggatcctgactgtgtggacaggctcttacagtgcactcggcaggcagtacccctcttctctaaaaatgtccattccacaaggtttgtgacatatttctgtgagcaggttctccctaacctcggtaccttgactaccccagtggaaggtcttgatatacagttggaggtattgaaattgttggcggagatgagttcattttgtggtgacatggaaaaactagaaacaaatttaaggaaactatttgataagttattggaatacatgcccctccctccagaagaggcagaaaatggagagaatgctggtaatgaagaacccaagctacagttcagttatgtggaatgtttgttgtacagttttcaccagttgggccgaaaacttccagatttcttaacagccaaactgaatgcagaaaagctcaaagatttcaaaatcaggctgcagtactttgcacggggcctgcaagtttatatcagacaacttcgcttagctctccagggtaaaacgggtgaggccttaaaaacagaagagaacaagattaaagtcgttgcattgaaaataacaaacaatatcaatgttttaatcaaggatctcttccacattcctccttcttataagagcacagtaacactatcctggaaacctgtacaaaaggttgagattgggcaaaagagagccagtgaagatacaacttcaggttcaccacccaagaaatcttcagcaggaccaaaaagagatgccaggcagatttataaccctcccagtgggaaatatagcagcaatttgggcaactttaattatgagagagaggagccttcaggggaagtagaggtggccgaggttggggcacacgaggaaatcgtagtcggggaagactctactgaataagacatcagcattcttcagcattgtcatgagcttaatatacttaaattctactactcattggattgccggggatgtccctttaaacagactgctgccttcagctaaaaacttaatgttctttatacctttgtatgtatgacctacttttgtaacagaccatggttgtgtccaaggtaaaaccacagtgatatttttggatgctttgtctgcaatcttgacttgtttttgcagtatcattattcagacttcaaattgtgaatcttttaaacatcttgataatttgttgttgagagctgttcattctaaaatgtaatgaaattcagtctagttctgctgataaagatcatcagttttgaaaggttactgattttcctcttccctcttagttttttacccaatatatggagaagagtaatggtcaatcttaacattttgttttaattgtttaataaagctgctgggcagtggtgcagcattcctacctagtgtcataaaagcaaaatacttacatagctttcttaaaatataggaatgacattacatttttaggagaaagtaagttgctttgcaccgcctacttaattcttttccatatattgtgatacaaacttttgaatatggaatcttactatttgaatagaaatgtgtatgtataatatacatacatacataagcatatatgtgtgtgtgtgtgtgtatatatatatatatgcatgctgtgaaacttgactacacaacataaatcactttttaaattccaggaacgggtagtctgacacggtgattatccttttgaggctgaatccgttattaacttgttatttaggtttttactcccagtagcaagggattctaagttagttgcacttacatgattattgttatttaaaactaagaataaaggctgcattttcaaagataaattggaattgctgttggtgaaataacaaccaaaatactgaatctgatgtacatacaggtttctacaggaagagatggtataatttacaatttggagatttaataaccagggctacccagaaaaagtgacttgataacatggtaccaataagtaagggatgctctctcggtttgcttttgccactttcaagattttaacttctcaggttattaatcaaaattattgtataagttagccaatagaatttttaggttaaaacaacagatggggggtttgtggagtgtttaatgtcatgggcatttttagtagcatagaccctttgttctgcatttgaatgtttcgtatatttttgtttcacagttaatcttccctccccaagtttgctattcaaatcaactgcctgaatgacatttctagtagtctgatgtatttttctgaggaatagtttgtgattccaatgcaggtgtcttcattaccattacctctacactgcagaagaagcaaaactcctttattagaattactgcacatgtgtatggggaaaatagttctgaaaggctagaatgatacaagtgagcaaaagttggtcagcttggctatggagtggtggcaataatctctaaacattccaaaagaccatgagctgaacctaaactcccttggaatctgaacaaaggaatataaaattgccatttgaaaactgaccagctaatctggacctcagagatagatcagccagtggcccaaagccatttcaagtacagaaattatagagactacagctaaataaatttgaacattaaatataattttaccactttttgtctttataagcatatttgtaaactctccctatccctgacctttccccttcctttcctaaa

SEQ ID NO: 76537 - DNA, 2674 bp, Homo sapiens
agcgggctgtgcgcggtgaactcggcggctgcactggcggcagctggaggtgtaatagtgcgggtagtgggtttggagaagttccgaggcggcggtggcgccggtcaggacaaggatagcggaaccgggccctgggcttgtcgctcaccatgccgacagtagaggagctttaccgcaattatggcatcctggccgatgccacggagcaagtgggccagcataaagatgcctatcaagtgatattggatggtgtgaaaggtggtactaaggaaaagcgattagcagctcaatttattccgaaattctttaagcattttccagaattggctgattctgctatcaatgcacagttagacctctgtgaggatgaagatgtatctattcgacgtcaagcaattaaagaactgcctcaatttgccactggagaaaatccttcctcgagtggccagataatactaacgcaacttttgccagaacagatgactctgccagaatttaaccctagtgaacaatgccccctattaagtatatttaaaatggatgcaaaagggacttttaggtgggttgttcagcccaaatacttcaaggagaggacattgttagagaacgagcaattaaattcctttctacaaaacttaagactttaccagatgaagtcttaacaaaggaagtggaagagcttatactaactgaatccaaaaaggtcctagaagatgtgactggtgaagaatttgttctatttatgaagatactgtctgggttaaaaagcttacagacagtgagtggaagacagcaacttgtagagttggtggctgaacaggccgacctagaacagaccttcaatccctcggatcctgactgtgtggacaggctcttacagtgcactcggcaggcagtacccctcttctctaaaaatgtccattccacaaggtttgtgacatatttctgtgagcaggttctccctaacctcggtaccttgactaccccagtggaaggtcttgatatacagttggaggtattgaaattgttggcggagatgagttcattttgtggtgacatggaaaaactagaaacaaatttaaggaaactatttgataagttattggaatacatgcccctccctccagaagaggcagaaaatggagagaatgctggtaatgaagaacccaagctacagttcagttatgtggaatgtttgttgtacagttttcaccagttgggccgaaaacttccagatttcttaacagccaaactgaatgcagaaaagctcaaagatttcaaaatcaggctgcagtactttgcacggggcctgcaagtttatatcagacaacttcgcttagctctccagggtaaaacgggtgaggccttaaaaacagaagagaacaagattaaagtcgttgcattgaaaataacaaacaatatcaatgttttaatcaaggatctcttccacattcctccttcttataagagcacagtaacactatcctggaaacctgtacaaaaggttgagattgggcaaaagagagccagtgaagatacaacttcaggttcaccacccaagaaatcttcagcaggaccaaaaagagatgccaggcagatttataaccctcccagtgggaaatatagcagcaatttgggcaactttaattatggtgagcgtttccgtttgggtacaaggaatatgagagattaggcagaaattgtgttatactttattttaattagtaattatatacagtgtcatggttctatccaatgacttttctgaattagcttggagaactagggctgttgaggaaatgatttatcccattcctctctcattcacccttctgggctgactgtattgaacatgcaacattaaacagtaagcacttaaagaaaatatgcctcttgtattcagaggaaccaacagaaacaaaataagttgacagaaccattctttccatgctttcccagttgcagcttcaaggcaaggcattctgtgcattctccctcagggatgggtatagcttctgagagatagtataaatgctctttcttggacatagtcagcctgctgcctatactcccatcttctgtagctagttaaaaagaaataacagaagtggagtcagatgttcaggcatcatctagcaaggaagatgtgttctattgcagtctctccctctgcccagaatgcaatcctcctatcagtgcttcctattcccctttagccattagagccaggagagcttcataccagtccatcctctcccacggctgtcgaatcaaaagtaaagtttatctctcattggcttatttcctcatggatctttttttttaaaagaatggagagaaatatcaggtcaattccttaccttgcttaagaagacaaagtttaggccgggggcagtggctcaagcctgtaatcccagcactttgggaggccgaggcaggcggatcacgaggtcaggagatcgagaccatcctggctaacagggtgaaaccccgtctctactaaaaataccaaaaatttgccaggtgtggtggcgggcgcctgctagtcccagctactctggaggctgaggcaggagaatggtttgaacctgggaggtggagctttcagtgagtggagatcgcaccactgtactccagcctaggcgacagagccaagactccgtctcaaaaaaaa

SEQ ID NO: 76538 - DNA, 2382 bp, Homo sapiens
agcgggctgtgcgcggtgaactcggcggctgcactggcggcagctggaggtgtaatagtgcgggtagtgggtttggagaagttccgaggcggcggtggcgccggtcaggacaaggatagcggaaccgggccctgggcttgtcgctcaccatgccgacagtagaggagctttaccgcaattatggcatcctggccgatgccacggagcaagtgggccagcataaagatgcctatcaagtgatattggatggtgtgaaaggtggtactaaggaaaagcgattagcagctcaatttattccgaaattctttaagcattttccagaattggctgattctgctatcaatgcacagttagacctctgtgaggatgaagatgtatctattcgacgtcaagcaattaaagaactgcctcaatttgccactggagaaaatccttcctcgagtggccagataatactaacgcaacttttgccagaacagatgactctgccagaatttaaccctagtgaacaatgccccctattaagtatatttaaaatggatgcaaaagggacttttaggtgggttgttcagcccaaatacttcaaggagaggacattgttagagaacgagcaattaaattcctttctacaaaacttaagactttaccagatgaagtcttaacaaaggaagtggaagagcttatactaactgaatccaaaaaggtcctagaagatgtgactggtgaagaatttgttctatttatgaagatactgtctgggttaaaaagcttacagacagtgagtggaagacagcaacttgtagagttggtggctgaacaggccgacctagaacagaccttcaatccctcggatcctgactgtgtggacaggctcttacagtgcactcggcaggcagtacccctcttctctgtgagctctttatttttacacacccggtattagctatatatatatttccataaatactcactttaacattccccttaaacctttccagtagtgtcccttatctgaaatgcttgcttggaaccagaagtgtattcagatttttgaatatttgcattgtgcctggttgagcatccctaattcaaaaatccaaaacctgaaatgctttaatgagcatttcctttgagcgtgatgtttgagcatcacattggtgctcaaaaagttttggattttgaagcatttcagatttgggattttcagatgagggatgcttggtctgtgtttatgaaggccacagtggtgttggtgagaacccaaagcagcaagaaactttcttgaaagaaagaattttttttttcctttgagacagagtcttgccctgtcactcatgctggagtgcagtggcacgatcttggcttactgcagcttctacctcccaggctcaagccttccttccatctcagcctcccaagtagctgctactacagtcatgcactatcacactcggctaatttttgtgtttttgtagagacggggcttccccatgttgcccatactagtcttgaactcctgagctgaagcagtctgcccaccttggcctcccaaagtgctgggattacaggtgtgagccaccatgagtggccaataaattttttttaagtcttcctagagactttttttgaaagtcatgagaattttgcattctgtctcaggctttgtgtttcctgaggccatgcatcttctgggatgtgcatacattcatttgaaaaacacaatttaaaggaactatcctagagcaggcgtggtggcccgtccctgtaatcccaatcccagcactttgtgagccaaggtgggagtatcacttgaggctgagttcaagaccagcctgggcaacagagcaagaccttgtctctacaaaaaaaattaagtaatagaattatcccttttgagaaatgtgcagtctgaaaatccaacactaaaagatgtccacaattcatttatttatttatttatttatttatgagacagagtctcgctccatcccccaggctggagtgcagtggcatgatcttggctgactgcaacctccacctcccagattcaagcaattctcgtgcctcaacttcccgagtagctgggattacaggcaagcaccaccacacccagctgattttttgtatttttagtagggatggggttttgccatgttgcccaggctgctctcgcactcctgagttcaggcaatccacctgcctcagcctcccaaagtgctaggattacaggcatgagccaccatgcctggccatgccccaaatttgaccagagaatcaaggaagagatcaaaatgtatagatgttccaatgctccagatgactttgcagtaaagtatataaggggtcttcaaaaagttcctggaaaatgcatattatgaaaga

SEQ ID NO: 76539 - DNA, 364 bp, Homo sapiens
aattagccgggcgcggtggcgggcgcctgtagtccaagctactcaggaggctgaggcaggagaatggcgtgaacccgggaggcagagcttgccgtgagctgagatcgcaccactgcactccagcctgggggacagacagagcgagactccgtctcaaaaaaaaaagagaaagttctgagctttgtgcactctagtcccctactaggttaaaggacagtgggttgggatccccatgggttgtggcttgatgtatctgtgagaggaacacgagcatctgtgagctgcagggtgtctggaaggctgtgcccctggggagactcagccagaaaaccaacgtaagatcaggacagtgcaccctgctggg

SEQ ID NO: 76540 - DNA, 899 bp, Homo sapiens
  misc_feature (2)..(3): n is a, c, g, or t
gnnggtcagccagtcctgagcacctaaccatgttgggcatcactgtcctcgctgcgctcttggcctgtgcctccagctgtggggtgcccagcttcccgcccaacctatccgcccgagtggtgggaggagaggatgcccggccccacagctggccctggcagatctccctccagtacctcaagaacgacacgtggaggcatacgtgtggcgggactttgattgctagcaacttcgtcctcactgccgcccactgcatcagcaacacccggacctaccgtgtggccgtgggaaagaacaacctggaggtggaagacgaagaaggatccctgtttgtgggtgtggacaccatccacgtccacaagagatggaatgccctcctgttgcgcaatgatattgccctcatcaagcttgcagagcatgtggagctgagtgacaccatccaggtggcctgcctgccagagaaggactccctgctccccaaggactacccctgctatgtcaccggctggggccgcctctggaccaacggccccattgctgataagctgcagcagggcctgcagcccgtggtggatcacgccacgtgctccaggattgactggtggggcttcagggtgaagaaaaccatggtgtgcgctgggggcgatggcgtcatctcagcctgcaatggggactccggtggcccactgaactgccagttggagaacggttcctgggaggtgtttggcatcgtcagctttggctcccggcggggctgcaacacccgcaagaagccggtagtctacacccgggtgtccgcctacatcgactggatcaacgagaaaatgcagctgtgatttgttgctgggagcggcggcagcgagtccctgcaacagcaataaacttccttctcctcgggc

SEQ ID NO: 76541 - DNA, 947 bp, Homo sapiens
  misc_feature (2)..(3): n is a, c, g, or t
gnnggtcagccagtcctgagcacctaaccatgttgggcatcactgtcctcgctgcgctcttggcctgtgcaacacccggacctaccgtgtggccgtgggaaagaacaacctggaggtggaagacgaagaaggatccctgtttgtgggtgtggacaccatccacgtccacaagagatggaatgccctcctgttgcgcaatgatattgccctcatcaagcttgcagagcatgtggagctgagtgacaccatccaggtggcctgcctgccagagaaggactccctgctccccaaggactacccctgctatgtcaccggctggggccgcctctggaccaacggccccattgctgataagctgcagcagggcctgcagcccgtggtggatcacgccacgtgctccaggattgactggtggggcttcagggtgaagaaaaccatggtgtgcgctgggggcgatggcgtcatctcagcctgcaatggggactccggtggcccactgaactgccagttggagaacggttcctgggaggtgtttggcatcgtcagctttggctcccggcggggctgcaacacccgcaagaagccggtagtctacacccgggtgtccgcctacatcgactggatcaacgagaaaatgcagctgtgatttgttgctgggagcggcggcagcgagtccctgcaacagcaataaacttccttctcctcgggcaaaaaaaaaaacaaacaaacaaaaaaaaatttggtgggcgctctgggcccgcgaaaaagttcttaacacacttccgttgggcgcgcgccccccaggggtaggaaccctggcacagcggccacaaagaacaccggccgggcatagggcggggttccccccataaaaaggcggggggcaccgcggtttgaacaacccacagggttcggggcctagggcttcaacaaggcccagggcgata

SEQ ID NO: 76542 - DNA, 1137 bp, Homo sapiens
  misc_feature (2)..(3): n is a, c, g, or t
gnnggtcagccagtcctgagcacctaaccatgttgggcatcactgtcctcgctgcgctcttggcctgtgcctccagctgtggggtgcccagcttcccgcccaacctatccgcccgagtggtgggaggagaggatgcccggccccacagctggccctggcagatctccctccagtacctcaagaacgacacgtggaggcatacgtgtggcgggactttgattgctagcaacttcgtcctcactgccgcccactgcatcagcaacacccggacctaccgtgtggccgtgggaaagaacaacctggaggtggaagacgaagaaggatccctgtttgtgggtgtggacaccatccacgtccacaagagatggaatgccctcctgttgcgcaatgatattgccctcatcaagcttgcagagcatgtggagctgagtgacaccatccaggtggcctgcctgccagagaaggactccctgctccccaaggactacccctgctatgtcaccggctggggccgcctctggaccaacggccccattgctgataagctgcagcagggcctgcagcccgtggtggatcacgccacgtgctccaggattgactggtggggcttcagggtgaagaaaaccatggtgtgcgctgggggcgatggcgtcatctcagcctgcaatggggactccggtggcccactgaactgccagttggagaacggttcctgggaggtgtttggcatcgtcagctttggctcccggcggggctgcaacacccgcaagaagccggtagtctacacccgggtgtccgcctacatcgactggatcaacgagaaaatgcagctgtgatttgttgctgggagcggcggcagcgagtccctgcaacagcaataaacttccttctcctcgggcaaaaaaaaaaacaaacaaacaaaaaaaaatttggtgggcgctctgggcccgcgaaaaagttcttaacacacttccgttgggcgcgcgccccccaggggtaggaaccctggcacagcggccacaaagaacaccggccgggcatagggcggggttccccccataaaaaggcggggggcaccgcggtttgaacaacccacagggttcggggcctagggcttcaacaaggcccagggcgata

SEQ ID NO: 76543 - DNA, 581 bp, Homo sapiens
  misc_feature (2)..(3): n is a, c, g, or t
gnnggtcagccagtcctgagcacctaaccatgttgggcatcactgtcctcgctgcgctcttggcctgtgcctccagctgtggggtgcccagcttcccgcccaacctatccgcccgagtggtgggaggagaggatgcccggccccacagctggccctggcagatctccctccagtacctcaagaacgacacgtggaggcatacgtgtggcgggactttgattgctagcaacttcgtcctcactgccgcccactgcatcagcaacacccggacctaccgtgtggccgtgggaaagaacaacctggaggtggaagacgaagaaggatccctgtttgtgggtgtggacaccatccacgtccacaagagatggaatgccctcctgttgcgcaatgatattgccctcatcaagcttgcagagcatgtggagctgagtgacaccatccaggtggcctgcctgccagagaaggactccctgctccccaaggactacccctgctatgtcaccggctggggccgcctctggaccccacggccccatttcttaaaaacctgaaacaggcccctgtaccctgggggatatacc

SEQ ID NO: 76544 - DNA, 880 bp, Homo sapiens
agcagcttggaccaccatttacatagctgcatggtcctgggacatacgatggaaagaatgaggaatggttataaaataaggaggctgagatgcataaaaatagaagagaaccagtcacatttggttaccactcaattacgagtgagattagcattacgagggaccctaattgaaagcaagtcccgagaagcctgtcgtgcctttgctttggtgacatatacatgtccacggacagggctcctggagacctcagcactttctaggttgctccttgattgcttcagtggaagctgtcagcctcctaatttctaacccatgttcttgcttctaagttagtttgaaacaaaactagtctaaataaagttgctcagaaaatacctcctgagttatttgacgagacgtttactgcatctctttaattttaaattgccagatgggtgagaggacacctgagtcactttcttctccctcacacccagcccagtcccttgaccagcaggagttggtaactgttgaataatgacacttctctccctccttcctactctttttccatcccactattgctcacttatttaatgaaacagcataaagtccagaccctattttaaaaattaatcttcccctttgggaggccgaggtgggtggattaggaggtcaggagatcgaaaccatcctggctaacaccgtgaaaccctgtctctactaaaaatacaaaaaattagccaggtgaggtggcggtcgcctgtggtcccagctactcgggaggctgaggcaggagaatggtgtgaacccaggaggtggagcttgcagtgagccgagatcgcgccactgcactccagcctgggcgacagagcgagactccatctcaaaaaaaaaa

SEQ ID NO: 76545 - DNA, 284 bp, Homo sapiens
aaaagtatttggggtctatgaaatcattctcagtttagcctttagtttttgctttatgtattttaagaaggaaaataaatcaatacttacttgaagaaacacaaaatttatagctttgcaactggcccattgcttacaaacagtagggttaaaattgcaatgcttagatattgaaaaacaaaacactagtagtccaagaatcccatcaagtgctcaattgtaattttgtctttaaatgcaaaataatgtcacaagcaatcatgctaaatgtttgtgttactgta

SEQ ID NO: 76546 - DNA, 409 bp, Homo sapiens
  misc_feature (401)..(408): n is a, c, g, or t
tttaattaaagagacagggtctcactctgttgcccaggctgaagtgcactgaagtgatcacagctcaccgtaacctctaagtcttggcctcaagaggtcctcccacttcagcttcctgagtaggtgggactacaggtgtgcactgccacacccagctaatgtttaaaatttttttgtagacaaggagtcttgctatgttgcccaggttggtcttgaactcctggcctcaagcaatcctcccacctctgcctcccaaagtgttgggattacaggtgtgagccactacaagcaggctgccttgcttctcttcgtagtttcaccacataggaatgtattcccaaacaatacgctatcaagttgaggtttttttgtttttgttttttttgagacagagatttcannnnnnnna

SEQ ID NO: 76547 - DNA, 372 bp, Homo sapiens
atagttatgtcatgtatcaccacatataagtgggtaaatgatcactgtcacaacatgctctacataaacaacaacactgaataaaaaagacctctgaggaacaggccaatttgaaactaggaattctagatttttaccttcggactttttaatttcctcttcccataattacagatgagaaaataaaatacatcctgtaaattcacccacttcaccacaaagtttgaagactactaaaataccttataattggatcaaatgtattcaagctggatctaaaaccctctgtattacctgaccatataaccactacccttgtgtttgtgtgcaacaatagctcctacagtagattttttttagggtaaaaagtac

SEQ ID NO: 76548 - DNA, 448 bp, Homo sapiens
caacaactattgtcaatgtttctcctttctgttaatgggaaatttaatgaccctttcctatgagaaaatgatgacaagaacctgtttcatggtgaaatctgaaagctgtgtggcttgtgttcttgtttgaatccaagggttggactaaattgacttctacactcctgcaaatttttccccaaagcttccatggtttgcactttcaaaacaactacttagcattaaaacttgtgtcaaatcccatgaagcgagttatctattaaatggagttaatgttttaaagatgcataatgatgggtttcttctgtactctctctaatcaaatgcttggatttttctgaccatactccaccccacataaagatttgaactatatgtcactactctgtaaaatgcagatcaagagagttacaagaaaaaataataaaatagtacatatttattcaaa

SEQ ID NO: 76549 - DNA, 339 bp, Homo sapiens
ggacttaatgtgggtgttaaatgaatacttgttgactaggtcccagggaggacctttgaaccttgggatgtataatttctattgtagttaaaacctttaaattataagaacagaaattcgctcaaactaggaaaagttaaaaaggggtttttaaagggacatctcataggaaggaagcactagttgggcctcaccggaattggagctggaaggtgggaagcgtctggtgagaaggaaagctgcaccttccatctctcccattctgggggccactcagtatctcagatgatctctgtgaactgttcagttcactgtttctctctccagattgcttccttt

SEQ ID NO: 76550 - DNA, 829 bp, Homo sapiens
cagccctagcccacctttgtttgtttggtgacagcaactaaggtctggtcagggccgcttggccacgctcatgccttttcctctcaacagttgcttctttgagtcagggtgcagctctggtcacctggcggcctcttcagctcagccctccacaaagtgtgagcctgaaggaccaccctgaattgcccttgtaggacccagaacagctaccagcagaatcagattctcatggaccaactggtattcaaagagacaatctggaatgatgcgttctggcagaacccctgggaccaggggggcctggcagtgattatcttattcatcaccgctgtcctgcttctcatcttatttgccatcgtgtttggtttactcacttccacagaaaacactcagtgtgaagcgggtgaagaggagtgacctgacttgctggggactgagatggcagcaggggaggcgagctgacctgcccccattccagtggtgggccccttcgcggttccctctggctcaggggccaagccctggtgtcttcctttcccaccaggaaaaagtctagtaaaatactgtatctggcttagggttggtcagactagtaagatggggaggctggtctgagaccaattctggctccttgaccctattgtttttagggttccccgaccagaaccctaaaagcacatggagaggatggctccactgcctcaggtggaaggagctatggctaacaaggttctctaacaggctcacaggcccagccagcaatttcacaaatccttgacagagaaagacacaaccaaatgaaataaaaattccttttcaaatctgctaa

SEQ ID NO: 76551 - DNA, 574 bp, Homo sapiens
cagccctagcccacctttgtttgtttggtgacagcaactaaggtctggtcagggccgcttggccacgctcatgccttttcctctcaacagttgcttctttgagtcagggtgcagctctggtcacctggcggcctcttcagctcagccctccacaaagtgtgagcctgaaggaccaccctgaattgcccttgtaggacccagaacagctaccagcagaatcagattctcatggaccaactggtattcaaagagacaatctggaatgatgcgttctggcagaacccctgggaccaggggggcctggcagtgattatcttattcatcaccgctgtcctgcttctcatcttatttgccatcgtgtttggtttactcacttccacagaaaacactcagtgtgaagcgggtgaagaggagtgacctgacttgctggggactgagatggcagcaggggaggcgagctgacctgcccccattccagtggtgggccccttcgcggttccctctggctcaggggccaagccctggtgtcttcctttcccaccaggaaaaagtctagtaaaatactgtatctggc

SEQ ID NO: 76552 - DNA, 622 bp, Homo sapiens
tcttattacatatgttatcttactaagtttttaaaataaattgataaatacttaaactttttctcatttaatttctaatacggtgaatgttgatcattacaagccacataaacaaaagctcttgggagtattcactaatttttaagaacacaaagtggtcctgactaaagagattgaaaactctttctttaaggaaagaaggccagattcatcaaatgaacaaagttctgaagttttaatcatttgggtattcctttggaatatggacttaacatgcctctagtttctttttctggttataagaatgtatcagtggactactgtgacattttccaaatattcagagggtaagaaggtttttgtttttaaaatggatgctacctatgtggttgccataccaaattgagatacagttaatggtcattcttgtcagcctgttcacacttgataccactctattggttgtgaggtatacctgtggttttggagctgttcaccatggcagattacttcagggttgtagtgactctcactttacagaagaggcaggaggattgcttaagcccaggaattcgagtccagcctggtcaacatagccagaccccatctctacaaaaaattt

SEQ ID NO: 76553 - DNA, 3916 bp, Homo sapiens
  misc_feature (948)..(948): n is a, c, g, or t
  misc_feature (1454)..(1454): n is a, c, g, or t
accggtccgctgtaacaccggcccggcgcagaagcgggacgtcggcttctaggggcccaggccggcggcggcgatggcctcggcagctgtggagagcttcgtgaccaagcaactggacctgctggagcttgagagagacgcggaggtggaggagcgcaggtcctggcaggagaacatctctctgaaagagctccagagccgaggcgtgtgtttgctgaagctgcaggtatccagccagcgcactgggctgtacggacggctgctggtcacctttgagcccaggcgatacgggtccgcggcagctcttcccagtaacagctttacttctggtgatatcgtgggcctgtacgatgctgctaatgagggcagtcagctggccactgggatcttgacccgggtcacccagaagtcggtcacggtggcctttgatgagtcccacgatttccagttgagcttggaccgagagaattcctacagactgttaaaacttgccaatgatgtcacttacaggcgactgaaaaaagccctgattgctctaaagaagtatcattctggcccagcctcctcactcatagaagtgctctttggcagatctgctcccagtcctgccagtgaaatacacccgctgacattcttcaacacctgcctggacacctcccagaaagaagcggtttcatttgcgctgtctcagaaagaacttgccatcatccatggacctcctggcactgggaaaaccacgactgtggttgagatcattcttcaagctgtgaaacaaggcttaaaggttctgtgctgcgccccctccaacatcgccgtggacaatctggtggagcgcctggctctgtgtaagcagcggattctgcgcctgggacaccctgcccgcctcctggagtccattcagcagcactccctggatgcggttttagcgcggagcgacagtgcccagantgttgcagatatcaggaaggacatcgaccaggtctttgtgaaaaacaaaaagacccaggataagagagagaaaagtaattttcgaaatgaaattaagctgttaagaaaagaactgaaggagagggaagaagcagctatgctcgagagcctcacttcggcaaacgtggtccttgcaacaaacacaggtgcgtctgccgatggccccctgaagttgctgcccgagagctacttcgacgtggtggtcattgacgagtgtgcccaggccctcgaggcgagctgctggatccccctgctgaaggccagaaagtgcatcctggcgggcgatcacaagcagctgccccccaccacagtctctcacaaggctgcgctggcaggactgtcactcagcctgatggaacgcctggctgaggagtacggcgcgagggtggtgcggacactgacggtgcagtaccgcatgcaccaggctatcatgcgctgggcctcagacaccatgtaccttgggcagntcacagcccactcttccgtggcaaggcacctcctgagggacctcccaggtgtggctgccacagaagagacgggtgtgcccctgctcttggtggacaccgccggctgcgggctgtttgagctggaggaggaggacgaacagtcgaaagggaaccctggcgaagtccgcctcgtcagtttgcacatccaggctctggtggacgctggtgttccagcccgtgacattgctgtggtctcgccatacaacctccaggtggacctgctcagacagagccttgtgcacaggcaccctgagcttgaaatcaagtctgtcgatggcttccaaggccgagagaaggaggccgtgatactgtccttcgtcagatccaacaggaaaggtgaagttggttttcttgctgaggaccggaggatcaacgtggctgtcacccgtgcccgacgccacgtggcggtcatctgtgactcccgtactgtcaacaaccatgcatttttgaagaccctggtggagtatttcacacagcatggggaagtacgcacggcctttgagtatcttgacgatattgtcccagaaaactattcccatgagaactcccagggttccagccacgctgccaccaagccccagggacctgctacgtccaccaggaccggaagccagcggcaggagggaggccaggaggctgcagcacctgccagacagggccggaagaagccggctgggaagtctctggcctctgaagctccatctcagcccagcctcaacggaggcagcccagagggagtggagagccaagatggcgtggaccacttccgggccatgatagtggagttcatggccagcaagaagatgcagttggagtttcctccttccctcaattcccacgacaggctgcgggtccaccaaatagccgaggagcacgggctgaggcacgacagttccggggaagggaagaggaggttcatcactgtgagcaagagggccccgcgaccccgagcagccctgggacccccagcagggaccggtggcccagcccctctccagccagtgccccctacccctgcgcagacagagcagcctcccagggagcagcgtggcccagaccagcctgatctgaggacgctgcacctggagagactgcagagggtcaggagcgcgcaggggcagcccgccagcaaggagcagcaggcctcagggcagcagaaacttccagaaaagaaaaagaaaaaagccaaaggacatccggccacagatctgcccacggaggaggactttgaggccctggtttctgccgccgttaaggctgataacacctgcggctttgccaagtgcacagccggcgtcacaaccctgggccagttctgccagctctgcagccgccgctactgcctcagccaccacctgcccgagatccatggctgcggtgagagggctcgcgcccatgcccggcagagaatcagccgggaaggggtcctctatgccggcagcgggaccaagaacggatccctggacccagccaagagggcccagctgcagaggaggctggataagaagctgagtgagctcagcaaccagaggaccagccggaggaaggagagggggacgtgaccggccgcatccttgcacgccccgcggagctctctccatggtagcccagggcgctggcagaccatgctccgcctccaccagggccacagaggagcggaggggcctatgggggaggagcggagggccctgttggggaaggttgggtttttggaccccagggataagcttttccgatgtcacaatgtggaggaaagcacctgggggacaacagtgctcgtgcaggtggggcttgggaaatgcacgtcccttccccttactccccgccaaaacccacatcccagcctctggatcctggggaaggttccagtccctggagaatacccagggcctcaaacttgaagtcactcctccaatgtctgggacttgccagctcagcccgttaggatgagggtgctgagaggaaacaggaaacaagactgcgaatggcgctcaggcagggagcagggagtggcgtttggcttgcacgttcccatgtggccagatgctggggccactttccttctgtctgctggtgactgcagtgttccccctcctcctcaccacggggctcctgtgagtctggggggcacctctttctggcctgtgcacctctctctggcttataaaggtgcctggcctgtgccaacccctccttgttgcgcctcaccgtggggaccaggtgagccggctctcccacgtggttgtcccgggaaaagctgccccacagcctcagcatcttcagcacttaccgatccagagcctcccggccttctccggtgtcctgtaccaactcttctatttaagagaacctcagatgatgtacctgagcctcagggttttgtttcagagggatataaattatttaaaaattaaatgaaaacg

SEQ ID NO: 76554 - DNA, 139 bp, Homo sapiens
gactctgctaagccatagacactctttcgtcttgttctttttgtgaattttgaaatactgaaaataatgtgatttaccaagtgctgttattgactatgttcaccagaacaatattaaaatctattaagaatgtatatta

SEQ ID NO: 76555 - DNA, 502 bp, Homo sapiens
cactacggtgtgtgggaggaagatgcagccaggttatagacttttttcttaaaaacaagaactcactacaaagtaaatgaaattatttttctgatacatctaaaagccagttctaggggaagttctaaaagaagcgttcagaaattggaacaagagcagtattattagaggacagtatgcatttggggtttgaattgttgtttagacctgtttatacctggtctgtgagttctgaaacccaacttgcttgggtgaagtgagccactgaagcctgtgttttggatgggaaggctatggcagaggggctccacgtttcccctgactgcattactgccttcacaaggttggccttcattaagcccctaattgttaagagtaaatgataagagtttaagttttttcttagtttgttttttatttgaggtatacttatactcattttagagaaagatcaatgtatgagaaaaggaacttaagaaacataaattcactgtaattattt

SEQ ID NO: 76556 - DNA, 268 bp, Homo sapiens
gactggcaccactgtaagaaagccctttatgaggtcatcatcccccacttgccatctctccccagatgcagatgtgcaagcttttaaaaacacttgagaagccaccatgcctcgctttgcaagccctcttttaagaaatgtcattatcagaagtcaatttgatggcatcaagaggaagcaatgcctccaatatctgaaaaccctgagaacactgcaatatgatggatttaagaccgtatattttggggaaaccaatatcccagaaagt

SEQ ID NO: 76557 - DNA, 406 bp, Homo sapiens
tattatttaaaaaaactaaaaggggcctaggcatggtggctcatgcctgtacctagcactttgggaggctgaggcaggaggattgcttgagaccaggagttcgagaccagcctgggcgatgtaatgagtctttgtctcttaaaaaaaattaaaataaattagttggtcattgtggcaggcacctgtagtcctggactggagaggtggatgtggaagcattgcttgagcctagaagtttaaggctgcagtgacatcacactccatcctgggtgagagagtaagagtctgtctaaaaaaaaaaataaggttccagtgtagttggcattttctaaaaactgcagctagtctgtttaaaacctagagaaggttgtggtaaaggcataatagatggctggcctgtgaggaa

SEQ ID NO: 76558 - DNA, 496 bp, Homo sapiens
tttttttgagatggaatttcactcgttgcccaggctggagtgcagtggcgtgatcttggctcactgcaagctctgcctcccgggttcaagcgattcttttgcctcagcctcccgagtagctgggattacaggcatctgccactacacccagctaattttttgtatttttagtagagacagggtttcaccatgttggccagcctgggcgatgtaatgagtctttgtctcttaaaaaaaattaaaataaattagttggtcattgtggcaggcacctgtagtcctggactggagaggtggatgtggaagcattgcttgagcctagaagtttaaggctgcagtgacatcacactccatcctgggtgagagagtaagagtctgtctaaaaaaaaaaataaggttccagtgtagttggcattttctaaaaactgcagctagtctgtttaaaacctagagaaggttgtggtaaaggcataatagatggctggcctgtgaggaa

SEQ ID NO: 76559 - DNA, 515 bp, Homo sapiens
aaacgtaacagaagaatgccaaagtcaagaatacaactgagaacatcttgaagctacgaattagtacttgccaccatccagctgttggttgcctatagattatcaagaattttacttgtatcattatctcatttaatactcacaataatcctggaaaaattattatccccatcttataaatgaggaaactgaggctcaaaagtttaaaagacttgcctgaagctacatagctcataagtaaaagagtaggaatttggacccaagtctgactggcactcaagccaagcactcttgaaattttctttaatcttctttctagtgtctcctagtgtctcccaaattgcttggattacaggcgtgagccactgtgcctggctggtttctgtcttttttctaatgcatgttttttccatggctgtgaccatattgtggaaaatgctgtattccatttttttttcatttaacatcataacaatattcaaatgccgttaaaaactttcatcaacatcataatt

SEQ ID NO: 76560 - DNA, 802 bp, Homo sapiens
aaagaatgttggggccacacaagcagagaacaccatgtcttcagatctcttcacagccttgtcctccagagtttagaagtggagggaaaagattaaaggcaatcttcttgttttgctatttgtccttggacctaatctggacttaatttggacacacaggctaacgaaggccgtgagtgtgagttgtccaggtccttggcaacaaagaattgaacaaaatgcacaaagtaacaaaggaacaaaacagagggaggaagcatcaaaagcggaaatttattaaggtaagaaatagggtgggtatgggcttgagcaagtggctcaaggacccagttacgaagttttctgggtttttagtactccttttgaggtccctatcagctaccactgatatggattaaggatttggtctgtggctaattaaaggcttaggagaattggcacgctatgcggatgaaggaatgcaggtgcttggcctgcagccactccaaggcactttccctttctacctgagaagtggtagaaaggggagggttgtagggacagtagcctttgatcctttgctattcaggtgtggggagatgggactttttcttttggtttagctgttggaagtttgccttaattggccttaggtttcctgcctccagaccttggtgttttttcttttaggaagtcagcacaaattggccttaagttctctgcctccataccccattctcctgcctcccttctgtacaaaccatttgttatacatagttcatcttaaactcacctggtaattggggaggccttctgtgtatgc

SEQ ID NO: 76561 - DNA, 517 bp, Homo sapiens
aaagaatgttggggccacacaagcagagaacaccatgtcttcagatctcttcacagccttgtcctccagagtttagaagtggagggaaaagattaaaggcaatcttcttgttttgctatttgtccttggacctaatctggacttaatttggacacacaggctaacgaaggccgtgagtgtgagttgtccaggtccttggcaacaaagaattgaacaaaatgcacaaagtaacaaaggaacaaaacagagggaggaagcatcaaaagcggaaatttattaagcagatgaaatccaaggccctggctccaggatcctgctctttcctgtggcgactcttgtgcagatttggcatagaaacaatatggaacttgttacacttctctggacaagtcattatgcttttggctcacaggctccacttccctggacaccccttcaccctaagcttcaagtaattcagcttcacccttcagagaagaactcagctgtcacttcttctaaggaccctccctagctg

SEQ ID NO: 76562 - DNA, 394 bp, Homo sapiens
agcatttggaaaacaccaggataaagcataccagtggtgtgaacaaggaacgagaattaagatctaaaacccaggagagaggaaaacaaatctcaaccacagcatctcttcttcagtacctatgtggtggtctttcttcctgcattctctgcttcctctgccactcttttacccacctcctagtacctgtagtctaacagtattgatgtcactcactttgtgactacagatttggactagaagtaatagaaaccacctatatttggaggttatctcatttttcatgtttccttactcaaaatctgtataaattatttggtaactcatttgctgggccattactttttgtttctctgtgtttggtataagtattaatactaacaaaatattgtat

SEQ ID NO: 76563 - DNA, 609 bp, Homo sapiens
aaaggtagacaatggctagattgtggagtggctggaatcacagagattagcattatttagttagcagagcaaatatgaaggtttggatcactgaagcacagggcaagaaggataatttcagactaataaattatttttggtctgtgtgcttgtttatttttcagtaggaatcagaagtttgtatatcctattgattatttatatacaccatctacccctcacttctgccttaatggcagggtcccaattttcttctggtatcaactcatttcccacatgactcacagggaaatgagcctatgctcagcccaaggttctgccacctttgtactctgggacttgcatcagtggcccccaggttctcaggccttcaaccttggacttggaattataccatcatctcccctgcttctcaggcctttggactcaaactgagctacaccaacagcttccctggttctccagcttgcagatgacctatcatgtgacttcttggccttcataatcacatgagccaattctactaagtcctctctcatacatctatgtatctatctatctatctatctatcctattgattgtgtttctctagggaaagctgactaata

SEQ ID NO: 76564 - DNA, 841 bp, Homo sapiens
attggagactattattctaagtgcagtaagtcaggaatggaaaaccaaacatcctatgttctcactgatatgtgggagctaagctgtgagaacacaatggcataagaatgatataatgggcttaggggactcgggggtaagagtgagagggggtgagggataaaagacaacatatatggtgcaatgtatactgctcaggtgatgggtgcaacaggatctcagaaatcactgctaaagaacttacttatgtaaccaaataccacctgtaacccaataacttatggaaaaataaaataataaataataagggttttggccatggaaagtaggagaaaaaggaaagtgcatctccaaaaggttaacagaaggctaaagatcaactttgtttatgtcatgcattttccgaaatcgggctccatctctcttttgcttaattgcacttagggtgtgggtgtattattttgggtgtaaaagagtctgggcatgtctgtatttaaaggaatattttttgtgtctacattcttttttttcccgctggggcgaggtggctcaggcctataatcccagcactttgggaggctgagacaggtggatcacttgaagtcaggagtttgagaccagcctggccaacatggcaaaaccctgtctctactaaaaatgcaaaattagctgggcatggtggccagtgcctgtaatcccagttactcacgaggctgaggcaggagaatcgcttgaaccctggaggcagaggttgcagtgagtcgagatcacaccactgcactccagcctgggtgacagaacaaaactctgtctcagaaaaaaaaaaaaaaaaaaagaaaga

SEQ ID NO: 76565 - DNA, 267 bp, Homo sapiens
aaaacaagggttatgtgaagggggtggggggagggggagtaattaatttttctttttgtttaaagtaggaaagccaaactacatctcccaaacacaccacttgacttgaaagagatacaaaagtcctttctcttaaaagtcatccatgtcgggcatgatggctcacgcgtgaaatcccagcacgttgggaggcggaggagggcggatcacgaggtcaggagatggagaccatcctggctaacatggtgaaaccccatctcccctaaa

SEQ ID NO: 76566 - DNA, 1257 bp, Homo sapiens
aagatttacccatgttgatatggctgtagtttattcattttcattgctgtaggttactatattgcattggtgtatcataatttattctactgctgatggacatataggctatttctagctttaggctattataagcaatgctgctgtgaaagtttgtgtaaacacacacacatatgtatgttctctttaagtacatatgtgtgtgtgtgtgtgaatgtatatatatatatatatatatgttctagagcatataaacacagatttctttggagtctttaccttggtatgtaattcctggtttgtagagcatgtatatattaatatattcagttttacaagatcgtgccaaaattttccaaaatgattgtaccaatttatataaccaacaacaatatacaaaagtttctgttgcactacatcctcaccaacacttgatattgtcagacattttaagttttattactgtaatgaatgtgtaatgctgttttattgtggctctattttgcatttccctgattgttaatgaagaatagcccctttttatatgagtgttgtctaatgtttagggtctttccccatttttctgttgggttgtttgtatttttcttactttttgtattaatctgttatataatgttgaaacaagttttattgattatatgtgctacaaatgtttttcccactttgtggcttgtactttcactgtcttaatgtcttttgatgaaaccaagttgtcagtggagtagaattcatcactcttcccttatgattaatgatatctgtatcctatttaagaaatattttccaaccctaagatcattaagacttttatattgtcttctaaaattttattgctttgctttttaaattttggtctaggcagacctgcaattaatgttcttacatatggagaaagggaggcatatatagatccccaaccccttccatgtggaaaattagactagcaccatttgttgaaagatggtcctctctgccctaccctgcagtgccatcttgatcatgaaccaagtagtcatataagtatggagttgtttctgaccttggtattctttccattagtctattatctttttttgtatgttgctggattcaatatactcacattttgtttaagatttcaggggatctcacaaataagactgacctgtaattttccttttggtaatgtctttctctgaatttggtatcaaattatgctagctaccttcattaaatgagttggggaatacactttct

SEQ ID NO: 76567 - DNA, 521 bp, Homo sapiens
aaccagcttaatcacatgattccgaatttaaaccgacttccctaaagggaaatttggccctcaaggccaagaattgggcacgagaaagacttttatattgtcttctaaaattttattgctttgctttttaaattttggtctaggcagacctgcaattaatgttcttacatatggagaaagggaggcatatatagatccccaaccccttccatgtggaaaattagactagcaccatttgttgaaagatggtcctctctgccctaccctgcagtgccatcttgatcatgaaccaagtagtcatataagtatggagttgtttctgaccttggtattctttccattagtctattatctttttttgtatgttgctggattcaatatactcacattttgtttaagatttcaggggatctcacaaataagactgacctgtaattttccttttggtaatgtctttctctgaatttggtatcaaattatgctagctaccttcattaaatgagttggggaatacactttct

SEQ ID NO: 76568 - DNA, 784 bp, Homo sapiens
caataaaatttcagttatgtgagaagaaaaagtcctagacctcctctgtacaacatcatgcatatagttaacaatactggggttgtacacttaatttaaaagggtaaaccttgggtgttatttatttattaccacaagaaagaaagaaggaaggaaagtgagcgtgcccttgatacttttctggggactgtaatgtaagcagaaattgagacaagggtccttggaactggctgatagttttttttcttcctaatttgcccaaataggacaaataggttgattggttcagagcatttctgcaattacactaaaatgcttggttctgggattgagtaggtgtgaccatcaaatgaataactctgtggagcagtcatttaacatttcaaaaagttataaaaatgtctgaaaatgcaattttaaaaaagcaaaaccaaatgagtccagagcagcactgtccggtagaactgtctgcagtggaagatggaaatgtctgcgctgtcctgtagagtacacgtggtcctatgtggctgccgagcatctgaaatgtggttaatgtggctaagaaactgtgtttttaactttatttaattttaattcatttaaatttagccatatgtggctgatgcttaccatgttggggaacgtaggtctagagactttagaaaagttagtatgagtgaagtaggaacttggtccttggacatttgggatttgaaagaaaggcggaggaaaggcattataatttgaccagaactctagcttatggtcttatcttaaaaaaaaa

SEQ ID NO: 76569 - DNA, 786 bp, Homo sapiens
acagaatgaaagaaagaaagtagataagtatataagatccttcaaagggctgatgggacgaagactgggtacgagaagctcctattgtaagtcggtgacatggctggggttttctctcagcaaatattgagcaaacactgactgtgccaggtgatgtgctgggtcccaaacccttcccagacccagccctggcactcacggagatccagctaggaagtccgggaaaaggtcatcggggaaataaacaaagtcaagcacagtggatgaacgcgctgctgccgctccccacacctcttgtggtggacatcacttacgcttcctcatggtgcatgtcacttatgcttcctggtgccctcccagatgacccccccttgggccactacacacagctgcacccggcaagagcagacaaggatggtctactcactgagcctgcaaggctggtgtgcaggacaggccagctacactccccaggtgtgtgcaagaccggggacgagtcagtcattgggaggtgaggtgctcgggcagtgtgggatggaggaggagggagggaaactgagtgtgggctcttcgtattggagaggaggggacggccatggcacaaagagccacccaaagcgccacccaaagagccgtgaggggaatactggttaccaaaaacgaagagcacccatggacttgctctctaaagcaacccatgattgtcgaacaaaaacggcattgtattgaccaaaaacaccagtatcagcattgacacctgcttctaatacaaaagaagcagatgac

SEQ ID NO: 76570 - DNA, 2255 bp, Homo sapiens
ctgtaaccatgaatacggtttcactgtcacgtcttgttataagaggaaccggctatgaccctcatttcagatggggtcccagtgccgttggtggttgcctgacgaaaagctgcacttaatagaaatcactgtggatgcaggagatggacggtgatgagctcaggaccagccagcaaccccatcaggcggtaatgcctaccatggtcacccatgacttcctctcgccactgctcggagctcctgcaaagccacaggcaacaacacatttctgctccgtacgagaagctcctattgtaagtcggtgacatggctggggttttctctcagcaaatattgagcaaacactgactgtgccaggtgatgtgctgggtcccaaacccttcccagacccagccctggcactcacggagatccagctaggaagtccgggaaaaggtcatcggggaaataaacaaagtcaagcacagtggatgaacgcgctgctgccgctccccacacctcttgtggtggacatcacttacgcttcctcatggtgcatgtcacttatgcttcctggtgccctcccagatgacccccccttgggccactacacacagctgcacccggcaagagcagacaaggatggtctactcactgagcctgcaaggctggtgtgcaggacaggccagctacactccccaggtgtgtgcaagaccggggacgagtcagtcattgggaggtgaggtgctcgggcagtgtgggatggaggaggagggagggaaactgagtgtgggctcttcgtattggagaggaggggacggccatggcacaaagactcagatgggaaagtgtgagaaagcagagatttcaaaggagctacggtggagacccacagaagaggaatgctgaggcttttctgtctgaaatgctgaatagactctagcacacgcaaaacagcccaccacagcgagctgcaggattcttccgggcttttaacagtggtcttgtaaaaaaaattagccgggcatggttgtcccagctactcaggaggcagagaggggaggatggcttgcgcccaggaggttgaggctgcagtgagccatgatcgcaccactgcactccagcctgggtgacagaatgagacccctgactcaaaaaaaaaaaaaaaaaaaaaaaaaaaagactggaacattcaaaacctgttgatgggctcaagaaattctcaagaaattctcttgcctcagcctcctgagtagctggaactacaggtgtgcaccaccacatgtggctaatttgtgtattttttgtagagacagggtcttaccatgttgcccagtctggccttgaactcctggactcaagggatccaatgacaggcgagagccaccatgcccagccacatttttgctaaattctttacactggtgaatctcaaagaattctctgatcatcacaccatatcctgctaagtgtgcaattaacctgtggacttcagttggacactttcagattagcattagctatgtggggccaccaaatgccaactgttaaattatcactcaaagataaatgacacttgagtgtgctgtttgagtttatacctctaaaaaatgcttatagtaccatgagactagtgtgccaacgtgtctggctgccaacgtgtctatagctgagccaataagaattagtctctagagcctctgtttccaaggaagtcaatctctagattcccacattggctgcatgatggaataagccaggggctacgaaaaatactgatgcctgttgaagcttggaggagctggggttggggtgtagggcagtgatgatcacatatgaatagaactgggagtctttagtgttactggtggcaatgttgaaatgcatgagggttgtttattgtataatgaagtatttttcacatgaagtcatatgaagtattccattccactgtatttgttcttattttaacgatacaactaggtaataaaggaaatgaagtattgttttatattttaaaaaaacacatatgcctggatctcacgccccagacattctgatttaactggtctagggtatggtctgggcatcaggactttttcaggctccaagtgattctaatgtgcaacaaggttgagaactattgctttagggccttcgtgttctttgagaatacaaagaaaattcagagagataggttaaaaacacacttgccattcctccattgctctgacatctatcagcaaataagctataacaggaaatacagggctttg

SEQ ID NO: 76571 - DNA, 398 bp, Homo sapiens
acgggggtgcagcggggctgaatggcactccaagctcgtggggctggggagtccacatctgcacccgccgcgtggctagcaccccctgagcgttttggtcaatttgccatcatcccacccctcagtgccgttggtggttgcctgacgaaaagctgcacttaatagaaatcactgtggatgcaggagatggacggtgatgagctcaggaccagccagcaaccccatcaggcggtaatgcctaccatggtcacccatgacttcctctcgccactgctcggagctcctgcaaagccacaggcaacaacacatttctgctccgtacgagaagctcctattgtaagtcggtgacatggctggggttttctctcagcaaatattgagcaaacactgactgtgcc

SEQ ID NO: 76572 - DNA, 2221 bp, Homo sapiens
  misc_feature (36)..(36): n is a, c, g, or t
ttgtcctcagggaagctggggctggtcaactttagnaagtggtcccagtgccgttggtggttgcctgacgaaaagctgcacttaatagaaatcactgtggatgcaggagatggacggtgatgagctcaggaccagccagcaaccccatcaggcggtaatgcctaccatggtcacccatgacttcctctcgccactgctcggagctcctgcaaagccacaggcaacaacacatttctgctccgtacgagaagctcctattgtaagtcggtgacatggctggggttttctctcagcaaatattgagcaaacactgactgtgccaggtgatgtgctgggtcccaaacccttcccagacccagccctggcactcacggagatccagctaggaagtccgggaaaaggtcatcggggaaataaacaaagtcaagcacagtggatgaacgcgctgctgccgctccccacacctcttgtggtggacatcacttacgcttcctcatggtgcatgtcacttatgcttcctggtgccctcccagatgacccccccttgggccactacacacagctgcacccggcaagagcagacaaggatggtctactcactgagcctgcaaggctggtgtgcaggacaggccagctacactccccaggtgtgtgcaagaccggggacgagtcagtcattgggaggtgaggtgctcgggcagtgtgggatggaggaggagggagggaaactgagtgtgggctcttcgtattggagaggaggggacggccatggcacaaagactcagatgggaaagtgtgagaaagcagagatttcaaaggagctacggtggagacccacagaagaggaatgctgaggcttttctgtctgaaatgctgaatagactctagcacacgcaaaacagcccaccacagcgagctgcaggattcttccgggcttttaacagtggtcttgtaaaaaaaattagccgggcatggttgtcccagctactcaggaggcagagaggggaggatggcttgcgcccaggaggttgaggctgcagtgagccatgatcgcaccactgcactccagcctgggtgacagaatgagacccctgactcaaaaaaaaaaaaaaaaaaaaaaaaaaaagactggaacattcaaaacctgttgatgggctcaagaaattctcaagaaattctcttgcctcagcctcctgagtagctggaactacaggtgtgcaccaccacatgtggctaatttgtgtattttttgtagagacagggtcttaccatgttgcccagtctggccttgaactcctggactcaagggatccaatgacaggcgagagccaccatgcccagccacatttttgctaaattctttacactggtgaatctcaaagaattctctgatcatcacaccatatcctgctaagtgtgcaattaacctgtggacttcagttggacactttcagattagcattagctatgtggggccaccaaatgccaactgttaaattatcactcaaagataaatgacacttgagtgtgctgtttgagtttatacctctaaaaaatgcttatagtaccatgagactagtgtgccaacgtgtctggctgccaacgtgtctatagctgagccaataagaattagtctctagagcctctgtttccaaggaagtcaatctctagattcccacattggctgcatgatggaataagccaggggctacgaaaaatactgatgcctgttgaagcttggaggagctggggttggggtgtagggcagtgatgatcacatatgaatagaactgggagtctttagtgttactggtggcaatgttgaaatgcatgagggttgtttattgtataatgaagtatttttcacatgaagtcatatgaagtattccattccactgtatttgttcttattttaacgatacaactaggtaataaaggaaatgaagtattgttttatattttaaaaaaacacatatgcctggatctcacgccccagacattctgatttaactggtctagggtatggtctgggcatcaggactttttcaggctccaagtgattctaatgtgcaacaaggttgagaactattgctttagggccttcgtgttctttgagaatacaaagaaaattcagagagataggttaaaaacacacttgccattcctccattgctctgacatctatcagcaaataagctataacaggaaatacagggctttg

SEQ ID NO: 76573 - DNA, 414 bp, Homo sapiens
caatcaacactgcctcatgagctactgctctcctgctctttgaaaagacaaatccttatttctttgtagtgatccagaaggcagtgggaagaatgacaggtgcttggttatcttcaatttaatctctacctttcaatggggctagtgcaagctagggccattttactgcacccaaaggaatttaagacatttctattatctctaaagaatccagattaacatgccttcttggtgggcagggagaccagctatgaattctaggatctcaattcaaatgcttttgaattcttcctgcttgttcagttaattacatatatgtcaccacaatcttgcttttttttttctatgcttctaattttctctgaaactataacattattttaggggttaataaatttgtaattggaaaaaatg

SEQ ID NO: 76574 - DNA, 466 bp, Homo sapiens
gtcttctctgttttgtgatgcttcctttgctggtggagaggcagggcagtccattagccatcagcactgcatttcattcttctgactctttccacagtacccaattgtggaatgagaagtagatcgtgatgcctagatccacattctctttctgctcctgactagctgtgtgtctggccacgtcacttaaccattctgagatgtaatgtactctgttgttgattaacggtggaaactcctgcctagtctgggattgttacctgcagattctctgtgatgagggtcagaggcacttgattgctttattggctggaatatgcctagttgtttcattctatctagtgttttcactcctactaaagcatctttcttctcaaacattcctaggttgtgcccatgtgttgactgaatgaagggactaggacaccattctaaaagacaccaaaaggctctttaaaaaaaaaca

SEQ ID NO: 76575 - DNA, 377 bp, Homo sapiens
actctcagcatagctataatgctatccatagagactgtagagttataatcgtgactactaaatttaagcagcatccttgcctggtgctgtatcatttttggacaccagagatatatttattcctgtctctagagagcgaaaaagcacctctctgtcagaatgactactttctactttaaaaatgtttttgatgataactcttgatggctttagataaagccatccttccaaaaggcctgaagcactctcagatggctccgttttgtcagccctttactgctctgggatgtggtctacccactgttaagctaatatttttgatcttcaatttggaaccttaattatgctgtacagcagtcgttgtacgtggatgcata

SEQ ID NO: 76576 - DNA, 389 bp, Homo sapiens
cacatcttcctgtcctcttctgagccctccaaactgttccatcctctgcttgttacccagttccaaagtcacttccacattttcaggtatctttacagcagtcccctgtgaccttggtaccaatttattgtattagccagttctcacattgttagaaggaaatacctgagactgggtaatatatgaaggaaagaggcttaatttactcacagttttgcatggctgggaaggctgcaggaaacttaaaatcatggtggaaggtgaaggggaagcaaggcaccttcttcacaaggtgacaggagagaggaagtgcaagcaagggcaacgccagatgcttataaaaccatcagatctcatgagaactcagtcactatcatgagaatagcatg

SEQ ID NO: 76577 - DNA, 850 bp, Homo sapiens
aggcaaagggattggcctcctgggcagaaaggggccaaaagggagggccctttggaggagcgtggctctggtgaggggtggaggtgagacccacacttatgctctgatgccttgcaactgatttcctccagatacaaacagggcagctgaatggggagatggcctcccccatcagaggcagttcccagccagcttccttggatggccacacaggaatcactccacacaccatccctgagaagcagaaccacagggaaacctcttgtccctctggaaactcagttacaatcagttcagcacttgaaggaaggatctcgaaacattacagcccgaagaacaagagggtgaaactgtggaggcctcagcatcttctacccagagtgtgcccaagctataccctggggcagccaccagcatcaagagcttcaggccagtagggagctaggggacctcttggtcccatttccttgataacatcagaaatctgaagaacaactctccagcaaggcacgggcttcaactgaagccctcttcccaagtcatactaaaacaagaactgaccccagctgcgggtgcttctctctgcccgcacatccctcttccagcctgctccatatgcagccccacacagtgggggttcctgttgggattgtgtgtctggggcaagtgaccttaccaccccaagcctccatttcctcagaagtcaaacagggatggggatgctgactttccggggtaagcgtgactctccgccctctctccagccccctggctctggagtggaaatctgggctcttctcgagctcagtcaataccagccatagatataacagggcactggggaaaagat

SEQ ID NO: 76578 - DNA, 436 bp, Homo sapiens
tactgactgaccctgggttcgattcccagccgagacgtttctgctccattccggcaggagctaccttcccgagccgcgctttgctcacctgtaggagagctagagggaaataagacagcccttcttaggatggtggagtggctagaaagaagcaatccacgccaaaggcttagctcagttcctagacttagtaaatgctcaataaatgtctgccattgttattattatttattatgcttccagctggcctggaaggagggttctggagccagaagggaccttggagagacctcggttaaatctctagcgccatctttatttttaggatggagtaacttgctcaggacctacatctaacattgtggaggggatgcggtttttaagtaggaattcttgactagacctctcagcaacccttcctctccgtgacagtggg

SEQ ID NO: 76579 - DNA, 388 bp, Homo sapiens
gcttacaggaaccaactctgagctgaagccactggccaggctcttgaatatgataagagaatcacagcatgcggctcagcacgtggctcaaggcggatgtcagccccgctggacaccatgctcccctcagccctgcatcttctttcaggctgtcccttctgcccggacaacgctctcccactcccctcccctcctcacccctagtcccttcacctaattaactcctgggcattcctcggggctctgtcttaatgtcacctcctctgagagccctccttgatgctccagattgggtcaagcatattatgaaccatcacaaggccatgcattcctcctgcagaacctgagctcaacagaaataaatcaaaacttcactcaccagggtatc

SEQ ID NO: 76580 - DNA, 1325 bp, Homo sapiens
tgcagatacgggctccaccacgctccaggacaccagcaaccagggtgtttgcagcctcacagcctggttttccacaagtctgccccatccctaaggccacacagctgaagctttggctctgctttcattccagggatgggcaggctggcattgggccacctgctgcccctggccccagattctctgggtggggggccatgtgatccatctggctggggcaatgccaggaccaccccacccatttcagtgtcctaattcttactttgttctgccattgtggcagtctggtggtaaatataaccttttgacagtttttgaactgcctggaacccaagatcctaaacattttttaaccgtatttgggttatcttttattttggtttttatccccaatggagaaaaatcaagatggaaaaaagttattttaaaatacacgatgggtggcagcagtggtggtagggaaaaacaaggtaaaaaaattttttaaaaaataaagtacaggatgaagtgaattgaaagatttgtttaatgcactcttcttcaaggatagtattcctgtgttcataaaatttgagaataaattggtctcgaattaaaaaaaaattttagaatgtcaagatcctaacttccaatttgagaacacgtaacgtgagtctctggattgggaatgacttatgtgatcccaaaccctcattttcacaaagaaggtggagccctagtagctctgaaattcaaatgaagccatgcctctgctgcctggtccagtgctgtgctaacccctcagcctgcccaggtacagctgggtctttgtccaccgagcagggagttccactgtgatatatgcatcccaccctcactggcaggccattgactacacctgcaaccagcctattctcacagccctttttgtggtgagcaggagagctggactctgagccccccagttgcctagagagagggtagagctggcctttaattaaggacttttttgctttttagagcgagcttccggggaagcatagcacagcaatagggccactttcctgccagagggggtgggtgccaaaggatgtgggtcttttgctcactggtttaccctcagcataccaggaaaaatagtcatcctgattcactgtttggtccaagtttttatcacacagtattgtgtgatgaaatcctttctgtagaatgatttaactggatgaaaataaccatgtttcttttttgtctttagaaatatgttactctggctgggcttggtggctcatgcctgtaatcccagcactttgggaggctgaggcgggtggatcacctgaggtcaggag

SEQ ID NO: 76581 - DNA, 1032 bp, Homo sapiens
gcccagaccacactgaccacaaatgacattgtcattagcaagctgacccagatcctttcatacctgaggcagggaacccgtaacaagaagcttaagaagaaggataaagggaagctggaagagaagaaacctcctgaggctgacatgaatatttttgaagacattggggattacgtaccctccacaaccaagacacctcgggacaaggagcgggagagatatcgggaacgggagcgtgatcgggaaagagacagagaccgtgaccgagagcgagagcgagaacgagatcgggaacgagagcgagagcgggaccgagagagagaagaggaaaagaagagacacagctactttgagaagccaaaagtagatgatgagcccatggacgttgacaaaggacctgggtctaccaaggagttgatcaagtccatcaatgaaaagtttgctgggtctgctggctgggaaggcacagaatcgctgaagaagccagaagacaaaaagcagctgggagatttctttggcatgtccaacagttatgcagagtgctacccagccacgatggatgacatggctgtggatagtgatgaggaggtggattatagcaaaatggaccagggtaacaagaaggggcccttaggccgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatggggttgaagtcaaaagaccaaaatactaatcactagttacaaccagagatgctccacaaggatatgctccccactgttttctttctacaatttccaaaggttgcaagatgtttttttgtggatgaatataaaattttattgtgtaattacttggttccattaaaattggttaacttgcaaaaagtcga

SEQ ID NO: 76582 - DNA, 306 bp, Homo sapiens
gagggtcccgtgggattcacgtggcgcttcaaggaaaccaatgacaaagcagagcttgatcgccagtggaagaagattagtgcaatcattgagaagaggaagaagatggaagctgatggggttgaagtcaaaagaccaaaatactaatcactagttacaaccagagatgctccacaaggatatgctccccactgttttctttctacaatttccaaaggttgcaagatgtttttttgtggatgaatataaaattttattgtgtaattacttggttccattaaaattggttaacttgcaaaaagtcga

SEQ ID NO: 76583 - DNA, 779 bp, Homo sapiens
ttcgagctcggtaccctcatcttgggcctgtgttatcctgcctctactgtttattagttttgtgaacttgccaagttctttcactgtttatgcctcagtttcctcatcaggaaaatggagagaaatatagttccctcttcatagattttatgagaattaagtgagatatgcatttagtgtacagaataatgcctgtcacatagtaagtatgtaataagcatttattattacttatcagggtatgatttatgaactgtggaacctgggattatgggagagtctggcttcaatcaagggctgaaattccatttccactgacatctcttccttccccatcccccgattctgtcctgcaacagggtaacaagaaggggcccttaggccgttgggactttgatacccaggaagaatacagcgagtatatgaacaacaaagaagctttgcccaaggctgcattccagtatggtatcaaaatgtctgaagggcggaaaaccaggcgcttcaaggaaaccaatgacaaagcagagcttgatcgccagtggaagaagattagtgcaatcattgagaagaggaagaagatggaagctgatggggttgaagtcaaaagaccaaaatactaatcactagttacaaccagagatgctccacaaggatatgctccccactgttttctttctacaatttccaaaggttgcaagatgtttttttgtggatgaatataaaattttattgtgtaattacttggttccattaaaattggttaacttgcaaaaagtcga

SEQ ID NO: 76584 - DNA, 815 bp, Homo sapiens
agtgttgtctttttcattacagccattctagtgggtgggaattggtatctcattgtggttttaatttccctggtgactaataatgttgaccatcttttcatgtgcttcatgacttctgttgagaaatgtctattcaagtccattgcctatttttttattggattgtcttttattattaagtccctgcaatgcaatgaattatgaaatttatattctctgaggaagctgaaacattgtcagataaatgatttgcaagtattttcttctctggattgtctcttcactttcatgatgatttcctttgaagaacgaacatttttaattttgaagtctaacgtgtttttttcttttattgcttgtttttgatgtcttatccattccctgacctaaaatcacaaagatttacacctgtatgttcttctgacggtgttgtagttttagctcttacattttggtctttgatcctttttgagttaatttttgtagattgtatgagttaggcatcctcatattcttggcacccttgttgaaaattagttgaccgtacacgtaacactctgggtctgcccttatgcagtatggtcttgattactgtagctttgcagtatggggtgtgtggatttattaatagcagatgggagtagaaccgcagccttgttaagcagggataatgggaaggaatcagtctatcctggatatagaataattcccctttatttgtgtctctttgaaatgcattgtcgtagccccagttatttctttgttcagactcccagtgattttaagtgctcttcaggtttgagaaagggctccaa

SEQ ID NO: 76585 - DNA, 825 bp, Homo sapiens
ttcgagaattgcttttctttttcgtgtttgtttttgatttaaaaaatcaatcatgtacccgattccaaagtcaaacctgtaacaagttacaaccaagtcagtctccttcgcatctctgttctctatcctctttcttcccccttttctatttgtttttggtttattttcccatgtttcttttcgcaaatacagcaagtgtgtatattgagtcaaatctcttcctcctttcttacacaaaattagcacattaaatatatagtactgcaccttactttttctctcactatgtcctagagattgctctacgcgttgtatggcgtttttcatagttattcactgtgtgtggataccacagtgtattcaactgtcacctgatgacagacatttgcattctttgcaatcctttgtaaatacaaacaatgctgcaatgtacatgtcattccacatattctccaaggtatagttaggacagatcccagaagtggaatttctgggtcaatgggcaagtgcatttttgctgattattatccagtttccttctgttgagttccattttgcattaccaccagcagtgtttgagaatgactgtttctccatagaactagaacttttacagtgaattttatcctaacttttcttcaatctccttttacttttactttctattttaaagaatataattcagatttctctagtggtcatgagtctgtgtgtagtgtgagaatctagagacaactgttctaaggcggcatgagaatgggcagctcagctcagagtttagacctcatctgtttccagtgccctgggggttttggggagtaactg

SEQ ID NO: 76586 - DNA, 1311 bp, Homo sapiens
gacgacgttcccacccactcctgagagcagagctggccgcagccatgaccccgcagcttctcctggcccttgtcctctgggccagctgcccgccctgcagtggaaggaaagggcccccagcagctctgacactgccccgggtgcaatgccgagcctctcggtacccgatcgccgtggattgctcctggaccctgccgcctgctccaaactccaccagccccgtgtccttcattgccacgtacaggctcggcatggctgcccggggccacagctggccctgcctgcagcagacgccaacgtccaccagctgcaccatcacggatgtccagctgttctccatggctccctacgtgctcaatgtcaccgccgtccacccctggggctccagcagcagcttcgtgcctttcataacagagcacatcatcaagcccgaccctccagaaggcgtgcgcctaagccccctcgctgagcgccagctacaggtgcagtgggagcctcccgggtcctggcccttcccagagatcttctcactgaagtactggatccgttacaagcgtcagggagctgcgcgcttccaccgggtggggcccattgaagccacgtccttcatcctcagggctgtgcggccccgagccaggtactacatccaagtggcggctcaggacctcacagactacggggaactgagtgactggagtctccccgccactgccacgatgagcctgggcaagtagcaagggcttcccgctgcctccagacagcacctgggtcctcgccaccctaagccccgggacacctgttggagggcggatgggatctgcctagcctgggctggagtccttgctttgctgctgctgagctgccgggcaacctcagatgaccgacttttccctttgagcctcagtttctctagctgagaaatggagatgtactactctctcctttacctttacctttaccacagtgcagggctgactgaactgtcactgtgagatattttttattgtttaattagaaaagaattgttgttgggctgggcgcagtggatcgcacctgtaatcccagtcactgggtagccgacgtgggagggtagcttgaggccaggagctcgaaaccagtccgggccacacagcaagaccccatctctaaaaaattaatataaatataaaataaattagccaggtgtgatgttgcgcgcccacagtcccaactacttgggaggctgaggtgggaggatcacttgagtccaggaggttaaggctgcagtgagctgtcgtcacaccactgccttcatgcctgggcaacagagca

SEQ ID NO: 76587 - DNA, 519 bp, Homo sapiens
tcccccgatctgactacgcggctcgatctgactacgcggctggagtccttgctttgctgctgctgagctgccgggcaacctcagatgaccgacttttccctttgagcctcagtttctctagctgagaaatggagatgtactactctctcctttacctttacctttaccacagtgcagggctgactgaactgtcactgtgagatattttttattgtttaattagaaaagaattgttgttgggctgggcgcagtggatcgcacctgtaatcccagtcactgggtagccgacgtgggagggtagcttgaggccaggagctcgaaaccagtccgggccacacagcaagaccccatctctaaaaaattaatataaatataaaataaattagccaggtgtgatgttgcgcgcccacagtcccaactacttgggaggctgaggtgggaggatcacttgagtccaggaggttaaggctgcagtgagctgtcgtcacaccactgccttcatgcctgggcaacagagca

SEQ ID NO: 76588 - DNA, 2424 bp, Homo sapiens
aacttaactaccattcatgacattgtttctttggggaaaaaacatacccatttccaaaacagctgaagcatagtcttctggatcctgcgcctctttgtgaagttggcctttgctggtggctctgccactggtttggaaatcagagatggtttttccatgcccatgatgaggacaaaggtgagtgtcccctgtctccacattgggaaaagaaacacacccatcccttagaaaggagagggaaatggtattgcggcctcactctcagatgagtaaaacctcctgagaatttaatgtgtgattgtttttataaatgtgacaagtcctggtgttagctcctggcctccaattgagcaaggtttcagtagcaggtaatcccctgttctttccctagctgtgtggggcgggaccatgtctttgctaccacctcttgctatattcctaccctttttttttttttttttttttgaggcaggtatttgctctgtcgcccaggctggagtgcagtggcatgatcatggctcattacagcctcagcctattgggcttaaaccatcctcccacctcagccacccaagtagctgggactacagatgcagaccaccaagcctggctagttcttaaaaatgttttgtggaaatgaggtctcactgtgttgtccaagctggtcttgaactcctgagctcaaaccatcctcctgcctcagcctcccaaagtgctaggatgacagccactgtgcccaaccatatccctaacttttaaaccttgctgtggctgagaacaaattaatgtagtttgaagtttaccaacagggaaaacaaaaggaaagaaagggatggggcagcagagcaggcagtgccatgactcagttccactcagatctcattctggatttgactggggtagaaaccagactttaggatgcccatgactcattgtctatggaaatagcattctcttagacttgtgcagtcagctacctgtggagctgtacgtagcagcccccataggcttgaaggacctttctgtagctgtctttggaggcagtgatactctcctcccaattgttacacacatttctgcataggagttgatacatgaaacaggaaactcaaatacattttgcaatgagttgagaagtaaatccaaaaccagatttagctgagagtcttttgttgcatgaagctgtgcacacaaaggcagtgaagaggtctagaataagacagctgtaggtttgcgtgttaattgcatgatgatctgactacgtgtgcacagggcctggcactcagcatcctacttggattatctcattcaatccttgataacactgtggagcagctcctgttggatgaagaaacaaagattcagagtagatgtcacccaaggttataccattggttggagggagagctggaacagtgaccagggatatccagctccagaaccctgaatcttaacctctgtggtatactcctgttcggtgggttgccctgagccaattgttctgctctctgagtcttgctcctcatctgtaagatggtcctcgggcggctgagtgtattgagagacagcctaggtatagatgcataccttcaggaaataggccatccttctagggccacagaaatgcccctgagaccttttttcctgtcatagcaccgtgctctgctttctgagaactgaaatttgcagggatagcctgcctacggaatttgtccacttgtttagtggggctggatggtggttgtcctatttacttaattcacttgatgggtttcagtcttttgaacctaaaaaaaataagaaaatgggatttgtttaatctcgttttccaacacaacagttcttaatctgctttcgaatgtttgtttgtgggctgaatacaattcagtgttaatctagtgacctagtattgcctggtgatgaaatctgtccctgccgttaggttcacttgtgtttctttgtgtttctctctctctgtctctctttctctctcgtacacacacacacacacacacacacacacacacacacacacacacacacacacacacacattttaaacttggtctttaaaatctcagtttttcctgcttaagacaagaagatccctgatgccaagatttctacctgaaaggtcagtttcagctttgtaacaactgggtaattgtctcctaaaataaaccagcatctcagggactgcaagcttgtcttctcagttatgtgaatgcaaatctcttctctcctaatgactaccctgcctatgccgtttcctgtgggcatgtgcagtcatctggaaatggcggctgccagttccacagctggggacgaccctggcttcttttctgtaatgaggatgtgtctgctcctgccattgccccactctttgtcctctgccttgtggtcaggagctgctctttgtgcttt

SEQ ID NO: 76589 - DNA, 1193 bp, Homo sapiens
cccccccccccagcatgtgactcaacagtcacctctgtagagcatcactaaagatggcttctcccagggccctgcccatcaattatcttttgagacaaatgcacatggattcttaggtaactcacaggggaatatatttgtatagaccaagattgggagaaagagccaggggagagctggaacagtgaccagggatatccagctccagaaccctgaatcttaacctctgtggtatactcctgttcggtgggttgccctgagccaattgttctgctctctgagtcttgctcctcatctgtaagatggtcctcgggcggctgagtgtattgagagacagcctaggtatagatgcataccttcaggaaataggccatccttctagggccacagaaatgcccctgagaccttttttcctgtcatagcaccgtgctctgctttctgagaactgaaatttgcagggatagcctgcctacggaatttgtccacttgtttagtggggctggatggtggttgtcctatttacttaattcacttgatgggtttcagtcttttgaacctaaaaaaaataagaaaatgggatttgtttaatctcgttttccaacacaacagttcttaatctgctttcgaatgtttgtttgtgggctgaatacaattcagtgttaatctagtgacctagtattgcctggtgatgaaatctgtccctgccgttaggttcacttgtgtttctttgtgtttctctctctctgtctctctttctctctcgtacacacacacacacacacacacacacacacacacacacacacacacacacacacacacattttaaacttggtctttaaaatctcagtttttcctgcttaagacaagaagatccctgatgccaagatttctacctgaaaggtcagtttcagctttgtaacaactgggtaattgtctcctaaaataaaccagcatctcagggactgcaagcttgtcttctcagttatgtgaatgcaaatctcttctctcctaatgactaccctgcctatgccgtttcctgtgggcatgtgcagtcatctggaaatggcggctgccagttccacagctggggacgaccctggcttcttttctgtaatgaggatgtgtctgctcctgccattgccccactctttgtcctctgccttgtggtcaggagctgctctttgtgcttt

SEQ ID NO: 76590 - DNA, 420 bp, Homo sapiens
gcactctcactcagtctgtatctactcctcctccccagcactcacaggatgaatttgacaacatattttattcctaagcattcaaaatctatcctaaaagaatagatattgttcttaaggtagccaagaagtgctaaacactgaggttctttttgctttcaaagatcccgggggcagggggtgaaccagaatcatctgcctctctctccacattggcaagacatcatgccccttttctcctgtgaactgttttttttttttcagggctgtgaattcttcctgtaattagacccccattctgtcatggtttgattttttaaaaatatacctgggctgcctctgcccttgggtagtaagaggagaagtcttaaaattttaaagcttaattagccagatcccatatcttttaaaaaaaaaaaa

SEQ ID NO: 76591 - DNA, 353 bp, Homo sapiens
caactacttggggaggctgaggtgggagaatcatttgagcctaggcgttcaaggctgcagtgagctatgattgtgccactgcactccagcctgggtgacagagcaacactccctctcaaaacaaaaaagagaaaagaaagaggcccttggactcccgtcctggctctgcccctaaccagcttcacaaacacaagaacacgccactcctgaacctggtctgtgaatcaagaaacagttgggatcagaccatgtggtctctaaatccccttgctccttattaagctctaaaaatgagaagtcttaaaattttaaagcttaattagccagatcccatatcttttaaaaaaaaaaaa

SEQ ID NO: 76592 - DNA, 661 bp, Homo sapiens
aaagagcagcctgcaagctgggagcttgcatgggtgaatgccgcagaaactgaggactagacattttcataatggtggctccatcttcccttctctgccagccgcgtgtatcctaaggagcagaccagatggggctgataactgaaaagcccatttgcataagattagggtaaggtgaccagccttccccatgtgccatgtaaatgtcatacctaattgaaccaatctgtgagccctacataaatcagacaccacctcctcatgccagactaaaacaatcggtgcattccctgccagctggtgtttttttcttctccatcctttccgcatggtcttttctgcttggagaacccttcctctatggaggaagctgttcctctttctcttctcttctacctattaaacctctgctcctaaattccacctgtgtctgtgtcctaaattttcttggcatgcgacaacgaacccctggcattattcaaaggcttctggactgaacccagcctctgacagtccgtccaggtgttggtaaaggatctccagctatcctgtcacaaaactttcctttcttttctatccatggtcattatgtctactatgctctccgtatatgcaatgtgcaggaatttttacaattcaggggaacagttctgttaggaaa

SEQ ID NO: 76593 - DNA, 501 bp, Homo sapiens
taaaaataatactaaccctcaaagttaaaacaaacaaaattccatcaaagcactctcaaaaaaaaagccatgttaccagtcatttattaggtctaaataatatgcctatattatcctccccaccttgaaaatagactctttaataaacacaagaggaaaaataaataggttaaccaggaaaaaggtcattgccttgtctgttgtaatacggtctgatcacccaagatgattgatttcttaaaagaatccatatccatgactcttatagacattctgccatcctgcagccatctacaaggtagcttatacttctaaggttattaaatccttgtggtcctcttaagaaatcaagaagttcagtagcctcactttttttgtaaaataaattttctcagtctccctttttaaaataaaagctgtaaaatggaagtgttaaatcagtatacttgaacaataccacctagttttgcatatcttcaataccattagctccattctgga

SEQ ID NO: 76594 - DNA, 395 bp, Homo sapiens
gaacaaacaatctgttgtgactgcagaagcaatgtaagagaaaaacaaatttttagggttaaaaaggaagaatgtggccaggcgcaatcactcatgtctgtaatcccaacacttagggatggtgaggtgggaggatcacttgagcctagaagttcaagaccagcctgagcagtgcagttagacactccaccatctctacaaaacaaaacaaaaaatatatatatttgggtgtggtggtgtttacttgtattcccagctattttggatgctgaggcagacagattacttgagcctggaggtctaggcttcactgagcagttcactttaccactgcactcttgcctgggtgtcactccagataggtgacagtgtctcaaagaaaaaaaaaaaaaaaa

SEQ ID NO: 76595 - DNA, 429 bp, Homo sapiens
aagtaacaaatatgtacatagcaatatgaagtgtggagagcaccccgtcatgtcatatttcttttttgcagtaaacagttctataacaggcagttagattttcttgttttgtctgttttggacatagacattttgacataagctacatgagattagaaacatttacatttttgaatttcattcatcagaatgaacattttcattgatgatgactctttaaaatgaaaggcaatttttcaaaataactattctatcacaactttaaggaatgtcatattaaactatatagtagtatatgtacattttttctgttaagttttaaagtacttcctctgagattttgctttaaaggtagaaaatattggccgggcgccgtggctcccgcctgtaatcccagcactttgggaggccaaggcaggaggattgctt

SEQ ID NO: 76596 - DNA, 691 bp, Homo sapiens
  misc_feature (3)..(3): n is a, c, g, or t
  misc_feature (5)..(8): n is a, c, g, or t
acngnnnnatcacttgaagctgggaggcggagcttgcagtgagccgagatcgcgccactgcactccaccctgggcgacagagcaagactctgtctcaaaacaaaacaaagcaaattagctgcttgtaatgtgtacatttcctgaaagtacttttgaataatatacatctaaaatgtcaaggttcattggtggaaaacaacaaatcatgaagctactaaaaaattatgtgagaaggcccgtcgggcaagtgaggaacgcctctgccggccgccgccctgtctgggaagtgaggagttcctctgcccggccgtccaactgactgggatgtgaggagcgcctctgacccgccgctgcccggtctgggaagtgagcagcgcctctgcccggccgccaccctgtctgcgaagtgagcagcgcctctgcccgccccaccccctcaccgtctgggatgttaggagcacctctgcccgcccgccgccccatctggaatgtgaggagcgactctgccaagctgccgccctgtgtggcaagtgaggagcacctctgcccggccgccgccctgtctgggaagtgaggagcgcctctgctcggccgctgtgcaaccctccaagtgtgaggtgacagccttgtgtgtgatctttctgctctccccaagtttgcattttcgacattaaagtttactttttaatta

SEQ ID NO: 76597 - DNA, 1083 bp, Homo sapiens
accactgggcaggcagaatttgtttgagggatagaacgacaacaaaataaatgttcctgcagcctgagatttcaggtagagtactgactaaggtttaataagacaataggtgacctgaggacatgcaagcttgtaaaatgcaacagcctcctgctagagtgacttgtacatgagcttgcttgcagaagactagattagatgtttctcaggatcccctcctgcgcaggggttctctgattttcgtgttctctgcccagatgggctgggggagttgagagtgtgcttattttcactgcgatcatgagaccacagttctgggttatctcctctcatacatcaagccccagaggaggcggcaagaggaacagccacaaacaagtactttaccccacagcttagtggccagtaaacaccctggggactaggaaaaggaaccaactgtaggcacctctccagggcctagggagacaagtgtcctctcttctgcatacatttgggctccccttacagagccctttgccctggctctctggtccttgttgctctaacagtccagatgtacacccagcctcagggggaaggcagctctctccagacagagtctcagggcccagcaaggtcaggttatctgctttcattcagggcaacaaatgatacaaatggtgccagggagtggcaaggccatgggggtaggtgggggtgtctttttcttttcataaagtaacaacagacgagactgaggttaaacatcagaaaaaaacctctggaatgaccttcctcattccaggaggccctggaataaggaagaggcttctttctgagggagctttgaggaattttgacagctgttgacatgggatttgggaaaggtgaagctgtgactggaggggcaggagatggtccaagtgtccatccagagatgagactcttagaatcaaagtgttcagcccaggaagtcttggagatcccaccttctgtggccctgcaccttatgggaagccattaagggggctcatctaggaattctggttacagcccagtgctcatcccagcgtatgctgcctctttagggcagccccaagg

SEQ ID NO: 76598 - DNA, 669 bp, Homo sapiens
ggaagccggggctggtctactggtctgtaggcacctctccagggcctagggagacaagtgtcctctcttctgcatacatttgggctccccttacagagccctttgccctggctctctggtccttgttgctctaacagtccagatgtacacccagcctcagggggaaggcagctctctccagacagagtctcagggcccagcaaggtcaggttatctgctttcattcagggcaacaaatgatacaaatggtgccagggagtggcaaggccatgggggtaggtgggggtgtctttttcttttcataaagtaacaacagacgagactgaggttaaacatcagaaaaaaacctctggaatgaccttcctcattccaggaggccctggaataaggaagaggcttctttctgagggagctttgaggaattttgacagctgttgacatgggatttgggaaaggtgaagctgtgactggaggggcaggagatggtccaagtgtccatccagagatgagactcttagaatcaaagtgttcagcccaggaagtcttggagatcccaccttctgtggccctgcaccttatgggaagccattaagggggctcatctaggaattctggttacagcccagtgctcatcccagcgtatgctgcctctttagggcagccccaagg

SEQ ID NO: 76599 - DNA, 641 bp, Homo sapiens
catggtgaaacccccatctctactaaaaatacaaaaattagccaggcgtggtggtgggcacctgaaatccctactcaggaggctgaggcagagaatcgcttgaacctgggaggcagaggttgcagtgagccgagatcgtgccactgcacttcagcctgggtgacagagcgagactccatctcaaaacaaaacaagcaaacaaacaacaacaacaaaaaacacctcttgacttctaaagacgcaaaagtggccaaaagtgcaatacagtattgtgtttatttacatctattttaaatgcatgtgtatctgtaaatacaaagtgattcgtgactcattgtctcctcagtctatagcattattaacttctaggagcagcagtggagtagagtgtactgaatggtcacagactcatcgattatcagatctggaaaggagcttagagaagatctgttccaggctcctattttatagaagggaaggttgacatccaaagaatggaaggaaatctcctaattattctgagagtatcacagtgatggagccaggactaggtcctggatcacctctaagaagacacttagctatttgactatcgactagggcctagcattattaagcactagataaatacagatgaaaaa

SEQ ID NO: 76600 - DNA, 843 bp, Homo sapiens
tttatatctgtgttctccgtagtgactggcaggggatcttgcatctaaagtaactaaaataaaattaagttaatcagatacattttgtgaaggtttagatctcttggctggaaaaatgttaaacaagagacagtaatcaaaggagatttggaaatgggtgcatttagagagaaaaatgtgttcttaaaaagcagtgactaaattcggtctcctgattttttcatttcaatagatctttttaaagaaaaccaagtgttgaatttctctgtcagtgaagactttgtgctgagttttcatgatgggttttctgtgagcagagagtcctcatcagccttcccacttccctgaaaccccccaaaactctaaatttttgccagcaaacacattaactgttctttcattctgacaaagcaaatcctccagaattttgcagtagaaatatcagccacttcgtggatgatggctttttcgccctgaaatctcctatggctttctaagtgaatgggtgtcatctgaattaatgatggcgctgttaggttttattgattagttaataaatgctggggaggggaatcctgggtgataggtatttgctccttcctatatttgctggagagaaactaaacccaaaatgaaggatgctttgtgccagttgtgttaaagtgactgtgtccgtgggatcccactatgactgtcccaaggtaataaaaatatcagggcttgggccaggtgcagtggctcatgcctgtgatcccaaaactttgggaggctgaggcaggaggatcacgaggtcaggtgatcgagaccatactggccagcatggtgaaacttcatctctattaa

SEQ ID NO: 76601 - DNA, 296 bp, Homo sapiens
atcccagggaagccttccaatattgctgctggctgggagtaagtggtcacctggctggaggagacgcacatgtgttaggccaagagtgagcctgcgtgaccatgcactgagtggacagtggccgctgtgctggggcagttgaagatggggccattcctgagtaagtccggtcccaaacccatcctccccggtgggaaagggccagggaggcaagggtcacgcccagcagcctacagggaggggttcagccccagaagagccttgccccatcccaccccacctggcctcccactaca

SEQ ID NO: 76602 - DNA, 409 bp, Homo sapiens
gatggatgttaagggttacttatgccctctccacccccaacaatatgttaaagttcatcagaatgtgatcttatttggaagtagggccgttgcagatgtaatgagttaaggtcatgctggagtagggcgggcccctaatccactgagactggtgtcgttgtaagagaagagacacagaagagacgcacagggagaaccacctgtggtgatggcggcagggatcagctgatgcatttccaaggccaggagtgccaagcactgccagcagggaccagaagctaggaacgggcagggaataattcctccttcagagcctccaaaaaggaactaaccctccagacaccttgattttggacttaatagcttccagagctgtaagtgaataaatttctgttgccacccagtttat

SEQ ID NO: 76603 - DNA, 686 bp, Homo sapiens
ctttctctatttctctttctcttaataatttaatcttttaaaagttatctcacatggcaaagctttggctttacaaagcgaacaaaaaaaacttccccatgaaaagtatcctgattcattaccactttttttcattttttcctgtttttcagtgcgtttgacatatgcgtcattgtcgtagtagcacgtgtataattttaagtcctgtttttcacgtagcctcctattagcacttaccgtcttgcccctgagccttcgtagctgtcatttttgatgtctacataatattctttgattgagtaccccatgattcattttcttttctcctgcttttggccactttggttgtttccaatttgtgccattataaataacactgcaattaacggcttttatttcctcagatacatttgcatctgttttatgaattaaaagcagctgaactgacttctgtgtcattcctgtttgaacaaaaatggaatgtcctggtttcgtaacgggacaatctaaatttagcctcactgacagagctgtgcgacaaggggaacggcagagtagaggtcgtagagcatttcagaaaaagtctatttagttcatttgtcccactttgaggagaagacgaagtcttgtgttgctccaaagtgagcgcaagattggtaactttacccttgacaggagtttttaaa

SEQ ID NO: 76604 - DNA, 424 bp, Homo sapiens
  misc_feature (415)..(415): n is a, c, g, or t
acaccctgtctagtccctgcagggcattaaaacccaagccttagtgtgactaggtcttgtctccacctctccacactgcccacagctgctgagtatcagttccttggctcactattccaaactcctcggtcctttcttcatttctaactcctatggacttcccccgctcctccccacacgtgttgttttgtttgttggttggttggatttttgggacagaatcacttgaacccgggaggtagaggttgcagtgaactaagatcaagccactgcacatccggcctgggtgacagagcaaagacactgtctcatacaaaaaaaggtggctttggttttttgagcccaagcactctcctttagcttgtgtcttctcacagtcccccttgaggagaagctctgaaacaggaacatttgngaaaggctt

SEQ ID NO: 76605 - DNA, 381 bp, Homo sapiens
  misc_feature (325)..(325): n is a, c, g, or t
  misc_feature (360)..(360): n is a, c, g, or t
  misc_feature (369)..(369): n is a, c, g, or t
ggccttcaaattacaaaaagcaatttacattatagtaatagttcatgtttatagtacaggaacaagaatgagttaaactaaatattccaaatcagtacaagttatttccttttttttttttttttgagacagagtctcactgtcacccaggctgtcttgctttgtcatccaggctgcagtgcagtggagtggtcacaactcactgcaacttcagcctcctgggctcaagcaagcctcccacctcagtagcctcccactcctgattagctgggactacagtgaatgtgtcgccatgcccagcctagtggtatttttaacagataantaagaatggaggtagtggcagaggtggagtgagangagagacangtaaaatatagg

SEQ ID NO: 76606 - DNA, 328 bp, Homo sapiens
tagagtttcaatatcaataaatactttatttttgattctaaagtaatgaatctaaatgttaccaaataaaaacaatagcattgcccaccaaaagcataagcaacaagaggaaaaatacataaactgtacgtaatcaaaatttaaaactttggggtttcaaaagagaccatcaagaatgtgaaatggcaaaccacagaatgtgagaagatttttgcaaattatatatctgataaaggacttgtttatagaatatataaagaaccattacaacccagtaataaagaaaacctgattaaatatggacaaacatctgagtagacatttccgc

SEQ ID NO: 76607 - DNA, 411 bp, Homo sapiens
  misc_feature (1)..(1): n is a, c, g, or t
ncgagagcaacagtttacttaatacggtaatggactagtgcagtttttgtagacagtgggcttctgatacaaagtcttgtttaaacacagacacacacacacacaaacacacacacacaccctaaagtgtgggtttcctgttctaatgatttgttgaatattatattattattattattattattattattgttattgttattagtaatgtttggttctggattctacttgttactgagtttaaattactggcggttcaggttacttttccacacttaccaacgatgcaatgtaactggctagcttatatatatatatatatatatatatatatatatattttttttttttttttttttttttacttatttttttctgatattcttacaccagatatgtacgaaaatgatc

SEQ ID NO: 76608 - DNA, 307 bp, Homo sapiens
ttcagcaagggtttctgtatctgtgcattgaggattaaattattcacatggtcagagaagcccatcaccactgatagttattgtaggtatggaaaactaacgactaagaagggagaaaaatataccaagcagttggcttggctgaacacaagtaaagactcttacagtcactggtgtgaactgcttattatcaatgtctgattacagtgctgcatactaatgattatgcatgtcattaaatgtgtcagattaactttgttataaaatttatgacaacattaaattttattcacatgaaaagccttca

SEQ ID NO: 76609 - DNA, 331 bp, Homo sapiens
tgagaatcaaaatgaaagaacctcaaagagaaataaaaactcaaaggaagaatctgagttctttaaacaacaccagagcaatcctgtcctaaaactggaggattttcaggttttgcaatgtgacaaacttggaaaagatacatctgacactaaatcctttggcaattttattccacctcggggcttcaactaccccattctcagtatctccatcttaaccttgatgacttctcaagatattaaatatttccatctgcctaatgacaaaaatcactcatctcaataaaaagctgtatttattagcatcttcttcctcaaatcagtttgtcct

SEQ ID NO: 76610 - DNA, 250 bp, Homo sapiens
ctgttcaatgtgtaaggaattttaaatagaaatggaaattcataaagacaagggccaagatgaccttttcaaatcagaatgtttaaggttgtgttaaaggcagctcctctcccccttttaggcactcttccttcccaaggatactgaagatatattttgagtgagaggatgcatgatgctccctgactcttggcctactccctttatcctacagaatagagctcattattcacgtaggtcaaggttgcta

SEQ ID NO: 76611 - DNA, 402 bp, Homo sapiens
tccacagaaaatttcaagtctatttccactttagggcttatacacttctatcttttcttcctggaatgcacttcctttgattcatctcgtgagtctttccaccagctcatcccagtatctgttcaaatgtcttcccttagagataatgttcctaaacaccctatttaataacaaacccaaatgctttttagcacttaagcctgatttatttttcttcacaatatgtgtctgttagcttttcctatcctatccatgatattacattgtactgtgatatattcctatatttattactctgtctaactctgtagcatatcatacgaactatgtcttgtatctccaattacaacgaagtgtctggcatacaagtggtagtcaataaatatttactgcatgactaag

SEQ ID NO: 76612 - DNA, 2908 bp, Homo sapiens
ttttttcttgctctgtcacccaggctggagtgcaatgttgcgatctccgctcaccgcagcctccacctccacctcctgggttcaagcaattcttctgcctcagcctcccgagtagctgggattacaggcgtgtgccaccacgctcagctaatttttgtaattttttttttagtagagacgaagcttcaccatgttggccaggctggtctcggactcttgacctcaagtgacccacccgccttggcctcccaaagtgttgggattacaggcgtgagccaccgtgcccagcccgggaccttttttcttaaagaagaaattatactgtatgtgtgtatgtgtgtagagagtgtggtgaggcttaaagacaatgggcttcaaagtctgccagaagggccccagtcaagttattcagcctcagtttgctcacctgtaattgggaataattatgtgtgatggtgttatgtaaacacctggcacagtgcctggccttctcctttacctgcttttcttcctgctccttatcattgagctttgaaagactatggtaaatgtttccctagtaatatgactaagtacttactggggtttgacgggggaaagaatatgactattttatccagtactgactttatgcagaagattttaagggtggggtcactgacattggtccaagggaggaaatgtacagtgttaagggggctgagcgagttttagccaaaactctgaaaaacgtgacagatgctaagcatttaatgccacgtaagctaaataatgtagggccagctgccgttgaagcacaaactaagataagctaataattagttgtactaggatttatacctcatacagacagtagttgatgtattcaagaatgcattctccgtgatggaggttttcttggttcctggctcataattcttagggaagtctgcgttctgctgatcacgatcactttattgtcctacccagtatcactgatatgtactttgttaaataaaaatacaaataacctgaagaggtattatttgaaagctgtgtaactccatggtatggctagtgtgataattgtcttctgataatgcatatgtagtgaattatggccgaggttagtttccagtactggttataagtaagttaaatttctgaaatgttttgggcactgttcagtaacctttggagtagcttgcagtgtctttactgctttcaagtgctgatgtggaggaatcattagtgttgggcagggaaacaggagctgtcagactgagagggccagggatgttcattgtggagattaaatgttctgagtaagtgagtttgtagacattttcttgtaagaaaatgttccatgctttactctgttttggacattttcttttgaaaaattttgagatagaaaccttaatatcatttcatatatttacagcatatagttaatttgagtagagtcaaattaatcttactttagaatttgattactaagtattagcatggataataatgcttcttttgcttaaatgtaaaaattaggccgttttactaggtgtactttgtcttaatcatattcctatttttttatacagctgtgcaaccatattgcttctgggaaaaaatgtcaatatgtgggaaactgttcctttgctcatagtcctgaggaaagagaagtttggacttacatgaaggagaatgggatacaagatatggagcaattttacgaactatggctcaagagtcaaaaaaatgaaaaaagtgaagacatagccagtcagtcaaacaaggaaaatggaaaacaaattcacatgccaacagattatgctgaagttacagtggactttcactgctggatgtgtgggaaaaactgcaacagtgagaagcagtggcagggccacatctcctccgagaagcacaaagagaaggttttccacaccgaggacgaccagtactgctggcagcaccgcttcccaacaggctatttcagtatttgtgataggtatatgaatggcacctgcccagaaggaaacagctgtaaatttgcacatggaaatgccgaacttcatgaatgggaagaaagaagagatgccctaaagatgaagctcaacaaagcacgaaaagatcacttaattggcccaaatgataatgactttggaaaatatagttttttgtttaaagatttaaactaatatgctggcttttatgtatgatacctaatcagagcattgaccagaaaaattgaaagtgttctgaggcacatagcagaggagctgcagatttcctgcttgtattggcgtatatcgttcctcctgagcagcaacccacagtaggtaggaaaatgggctgtttcacaggcctggccacgctctcacggaaccactggcatcagatggtgaagtgactgctacccggttgccatctgttgaacagacttttggatgaagtgtgttggggaagaggataaggttatatctaggacaactctttgagttggtccttcatataagaatcgtgacggtaagagaataaacacttgtactgggatcagaatacatgatggatgaaattctttacatgttttagcagaatgaatttgtttaatataataaagtttgctacttatctgtatgtaggttgctaaaaaggattttcttaactcagattttaagccaaataaccatttaacactagtatttgttaaatggggtatttttctgtatttgtatgtttcactataataagggaattaaggataatgtgcattgagaatattttgaaaaataattgactcaaattttatttcttggtcttttgctgtttaaatgatgattttgaaagattaaacctgtactgttggtattgtgttagtgtatggaccaatactgcctgtaataaagattttatatatagatgcctttca

SEQ ID NO: 76613 - DNA, 495 bp, Homo sapiens
cagtcacgtatctagaaagcacgagtgccttgattactcatgatagacctcagccacgcgtgcactgttcccagcaggcttgacgcgcaatcaggttccttgaacattctcaggcactgataaagctgcttaggtagttgctcaaaaacatggataataatgcttcttttgcttaaatgtaaaaattaggccgttttactaggtgtactttgtcttaatcatattcctatttttttatacagctgtgcaaccatattgcttctgggaaaaaatgtcaatatgtgggaaactgttcctttgctcatagtcctgaggaaagagaagtttggacttacatgaaggagaatgggagtaagttaatcttttagctgtgtccttgagctagcttgcctgaaagttcttttcctctctataaatatgccagcttcctgtgaacacagaaagcagtttgcattctaaacggttgccccgtttcatcagtagctctgttggcga

SEQ ID NO: 76614 - DNA, 3539 bp, Homo sapiens
gtatatttgcgtgctctcgtgagaaatctttttaatgaaggaaatgacgtttatcgggaacatgattggaacaactcgataagccagtacacggaagccttgaatatagctgattatgcaaaatctgaagaaattttaatccccaaagaaataattgaaaaactatatataaatcgtattgcctgctattctaatatgggtttccatgataaagttttggaggactgcaatatagtcctcagtttaaatgccagtaactgcaaagctctgtatcggaaatctaaggctttaagtgatttaggaagatacaaaaaggcttacgatgctgtagcaaagtgctccttagcagtgcctcaggatgagcatgtaataaaactaactcaagaactagctcagaaattgggatttaaaataagaaaagcgtatgtcagagctgagctctcattaaaatcagttcctggggatggggctaccaaggctttgaaccattctgtggaagatattgagccagatttattaactccaaggcaagaagcagttcctgttgtctctttaccggcacccagtttttctcatgaagttggaagtgagctggcctcagttcctgttatgcccttaacttctattttgccactacaagtggaagagagcgctctgccatctgcagtgctggcaaatggaggaaagatgcccttcactatgccagaagcttttctagatgatggagatatggtccttggagatgaactagatgacctgcttgattctgcacctgaaactaatgaaactgttatgccgtcagctttagtcagaggaccccttcagacagccagtgtctctcctagcatgcccttttcggcatcgctgttaggaaccttacccattggtgcgaggtatgctcctccaccctccttctcagaattttatccacctttgacttcatccttagaagatttttgttcttctttaaattcattttcaatgagtgaatccaaacgagatctgtccacctcaacttctagagagggaacaccgcttaacaacagtaattcttcccttttacttatgaatggaccaggtagtttgtttgcttcagagaatttcctgggaatttcaagtcagcctagaaatgactttggaaacttttttggaagtgcagttaccaaaccatcttcatcagtgactccaagacatcccctcgaaggaacccatgaattgagacaagcttgccagatctgttttgtaaaatcaggccctaagttaatggatttcacttaccatgctaacatagatcataagtgtaagaaagatattttaatcggtaggataaagaatgttgaagataaatcatggaaaaaaatacgtccaagaccaacaaaaacaaattatgaaggaccatattatatatgtaaagatgttgctgctgaggaggaatgtagatattcaggccactgcacgtttgcttattgccaagaggagatagatgtgtggacactggagcggaaaggagcattcagccgggaggctttctttggcggcaatggaaagattaaccttactgtgttcaaacttctccaggagcatcttggggaatttatattcctttgtgagaaatgttttgatcataagcctagaatgataagtaaaagaaataaagataattctactgcttgttctcacccggttacaaagcatgagtttgaagacaataagtgccttgtccacattttgcgagagacaacagtaaaatactccaaaatacgttcttttcatggtcagtgtcagcttgatttatgtcgacatgaagttcggtatggctgtttaagggaagatgagtgcttttatgcccatagtcttgtggaactgaaagtctggataatgcaaaatgaaacaggtatctcacatgatgctattgctcaagagtctaaacgatattggcagaatttggaagcaaatgtacctggagcgcaggtacttggtaatcaaataatgcctggatttcttaatatgaagataaagtttgtgtgcgcccagtgtctgagaaacggtcaagtcattgaaccagacaaaaacagaaaatattgtagtgcaaaagcaaggcattcgtggaccaaagaccggcgtgcgatgagagtgatgtctattgaacgtaagaagtggatgaacatccgtcctctccccacaaagaaacaaatgcctttacagtttgatctgtgcaaccatattgcttctgggaaaaaatgtcaatatgtgggaaactgttcctttgctcatagtcctgaggaaagagaagtttggacttacatgaaggagaatgggatacaagatatggagcaattttacgaactatggctcaagagtcaaaaaaatgaaaaaagtgaagacatagccagtcagtcaaacaaggaaaatggaaaacaaattcacatgccaacagattatgctgaagttacagtggactttcactgctggatgtgtgggaaaaactgcaacagtgagaagcagtggcagggccacatctcctccgagaagcacaaagagaaggttttccacaccgaggacgaccagtactgctggcagcaccgcttcccaacaggctatttcagtatttgtgataggtatatgaatggcacctgcccagaaggaaacagctgtaaatttgcacatggaaatgccgaacttcatgaatgggaagaaagaagagatgccctaaagatgaagctcaacaaagcacgaaaagatcacttaattggcccaaatgataatgactttggaaaatatagttttttgtttaaagatttaaactaatatgctggcttttatgtatgatacctaatcagagcattgaccagaaaaattgaaagtgttctgaggcacatagcagaggagctgcagatttcctgcttgtattggcgtatatcgttcctcctgagcagcaacccacagtaggtaggaaaatgggctgtttcacaggcctggccacgctctcacggaaccactggcatcagatggtgaagtgactgctacccggttgccatctgttgaacagacttttggatgaagtgtgttggggaagaggataaggttatatctaggacaactctttgagttggtccttcatataagaatcgtgacggtaagagaataaacacttgtactgggatcagaatacatgatggatgaaattctttacatgttttagcagaatgaatttgtttaatataataaagtttgctacttatctgtatgtaggttgctaaaaaggattttcttaactcagattttaagccaaataaccatttaacactagtatttgttaaatggggtatttttctgtatttgtatgtttcactataataagggaattaaggataatgtgcattgagaatattttgaaaaataattgactcaaattttatttcttggtcttttgctgtttaaatgatgattttgaaagattaaacctgtactgttggtattgtgttagtgtatggaccaatactgcctgtaataaagattttatatatagatgcctttca

SEQ ID NO: 76615 - DNA, 3477 bp, Homo sapiens
gtatatttgcgtgctctcgtgagaaatctttttaatgaaggaaatgacgtttatcgggaacatgattggaacaactcgataagccagtacacggaagccttgaatatagctgattatgcaaaatctgaagaaattttaatccccaaagaaataattgaaaaactatatataaatcgtattgcctgctattctaatatgggtttccatgataaagttttggaggactgcaatatagtcctcagtttaaatgccagtaactgcaaagctctgtatcggaaatctaaggctttaagtgatttaggaagatacaaaaaggcttacgatgctgtagcaaagtgctccttagcagtgcctcaggatgagcatgtaataaaactaactcaagaactagctcagaaattgggatttaaaataagaaaagcgtatgtcagagctgagctctcattaaaatcagttcctggggatggggctaccaaggctttgaaccattctgtggaagatattgagccagatttattaactccaaggcaagaagcagttcctgttgtctctttaccggcacccagtttttctcatgaagttggaagtgagctggcctcagttcctgttatgcccttaacttctattttgccactacaagtggaagagagcgctctgccatctgcagtgctggcaaatggaggaaagatgcccttcactatgccagaagcttttctagatgatggagatatggtccttggagatgaactagatgacctgcttgattctgcacctgaaactaatgaaactgttatgccgtcagctttagtcagaggaccccttcagacagccagtgtctctcctagcatgcccttttcggcatcgctgttaggaaccttacccattggtgcgaggtatgctcctccaccctccttctcagaattttatccacctttgacttcatccttagaagatttttgttcttctttaaattcattttcaatgagtgaatccaaacgagatctgtccacctcaacttctagagagggaacaccgcttaacaacagtaattcttcccttttacttatgaatggaccaggtagtttgtttgcttcagagaatttcctgggaatttcaagtcagcctagaaatgactttggaaacttttttggaagtgcagttaccaaaccatcttcatcagtgactccaagacatcccctcgaaggaacccatgaattgagacaagcttgccagatctgttttgtaaaatcaggccctaagttaatggatttcacttaccatgctaacatagatcataagtgtaagaaagatattttaatcggtaggataaagaatgttgaagataaatcatggaaaaaaatacgtccaagaccaacaaaaacaaattatgaaggaccatattatatatgtaaagatgttgctgctgaggaggaatgtagatattcaggccactgcacgtttgcttattgccaagaggagatagatgtgtggacactggagcggaaaggagcattcagccgggaggctttctttggcggcaatggaaagattaaccttactgtgttcaaacttctccaggagcatcttggggaatttatattcctttgtgagaaatgttttgatcataagcctagaatgataagtaaaagaaataaagataattctactgcttgttctcacccggttacaaagcatgagtttgaagacaataagtgccttgtccacattttgcgagagacaacagtaaaatactccaaaatacgttcttttcatggtcagtgtcagcttgatttatgtcgacatgaagttcggtatggctgtttaagggaagatgagtgcttttatgcccatagtcttgtggaactgaaagtctggataatgcaaaatgaaacaggtatctcacatgatgctattgctcaagagtctaaacgatattggcagaatttggaagcaaatgtacctggagcgcaggtacttggtaatcaaataatgcctggatttcttaatatgaagataaagtttgtgtgcgcccagtgtctgagaaacggtcaagtcattgaaccagacaaaaacagaaaatattgtagtgcaaaagcaaggcattcgtggaccaaagaccggcgtgcgatgagagtgatgtctattgaacctgtgcaaccatattgcttctgggaaaaaatgtcaatatgtgggaaactgttcctttgctcatagtcctgaggaaagagaagtttggacttacatgaaggagaatgggatacaagatatggagcaattttacgaactatggctcaagagtcaaaaaaatgaaaaaagtgaagacatagccagtcagtcaaacaaggaaaatggaaaacaaattcacatgccaacagattatgctgaagttacagtggactttcactgctggatgtgtgggaaaaactgcaacagtgagaagcagtggcagggccacatctcctccgagaagcacaaagagaaggttttccacaccgaggacgaccagtactgctggcagcaccgcttcccaacaggctatttcagtatttgtgataggtatatgaatggcacctgcccagaaggaaacagctgtaaatttgcacatggaaatgccgaacttcatgaatgggaagaaagaagagatgccctaaagatgaagctcaacaaagcacgaaaagatcacttaattggcccaaatgataatgactttggaaaatatagttttttgtttaaagatttaaactaatatgctggcttttatgtatgatacctaatcagagcattgaccagaaaaattgaaagtgttctgaggcacatagcagaggagctgcagatttcctgcttgtattggcgtatatcgttcctcctgagcagcaacccacagtaggtaggaaaatgggctgtttcacaggcctggccacgctctcacggaaccactggcatcagatggtgaagtgactgctacccggttgccatctgttgaacagacttttggatgaagtgtgttggggaagaggataaggttatatctaggacaactctttgagttggtccttcatataagaatcgtgacggtaagagaataaacacttgtactgggatcagaatacatgatggatgaaattctttacatgttttagcagaatgaatttgtttaatataataaagtttgctacttatctgtatgtaggttgctaaaaaggattttcttaactcagattttaagccaaataaccatttaacactagtatttgttaaatggggtatttttctgtatttgtatgtttcactataataagggaattaaggataatgtgcattgagaatattttgaaaaataattgactcaaattttatttcttggtcttttgctgtttaaatgatgattttgaaagattaaacctgtactgttggtattgtgttagtgtatggaccaatactgcctgtaataaagattttatatatagatgcctttca

SEQ ID NO: 76616 - DNA, 2455 bp, Homo sapiens
ttgttggctgttttttttttttttcttcttatttttcttgcagatgaatggaccaggtagtttgtttgcttcagagaatttcctgggaatttcaagtcagcctagaaatgactttggaaacttttttggaagtgcagttaccaaaccatcttcatcagtgactccaagacatcccctcgaaggaacccatgaattgagacaagcttgccagatctgttttgtaaaatcaggccctaagttaatggatttcacttaccatgctaacatagatcataagtgtaagaaagatattttaatcggtaggataaagaatgttgaagataaatcatggaaaaaaatacgtccaagaccaacaaaaacaaattatgaaggaccatattatatatgtaaagatgttgctgctgaggaggaatgtagatattcaggccactgcacgtttgcttattgccaagaggagatagatgtgtggacactggagcggaaaggagcattcagccgggaggctttctttggcggcaatggaaagattaaccttactgtgttcaaacttctccaggagcatcttggggaatttatattcctttgtgagaaatgttttgatcataagcctagaatgataagtaaaagaaataaagataattctactgcttgttctcacccggttacaaagcatgagtttgaagacaataagtgccttgtccacattttgcgagagacaacagtaaaatactccaaaatacgttcttttcatggtcagtgtcagcttgatttatgtcgacatgaagttcggtatggctgtttaagggaagatgagtgcttttatgcccatagtcttgtggaactgaaagtctggataatgcaaaatgaaacaggtatctcacatgatgctattgctcaagagtctaaacgatattggcagaatttggaagcaaatgtacctggagcgcaggtacttggtaatcaaataatgcctggatttcttaatatgaagataaagtttgtgtgcgcccagtgtctgagaaacggtcaagtcattgaaccagacaaaaacagaaaatattgtagtgcaaaagcaaggcattcgtggaccaaagaccggcgtgcgatgagagtgatgtctattgaacctgtgcaaccatattgcttctgggaaaaaatgtcaatatgtgggaaactgttcctttgctcatagtcctgaggaaagagaagtttggacttacatgaaggagaatgggatacaagatatggagcaattttacgaactatggctcaagagtcaaaaaaatgaaaaaagtgaagacatagccagtcagtcaaacaaggaaaatggaaaacaaattcacatgccaacagattatgctgaagttacagtggactttcactgctggatgtgtgggaaaaactgcaacagtgagaagcagtggcagggccacatctcctccgagaagcacaaagagaaggttttccacaccgaggacgaccagtactgctggcagcaccgcttcccaacaggctatttcagtatttgtgataggtatatgaatggcacctgcccagaaggaaacagctgtaaatttgcacatggaaatgccgaacttcatgaatgggaagaaagaagagatgccctaaagatgaagctcaacaaagcacgaaaagatcacttaattggcccaaatgataatgactttggaaaatatagttttttgtttaaagatttaaactaatatgctggcttttatgtatgatacctaatcagagcattgaccagaaaaattgaaagtgttctgaggcacatagcagaggagctgcagatttcctgcttgtattggcgtatatcgttcctcctgagcagcaacccacagtaggtaggaaaatgggctgtttcacaggcctggccacgctctcacggaaccactggcatcagatggtgaagtgactgctacccggttgccatctgttgaacagacttttggatgaagtgtgttggggaagaggataaggttatatctaggacaactctttgagttggtccttcatataagaatcgtgacggtaagagaataaacacttgtactgggatcagaatacatgatggatgaaattctttacatgttttagcagaatgaatttgtttaatataataaagtttgctacttatctgtatgtaggttgctaaaaaggattttcttaactcagattttaagccaaataaccatttaacactagtatttgttaaatggggtatttttctgtatttgtatgtttcactataataagggaattaaggataatgtgcattgagaatattttgaaaaataattgactcaaattttatttcttggtcttttgctgtttaaatgatgattttgaaagattaaacctgtactgttggtattgtgttagtgtatggaccaatactgcctgtaataaagattttatatatagatgcctttca

SEQ ID NO: 76617 - DNA, 2471 bp, Homo sapiens
ttattctcaacttctagagagggaacgctgtccacgacagacagttgtccccgtcggcatgagtggagcaggtagttccctcgttcaagagaatttgcgtgcggccgcaagccgagcctagtaatgactttgaacacctacatgcaagagccgaccgaataccatatctatcagtcactcaagatcaacgcctgcaaggtacgcatgaaccaataccttagggcctgatctgttttgtaaaatcaggccctaagttaatggatttcacttaccatgctaacatagatcataagtgtaagaaagatattttaatcggtaggataaagaatgttgaagataaatcatggaaaaaaatacgtccaagaccaacaaaaacaaattatgaaggaccatattatatatgtaaagatgttgctgctgaggaggaatgtagatattcaggccactgcacgtttgcttattgccaagaggagatagatgtgtggacactggagcggaaaggagcattcagccgggaggctttctttggcggcaatggaaagattaaccttactgtgttcaaacttctccaggagcatcttggggaatttatattcctttgtgagaaatgttttgatcataagcctagaatgataagtaaaagaaataaagataattctactgcttgttctcacccggttacaaagcatgagtttgaagacaataagtgccttgtccacattttgcgagagacaacagtaaaatactccaaaatacgttcttttcatggtcagtgtcagcttgatttatgtcgacatgaagttcggtatggctgtttaagggaagatgagtgcttttatgcccatagtcttgtggaactgaaagtctggataatgcaaaatgaaacaggtatctcacatgatgctattgctcaagagtctaaacgatattggcagaatttggaagcaaatgtacctggagcgcaggtacttggtaatcaaataatgcctggatttcttaatatgaagataaagtttgtgtgcgcccagtgtctgagaaacggtcaagtcattgaaccagacaaaaacagaaaatattgtagtgcaaaagcaaggcattcgtggaccaaagaccggcgtgcgatgagagtgatgtctattgaacctgtgcaaccatattgcttctgggaaaaaatgtcaatatgtgggaaactgttcctttgctcatagtcctgaggaaagagaagtttggacttacatgaaggagaatgggatacaagatatggagcaattttacgaactatggctcaagagtcaaaaaaatgaaaaaagtgaagacatagccagtcagtcaaacaaggaaaatggaaaacaaattcacatgccaacagattatgctgaagttacagtggactttcactgctggatgtgtgggaaaaactgcaacagtgagaagcagtggcagggccacatctcctccgagaagcacaaagagaaggttttccacaccgaggacgaccagtactgctggcagcaccgcttcccaacaggctatttcagtatttgtgataggtatatgaatggcacctgcccagaaggaaacagctgtaaatttgcacatggaaatgccgaacttcatgaatgggaagaaagaagagatgccctaaagatgaagctcaacaaagcacgaaaagatcacttaattggcccaaatgataatgactttggaaaatatagttttttgtttaaagatttaaactaatatgctggcttttatgtatgatacctaatcagagcattgaccagaaaaattgaaagtgttctgaggcacatagcagaggagctgcagatttcctgcttgtattggcgtatatcgttcctcctgagcagcaacccacagtaggtaggaaaatgggctgtttcacaggcctggccacgctctcacggaaccactggcatcagatggtgaagtgactgctacccggttgccatctgttgaacagacttttggatgaagtgtgttggggaagaggataaggttatatctaggacaactctttgagttggtccttcatataagaatcgtgacggtaagagaataaacacttgtactgggatcagaatacatgatggatgaaattctttacatgttttagcagaatgaatttgtttaatataataaagtttgctacttatctgtatgtaggttgctaaaaaggattttcttaactcagattttaagccaaataaccatttaacactagtatttgttaaatggggtatttttctgtatttgtatgtttcactataataagggaattaaggataatgtgcattgagaatattttgaaaaataattgactcaaattttatttcttggtcttttgctgtttaaatgatgattttgaaagattaaacctgtactgttggtattgtgttagtgtatggaccaatactgcctgtaataaagattttatatatagatgcctttca

SEQ ID NO: 76618 - DNA, 1585 bp, Homo sapiens
gaagtgaaaatacagaatcataaggtatttcttttagaagcattgagaaaaaaattctctggttcctcaggtacaaactttgtgcctctccctttgtgttatgtcttttgctcgtgtgtctttgtttttttctgaactccatttttcttaggtggaccaaagaccggcgtgcgatgagagtgatgtctattgaacgtaagaagtggatgaacatccgtcctctccccacaaagaaacaaatgcctttacagtttgatctgtgcaaccatattgcttctgggaaaaaatgtcaatatgtgggaaactgttcctttgctcatagtcctgaggaaagagaagtttggacttacatgaaggagaatgggatacaagatatggagcaattttacgaactatggctcaagagtcaaaaaaatgaaaaaagtgaagacatagccagtcagtcaaacaaggaaaatggaaaacaaattcacatgccaacagattatgctgaagttacagtggactttcactgctggatgtgtgggaaaaactgcaacagtgagaagcagtggcagggccacatctcctccgagaagcacaaagagaaggttttccacaccgaggacgaccagtactgctggcagcaccgcttcccaacaggctatttcagtatttgtgataggtatatgaatggcacctgcccagaaggaaacagctgtaaatttgcacatggaaatgccgaacttcatgaatgggaagaaagaagagatgccctaaagatgaagctcaacaaagcacgaaaagatcacttaattggcccaaatgataatgactttggaaaatatagttttttgtttaaagatttaaactaatatgctggcttttatgtatgatacctaatcagagcattgaccagaaaaattgaaagtgttctgaggcacatagcagaggagctgcagatttcctgcttgtattggcgtatatcgttcctcctgagcagcaacccacagtaggtaggaaaatgggctgtttcacaggcctggccacgctctcacggaaccactggcatcagatggtgaagtgactgctacccggttgccatctgttgaacagacttttggatgaagtgtgttggggaagaggataaggttatatctaggacaactctttgagttggtccttcatataagaatcgtgacggtaagagaataaacacttgtactgggatcagaatacatgatggatgaaattctttacatgttttagcagaatgaatttgtttaatataataaagtttgctacttatctgtatgtaggttgctaaaaaggattttcttaactcagattttaagccaaataaccatttaacactagtatttgttaaatggggtatttttctgtatttgtatgtttcactataataagggaattaaggataatgtgcattgagaatattttgaaaaataattgactcaaattttatttcttggtcttttgctgtttaaatgatgattttgaaagattaaacctgtactgttggtattgtgttagtgtatggaccaatactgcctgtaataaagattttatatatagatgcctttca

SEQ ID NO: 76619 - DNA, 1438 bp, Homo sapiens
taatatttgccatctaacagtcctgaaagtagttcttatgcgtgagagtttacctgctgcttgaactgggtgatctctccatgtctaatataatagtctccttcagcccccttgagtttcttttgaactgtatgctgactgctacaaaatatgcacatagttgcatgtatttaaatggagtttagttgctgctgctgaaagtaattcatttttctttagtacaagatatggagcaattttacgaactatggctcaagagtcaaaaaaatgaaaaaagtgaagacatagccagtcagtcaaacaaggaaaatggaaaacaaattcacatgccaacagattatgctgaagttacagtggactttcactgctggatgtgtgggaaaaactgcaacagtgagaagcagtggcagggccacatctcctccgagaagcacaaagagaaggttttccacaccgaggacgaccagtactgctggcagcaccgcttcccaacaggctatttcagtatttgtgataggtatatgaatggcacctgcccagaaggaaacagctgtaaatttgcacatggaaatgccgaacttcatgaatgggaagaaagaagagatgccctaaagatgaagctcaacaaagcacgaaaagatcacttaattggcccaaatgataatgactttggaaaatatagttttttgtttaaagatttaaactaatatgctggcttttatgtatgatacctaatcagagcattgaccagaaaaattgaaagtgttctgaggcacatagcagaggagctgcagatttcctgcttgtattggcgtatatcgttcctcctgagcagcaacccacagtaggtaggaaaatgggctgtttcacaggcctggccacgctctcacggaaccactggcatcagatggtgaagtgactgctacccggttgccatctgttgaacagacttttggatgaagtgtgttggggaagaggataaggttatatctaggacaactctttgagttggtccttcatataagaatcgtgacggtaagagaataaacacttgtactgggatcagaatacatgatggatgaaattctttacatgttttagcagaatgaatttgtttaatataataaagtttgctacttatctgtatgtaggttgctaaaaaggattttcttaactcagattttaagccaaataaccatttaacactagtatttgttaaatggggtatttttctgtatttgtatgtttcactataataagggaattaaggataatgtgcattgagaatattttgaaaaataattgactcaaattttatttcttggtcttttgctgtttaaatgatgattttgaaagattaaacctgtactgttggtattgtgttagtgtatggaccaatactgcctgtaataaagattttatatatagatgcctttca

SEQ ID NO: 76620 - DNA, 979 bp, Homo sapiens
tgtggtatctagaggatccgtcgacggtaccaacaggctatttcagtatttgtgataggtatatgaatggcacctgcccagaaggaaacagctgtaaatttgcacatggaaatgccgaacttcatgaatgggaagaaagaagagatgccctaaagatgaagctcaacaaagcacgaaaagatcacttaattggcccaaatgataatgactttggaaaatatagttttttgtttaaagatttaaactaatatgctggcttttatgtatgatacctaatcagagcattgaccagaaaaattgaaagtgttctgaggcacatagcagaggagctgcagatttcctgcttgtattggcgtatatcgttcctcctgagcagcaacccacagtaggtaggaaaatgggctgtttcacaggcctggccacgctctcacggaaccactggcatcagatggtgaagtgactgctacccggttgccatctgttgaacagacttttggatgaagtgtgttggggaagaggataaggttatatctaggacaactctttgagttggtccttcatataagaatcgtgacggtaagagaataaacacttgtactgggatcagaatacatgatggatgaaattctttacatgttttagcagaatgaatttgtttaatataataaagtttgctacttatctgtatgtaggttgctaaaaaggattttcttaactcagattttaagccaaataaccatttaacactagtatttgttaaatggggtatttttctgtatttgtatgtttcactataataagggaattaaggataatgtgcattgagaatattttgaaaaataattgactcaaattttatttcttggtcttttgctgtttaaatgatgattttgaaagattaaacctgtactgttggtattgtgttagtgtatggaccaatactgcctgtaataaagattttatatatagatgcctttca

SEQ ID NO: 76621 - DNA, 3086 bp, Homo sapiens
  misc_feature (3053)..(3053): n is a, c, g, or t
gtatatttgcgtgctctcgtgagaaatctttttaatgaaggaaatgacgtttatcgggaacatgattggaacaactcgataagccagtacacggaagccttgaatatagctgattatgcaaaatctgaagaaattttaatccccaaagaaataattgaaaaactatatataaatcgtattgcctgctattctaatatgggtttccatgataaagttttggaggactgcaatatagtcctcagtttaaatgccagtaactgcaaagctctgtatcggaaatctaaggctttaagtgatttaggaagatacaaaaaggcttacgatgctgtagcaaagtgctccttagcagtgcctcaggatgagcatgtaataaaactaactcaagaactagctcagaaattgggatttaaaataagaaaagcgtatgtcagagctgagctctcattaaaatcagttcctggggatggggctaccaaggctttgaaccattctgtggaagatattgagccagatttattaactccaaggcaagaagcagttcctgttgtctctttaccggcacccagtttttctcatgaagttggaagtgagctggcctcagttcctgttatgcccttaacttctattttgccactacaagtggaagagagcgctctgccatctgcagtgctggcaaatggaggaaagatgcccttcactatgccagaagcttttctagatgatggagatatggtccttggagatgaactagatgacctgcttgattctgcacctgaaactaatgaaactgttatgccgtcagctttagtcagaggaccccttcagacagccagtgtctctcctagcatgcccttttcggcatcgctgttaggaaccttacccattggtgcgaggtatgctcctccaccctccttctcagaattttatccacctttgacttcatccttagaagatttttgttcttctttaaattcattttcaatgagtgaatccaaacgagatctgtccacctcaacttctagagagggaacaccgcttaacaacagtaattcttcccttttacttatgaatggaccaggtagtttgtttgcttcagagaatttcctgggaatttcaagtcagcctagaaatgactttggaaacttttttggaagtgcagttaccaaaccatcttcatcagtgactccaagacatcccctcgaaggaacccatgaattgagacaagcttgccagatctgttttgtaaaatcaggccctaagttaatggatttcacttaccatgctaacatagatcataagtgtaagaaagatattttaatcggtaggataaagaatgttgaagataaatcatggaaaaaaatacgtccaagaccaacaaaaacaaattatgaaggaccatattatatatgtaaagatgttgctgctgaggaggaatgtagatattcaggccactgcacgtttgcttattgccaagaggagatagatgtgtggacactggagcggaaaggagcattcagccgggaggctttctttggcggcaatggaaagattaaccttactgtgttcaaacttctccaggagcatcttggggaatttatattcctttgtgagaaatgttttgatcataagcctagaatgataagtaaaagaaataaagataattctactgcttgttctcacccggttacaaagcatgagtttgaagacaataagtgccttgtccacattttgcgagagacaacagtaaaatactccaaaatacgttcttttcatggtcagtgtcagcttgatttatgtcgacatgaagttcggtatggctgtttaagggaagatgagtgcttttatgcccatagtcttgtggaactgaaagtctggataatgcaaaatgaaacaggtatctcacatgatgctattgctcaagagtctaaacgatattggcagaatttggaagcaaatgtacctggagcgcaggtacttggtaatcaaataatgcctggatttcttaatatgaagataaagtttgtgtgcgcccagtgtctgagaaacggtcaagtcattgaaccagacaaaaacagaaaatattgtagtgcaaaagcaaggcattcgtggaccaaagaccggcgtgcgatgagagtgatgtctattgaacgtaagaagtggatgaacatccgtcctctccccacaaagaaacaaatgcctttacagtttgatctgtgcaaccatattgcttctgggaaaaaatgtcaatatgtgggaaactgttcctttgctcatagtcctgaggaaagagaagtttggacttacatgaaggagaatgggatacaagatatggagcaattttacgaactatggctcaagagtcaaaaaaatgaaaaaagtgaagacatagccagtcagtcaaacaaggaaaatggaaaacaaattcacatgccaacagattatgctgaagttacagtggactttcactgctggatgtgtgggaaaaactgcaacagtgagaagcagtggcagggccacatctcctccgagaagcacaaagagaaggttttccacaccgaggacgaccagtactgctggcagcaccgcttcccaacaggctatttcagtatttgtgataggtatatgaatggcacctgcccagaaggaaacagctgtaaatttgcacatggaaatgccgaacttcatgaatgggaagaaagaagagatgccctaaagatgaagctcaacaaagcacgaaaagatcacttaattggcccaaatgataatgactttggaaaatatagttttttgtttaaagatttaaactaatatgctggcttttatgtatgatacctaatcagagcattgaccagaaaaattgaaagtgttctgaggcacatagcagaggagctgcagatttcctgcttgtattggcgtatatcgttcctcctgagcagcaacccacagtaggtaggaaaatgggctgtttcacaggcctggccacgctctcacggaaccactggcatcagatggtgaagtgactgctacccgtccatctgtgacaactatgatgngttgttggtcctcacaggatcctgtagatacag

SEQ ID NO: 76622 - DNA, 1800 bp, Homo sapiens
gtatatttgcgtgctctcgtgagaaatctttttaatgaaggaaatgacgtttatcgggaacatgattggaacaactcgataagccagtacacggaagccttgaatatagctgattatgcaaaatctgaagaaattttaatccccaaagaaataattgaaaaactatatataaatcgtattgcctgctattctaatatgggtttccatgataaagttttggaggactgcaatatagtcctcagtttaaatgccagtaactgcaaagctctgtatcggaaatctaaggctttaagtgatttaggaagatacaaaaaggcttacgatgctgtagcaaagtgctccttagcagtgcctcaggatgagcatgtaataaaactaactcaagaactagctcagaaattgggatttaaaataagaaaagcgtatgtcagagctgagctctcattaaaatcagttcctggggatggggctaccaaggctttgaaccattctgtggaagatattgagccagatttattaactccaaggcaagaagcagttcctgttgtctctttaccggcacccagtttttctcatgaagttggaagtgagctggcctcagttcctgttatgcccttaacttctattttgccactacaagtggaagagagcgctctgccatctgcagtgctggcaaatggaggaaagatgcccttcactatgccagaagcttttctagatgatggagatatggtccttggagatgaactagatgacctgcttgattctgcacctgaaactaatgaaactgttatgccgtcagctttagtcagaggaccccttcagacagccagtgtctctcctagcatgcccttttcggcatcgctgttaggaaccttacccattggtgcgaggtatgctcctccaccctccttctcagaattttatccacctttgacttcatccttagaagatttttgttcttctttaaattcattttcaatgagtgaatccaaacgagatctgtccacctcaacttctagagagggaacaccgcttaacaacagtaattcttcccttttacttatgaatggaccaggtagtttgtttgcttcagagaatttcctgggaatttcaagtcagcctagaaatgactttggaaacttttttggaagtgcagttaccaaaccatcttcatcagtgactccaagacatcccctcgaaggaacccatgaattgagacaagcttgccagatctgttttgtaaaatcaggccctaagttaatggatttcacttaccatgctaacatagatcataagtgtaagaaagatattttaatcggtaggataaagaatgttgaagataaatcatggaaaaaaatacgtccaagaccaacaaaaacaaattatgaaggaccatattatatatgtaaagatgttgctgctgaggaggaatgtagatattcaggccactgcacgtttgcttattgccaagaggagatagatgtgtggacactggagcggaaaggagcattcagccgggaggctttctttggcggcaatggaaagattaaccttactgtgttcaaacttctccaggagcatcttggggaatttatattcctttgtgagaaatgttttgatcataagcctagaatgataagtaaaagaaataaagataattctactgcttgttctcacccggttacaaagcatgagtttgaagacaataagtatgttgatagtttctaatttctgtaatgacaaaatagattctttttctagatctgaataaaaactagtagtaatgtctgtccaggc

SEQ ID NO: 76623 - DNA, 516 bp, Homo sapiens
gtatatttgcgtgctctcgtgagaaatctttttaatgaaggaaatgacgtttatcgggaacatgattggaacaactcgataagccagtacacggaagccttgaatatagctgattatgcaaaatctgaagaaattttaatccccaaagaaataattgaaaaactatatataaatcgtattgcctgctattctaatatgggtttccatgataaagttttggaggactgcaatatagtcctcagtttaaatgccagtaactgcaaagctctgtatcggaaatctaaggctttaagtgatttaggaagatacaaaaaggcttacgatgctgtagcaaagtgctccttagcagtgcctcaggatgagcatgtaataaaactaactcaagaactagctcagaaattgggatttaaaataagaaaagcgtatgtcagagctgagctctcattaaaatcagttcctggggatggggctaccaaggatgctaatggctattgtgagttgggcaatgattggtgg

SEQ ID NO: 76624 - DNA, 343 bp, Homo sapiens
ttttgagtgtgttctcatgtcattaattactgatacaagttgatacatgcaattgttgggaggaaagattcctcagaaggcacaaagagctgtatttgtgtatattccatttcaaaaaagagaaacgtggtattcatccttgctgatggattaggaggtatgagaatagattggaagctgaaggttctccacgtctgactgcacccagattggtgggctgttgttcttatagatataatttaaaggaaggcttgtacattccccaggtatctcacatgatgctattgctcaagagtctaaacgatattggcagaatttggaagcaaatgtacctggagcgcag

SEQ ID NO: 76625 - DNA, 252 bp, Homo sapiens
tctgctctatgtggtcagtcaggaactcaggactctaccatcttttgtcattgtcaacttcaacctgtgatctttcagctctccactgaaggaggagagaaggaccacctgttctcagctacttcagctggaagtgacccatcagttctccttacacacctctgctttactgagacacaatgggactggggaatacagtttaacaatgtgtccaggaaaaggaaatgggactggtgagcatctagaatggtt

SEQ ID NO: 76626 - DNA, 642 bp, Homo sapiens
agaccctgtctcaaaaaaataaataaataaaaaacaacaaaaaaataaaataaaagcagctagttcagcttgcaattcaaacaagtgcacacgtactttccctcaaggccacacccatcacacttcaggcccagcagcagtgctgtgtgcacacctcccatgctgtctcacagaatattaaaaggcaagggttgagatttaatcacatcaacagttttattatttcaagaccattcttaagtgatatgagcctttttcaccccctgtgagtaggtgacagtaaagaatgcagtggctactggcagattctggtaccacagcctggaatcacgtgacggtgccggcaatttcacccatcattgcttttcaccatcaggcaaatgtcaacagcacaagagactcacaccgtatgattatgaaaatagttttgatcccgaggacccccttgagaaccgctgccctaacaaatgcctcgcatggtcgcggctcctttcagagcacggcggcacctcggaatgaagccgttcctccatcaactctgcagccagccaaccgggattgtttaaatacttctgaagctcacatgaaagctaaggctcttcagaatacatcttctgacttttcctcagaaacacaaggccc

SEQ ID NO: 76627 - DNA, 361 bp, Homo sapiens
cttcagatccaaatagcctgaaggttgttaaaatacagatagtgagccaccgcacccggccctttataaattctttgggcttagatgtctgtcatatagttttgtgtcatctgtagcaagcaccagctgtaattttggtttggtattggatatacctcagctggtttgtagagtcatttaaatacttcagactatttttctcattcattttatttagtaaacattgtttataaagtgctgggtaaaacataaaggtgactaaaatacagtttcttcccttgagagatttctagtgtggtggaatctgtgagctacacacatggccaagtgtgcaaggggctattgcaggggcacagacttg

SEQ ID NO: 76628 - DNA, 529 bp, Homo sapiens
gtcatatttgtaaaggactttaaaacacccaaatggagggccatttggtgatctacctccagaatcataatgaaaaccatcaccatgaactgagtttctactgtacaccacaaaccatattctcatctgttcccatcctaaaactcccactggaccagctgggaacctgacagctgctgcactgttggttccacttgcctgctgccgtcttctaggagcagaaagtcatgtgacccgggcctggctactgtgattggctctgtgatgagcacatgacaaagctgggccaatcagaatcttccctgagactttttttgccagataggaaaagactccccaaccctaccgttgctaagctggggcccattgggaacacatatggaaggtgcctgagaaatataagaagcccccaaagatatgcagtccctatgacaatgcttgagccttagatgcacctgtagaggaagccagatctacttcctggatttgacagttacaggaatagtaaattcttttactgcttaagcca

SEQ ID NO: 76629 - DNA, 464 bp, Homo sapiens
ggaagaacaaggaaatgacagtggctggagcagagtggggaatggaaggagtagtaagagctgaagtcagacaggcaacgagagactaaattatgaagggctttgaaggccattgctgggactgatctgaaggccttgagcagaaaggtggccccgcctaccccaccaaccccagcttctctggttcctcccttggtaacggaatgcatgcttattgctgttgtttgaatgcactcaaacatttcccttttatggccttcacactggcttttacctctccttggaatcctcttccccccagatctttatcccttgcctcgccccttcacattacttacgtctctgctcaatggatcttctctgaccacagatttgaaaatagcacgctacctcccttctatgttgactagggtcctactaggaaaacaggaaccacactgcgcattttcataagataaagttta

SEQ ID NO: 76630 - DNA, 359 bp, Homo sapiens
attctcctctgttctcttgatgtgtagggaaatttgaagaatgactctgataaaaatctaaaagagaaacatcgaatcctaactggctgtgtgaccctaaaaccttactccgtctctttgaacctcagatttctcagggcttggcacatagcaagcatttcatactcagaagctggtactattactgttgtgttttgtggggggaggtttgtttgttttgtttggagacaggatctggctttgttgccctggctggagtgaagtggcgccatcatagctcactgcagcctcgccctcctgggctccagcgatcctcctgcctcagtctcccgagtagctgggaccacctgcgcatgccg

SEQ ID NO: 76631 - DNA, 274 bp, Homo sapiens
caaggcctcttccaccctccagagaagagccctgaaatgacccacgcaggcacatacaatcaggggtctggaaacaagaccaagacggacgcacatctatttgcccaaataaattaagtagcattctgaacatgatgaatagtttggcaggaaaaaaacgttccagtaaatgcacgggctgacccaaaatggtccctccactggaatatggaaaatgaaaaaagatattgttttggctctagcctataaggcattaataaacaattggcatcta

SEQ ID NO: 76632 - DNA, 203 bp, Homo sapiens
ttttttttttcagagacaggatctcgctctatcacccaggctggagtacagtggcacaaatagtagctcactgtaacctcaagcttaggctcaagcaatcctcctgtcttggcctcctaaagtgctgggactacgggtgtgagccaccatacctagcctacttttaaattttctagaagtcacattttaaaaagacttttaaa

SEQ ID NO: 76633 - DNA, 724 bp, Homo sapiens
gattcacaaataaacgcagcgggatctgagaaggggcctgagtacacgggccgggggagaaagggaagtggcaacccctagttcaaaatgcaaacgacctctggaatttcgggaagagacggaggagtgagtttggattgagcccaccctgtgggggaggggaagcccaggcttgagaagcaaagctcgcgtttattgaccacctactaagtgctaaatccttctgcatttgttctcactttgaagagtaaaggctacccctgccaggtttccagtcttgggctggctccgagaagggcctaggctttgaagcgcttttaaattgtcctctggccctgggtggccagggaaggttcccgggggtgcagccaaatacacatcgccggcaaactgattaaccctgaaagtggcgccgaggcccggtctgtggctcttggtgttcccctccccctcacccctcttgggggagccagacggccacccccaggggaggaggggcccggccgagcctcgccgcgacttttgcgagatagcgcggcgacatggccacacaatggagcccgcaggcgggagtgcggggcggggcgcggcgccctggccttgcgcgcttacggggtcctctccagggccctctggggcctctgacttaaaatagggaggactgggccaggagatcgagacaatcctggccaacctgttgaaaccccgcctctactaaaataca

SEQ ID NO: 76634 - DNA, 423 bp, Homo sapiens
gattcacaaataaacgcagcgggatctgagaaggggcctgagtacacgggccgggggagaaagggaagtggcaacccctagttcaaaatgcaaacgacctctggaatttcgggaagagacggaggagtgagtttggattgagcccacccttcacccctcttgggggagccagacggccacccccaggggaggaggggcccggccgagcctcgccgcgacttttgcgagatagcgcggcgacatggccacacaatggagcccgcaggcgggagtgcggggcggggcgcggcgccctggccttgcgcgcttacggggtcctctccagggccctctggggcctctgacttaaaatagggaggactgggccaggagatcgagacaatcctggccaacctgttgaaaccccgcctctactaaaataca

SEQ ID NO: 76635 - DNA, 729 bp, Homo sapiens
tcaggccctgcttttttgtatcaacccgaagggaactttccaaatgtaaaaaccatgtggctcatttacatagtgactgaaaccatctttcatggaaactccctgtgtaacaaacagaattatcgttactagttttcagaggtttgaatggccaacgtttgtactcataaaaagagagaaatgatttcactctggggaaacagtaagggttaagagaatgcatccttaccaggactatctaagccgctaaatataattgtatttgcactaaacttgttgccaattaagattaaatattagcctttaagtactctatatctaacatgaagtgctcctttttaattgcttttgaagggaccgataacttgtgagttcatggagtgagaaaatggctagtctataaacgtcagtagagcatcaagatttcagaataagttcaaagagggctgaaatacatgttcaagtggaaattgttaattttttatgggaatgttttcatgagatgtgacaatgatgctgtattttaagtctttttgtgtttcttctggttatttgcccccattaaaagatcaatagatctttataatttattatacttatgctgattactgttttcttctttacaaaattatgtctcagcgagtgccaaatattattgtttctttgattttttactttataattttgctgaaataaatacatctcttctactagaaaaataagcataat

SEQ ID NO: 76636 - DNA, 783 bp, Homo sapiens
aggcagacttatttacagaaatgaggaaagtgtgagaggatggagatgcccaagaggaagtgatcagcaaaatcacactagagaaactctcagacatattttatgacattaaaagctccaggaatgagaaatatcaggggcatatctactcttaagaagaaagaagtatgagaattcaccaagacatagaaatattatgaataagttatgtgatgagaagatttatttatctcaggcttagtgctggagaagtcaacaacctagaaatgccaaggaacacaagttaaaaagctgatgaaaagcctgctctctccagcttaatgaccaagaaaggggcagccaagaaaaacataaggcttttagacaacaaccaccctattccatggaataccactgttgcagtcccactcccactcctgtaagcaaaagctgagtggagaacctagacttccacctttcatcttcaccaggccgtaacaagacactgttaaagacaaaataatatttaataacacttgttaacgcatggttgggaagactgtattcaggatcattacatgatcccattgcatggacaagccaaggagtagagcagggtcagtggatggaaaattactaagaggaaacatgaggtgtaagaaggattctggccaaaccaacctaacagggcttacatcacttagagaatagtggaggatgagggactggatcagacatcaaagatgatcagatattaaggatagaggtttttgctagcaaaatgtagatttttgctaaaactat

SEQ ID NO: 76637 - DNA, 274 bp, Homo sapiens
gttcctgcttgttagaagagtgtacaagagcagtagctgctaaagaacgtcttccacaccattgtgtgtttggggcaggctgaatagtcccatccacaccaaagaagtccataccgtaactcagaacctgtgaatacatgacctcagatggcaggagggactttgcagatgggatcaaggatcttgagatgggtggatgatcctggagtatccaggtggccccatgtcatcacaaaggttcttttaggaaggaggcaggtcaaagagagacaat

SEQ ID NO: 76638 - DNA, 516 bp, Homo sapiens
ctgaaactgcggctagtaccaaaccctatccatactgtttttccacctggtaactgagtgactactaagtgactaacatggatatgctggataaaggaatgatgcacagcccgggcgggacggaatgggatggcgtgaggttgcaccatgctacttagaacagtgctcaatttaaaacttaggaactgtttacttctgcagttttttatttaatatttttggaccacagttaactgcgagtaactgttaaacttcagaaagtaaaaccatgggtaagagagactactgtatatctttccataccattatcttagctcttacaaacctatatgtgcatattatcataattattatcataatatgtgtgataggcacattattctgcaacttgctttttcccttgataatacactataggcatgcagtggtctgcaaccctgtctatgtattaaaatcatctaggtactttaaaaatactgattcccaggtctccacagattttcctgcccataggtg

SEQ ID NO: 76639 - DNA, 431 bp, Homo sapiens
cccagatgtggttctcaaccttctaggctaagaaaccgatgacacccaccttccaggaatgggacctcctcctctcaaggacagactcacttaaccacatttgtgaaataaaaaaggacagtttacaaatgtatagtactgtatatatccaattgtcataaatatcccaacacaacaagctctgtcactaaaatcataatcgaactataaatgtattaatttacagcgagaataacttttccagaaactagatatttcagagtttcaatactgagctttgtggtttttttttttttttttttttttttttggcatattgacttagaaagccaaggaataatgcaaaggttttctagtgagcgttgaatctgatcaaagtaaaacggatgaaacaaatgtacaatggaagttcttgccaatgaccccaaatc

SEQ ID NO: 76640 - DNA, 190 bp, Homo sapiens
aaaggttagctgaagcttgttttcctggcaacagagcagagttctgagagagcgtgagtatgcaaggcctcttgaggcccaagcctaggttcagaacaggaatcacttctgatatactctattggccaaagttagtcccaagtccagatccaggcttgctcaaaacagtggcccatctctctggccccaa

SEQ ID NO: 76641 - DNA, 430 bp, Homo sapiens
cagggacagcgctcagcagccgcgccgcatcccgcgcccgatcggccgccgcgtcagcaccacggacagctcctggagcagccccagcggggccctggcagcagggctcacacaccccagtcgccccacaagcatctggggacacaaggggccgtgactgacaaggagaaggagcgtcccccgagttgctgcgctgctgccggagccctccttcagcacaaatccccctccgccctcggcaagggcgtcctgagcaggagacctgagaatgagaccgtgctgcaccagttctgctgcccagccgccgacgcctgctccgacctggcctcccaaagtgatggctcctgcacccaggccggtgggggcatggaggactccgtggtggcagcggcggcggtggcagccggcagacccagtgcccatgccccga

SEQ ID NO: 76642 - DNA, 450 bp, Homo sapiens
tagggtgctattcttaatcatatactaagtaagtattttacatacatatagactgtgtttatttggtcactacattttgttaatgggtaaaagaccatatattaagctactttgttatttacatctatatctgttattaatctgatagctaggaagttgtatttagtaagaatctaattaggtttgcttttatcttataattgggattcctttatgctctatagtgttaatgtgtacagtgtttattagaggcttaaatgatacttctttaagcatccagtttttattttattaaaaaatcttagtgtttctttacaggttagttttgtattcttttttaatattttaagacattgccttcctatttaataatgtgctattcgtataataatctgtttttattacatagacatttgtgttatttaataaagtatattgtgttatatccct

SEQ ID NO: 76643 - DNA, 1128 bp, Homo sapiens
ggctgtggctttgccctttggcctttgctggctgtgtggcggctccgcggttcgcaggtcgttcgctgagcgtctctgcttagccgcggtcatgagccggcacagccggctgcagaggcaggttctgagcctgtaccgcgatctgctgcgcgccgggcgtgggaagccgggcgccgaggcgcgagtgcgggcagagttccggcagcatgcgggcctgccgcggtccgacgtgctgcgcatcgagtacctgtaccgccgcgggcggcgccagctgcagctgctacgctcgggccacgccaccgccatgggcgccttcgtacgcccgcgggccccgaccggggagcctggcggcgtgggttcccagcctgacgacggcgacagtccaaggaacccccacgacagcacgggggcaccggagacccgccccgacggacggtgacaggcgaagagccgaactcgctcgatggcgtggtggagccaggaggctcgcctgactgcatggggggactggggaacccgcctaaggtgagaggtcttaagagactagcttgacgaattggggatgtcagagactcctccttggcgacgcagggggcctagagagccccgtgatggacggcaagggaggcccgccttttccgatgcttggagacaggtcggtgctcctcccccatgagggcttggggcggcctgggacgctggcgggctggacagtgtcaagccaagagctacttgcccgaaggtacggggagccaggacgacccccggtggacagggagagcctgagacgcccttctcttgacccctgagaacatacccacttctggctcctcaaggagtctcccctctcctgtatttaactctgagaagtgcagactttttgctgagaacgttttgggaaggtgccctgatgagcggtgagaagcccggaatccccttctggaaaactttcccccattaattgtgacaagccaggaccatgaggaaggggtaggggtctatcaccctggttgatcaactgaagacccccaaaggcccctacttgatggttttgaggggcaacattgactcatttgccccttccctctcggaatgttggacaaagggaataaaattggggatatgtct

SEQ ID NO: 76644 - DNA, 3340 bp, Homo sapiens
gggggcggggctccgagccgggctgaggcgagcgggggcgcgggtggcgcggcgggacgcgagcggcgagccggagcgcggagcccggctcccgcaccatggaggaggacgacagctacgttcccagtgacctgacagcagaggagcgtcaagaactggagaacatccgacggagaaaacaggagctgctggctgacattcagaggctgaaggatgagatagcagaagtagctaatgaaattgaaaacctgggatccacagaggaaaggaaaaacatgcagaggaacaaacaggtagccatgggcaggaaaaaatttaatatggaccctaaaaaggggatccagttcttaatagagaacgacctcctgaagaacacttgtgaagacattgcccagttcttatataaaggcgaagggctcaacaagacagccatcggcgactacctaggggagagagatgagtttaatatccaggttcttcatgcatttgtggagctgcatgagttcactgatcttaatctcgtccaggcactacggcagttcctgtggagcttccggctacccggagaggcccagaagatcgaccggatgatggaggcgtttgcccagcgatattgtcagtgcaataatggcgtgttccagtccacggatacttgttacgtcctctcctttgccatcatcatgttgaacaccagtctgcacaaccccaatgtcaaagataagcccactgtggagaggttcattgccatgaaccgaggcatcaatgatgggggagacctgccggaggagctcctccggaatctctatgagagcataaaaaatgaaccctttaaaatcccagaagacgacgggaatgacctcactcacactttcttcaatccagaccgagaaggctggctattgaaactcggaggtggcagggtaaagacttggaagagacgctggttcattctgactgacaactgcctttactactttgagtataccacggataaggagccccgtggaatcatccctttagagaatctgagtatccgggaagtggaggactccaaaaaaccaaactgctttgagctttatatccccgacaataaagaccaagttatcaaggcctgcaagaccgaggctgacgggcgggtggtggaggggaaccacactgtttaccggatctcagctccgacgcccgaggagaaggaggagtggattaagtgcattaaagcagccatcagcagggaccctttctacgaaatgctcgcagcacggaaaaagaaggtctcctccacgaagcgacactgagcgtgcagccaagggcgttggtctgcgggggccttggagctcctgctcttctcccgcacctccatggatgcactgctgccgagcagagcgtcctctgccaggccccgccctggattcctagagactagcttcagcttttgctattttttttaagtgggagaagggtgggcagttatcactggggaagagaggaccggccacctgtccagcatgggctccagagccttcctctctcacagggcagagctcttgtcggcagggcagcctcctggccagtttctctgctcagtgttctggtagcagagctcagagccaactgtttacctcttggttgtccccgtgaagaagccttcaaaccctgcaccataaatacatgtgtccatatattattatatgttaagagaaaaaggtggaaaggaagagaagccacatactataaagatctattttttttttttaagagagaacgtagggctgttcaggtgcattctgccctggctgcgctggggagcttctccctggagaagagcacctggggctgcggccaaggggcatcagcctgggcccgcggcagggcctggcctgcctctcctgtgctgtgggagctcgctgcctggtgcttgtcttggcgagatggacaggtgaggtcgaggacgcagagggcagaggcccagtggagcctcagacggcacagtcagagtcgggggcctgcctggccggggtcgcagtcggcagcagcgtgcagtccggcatctcccgcggatgcttttccatcccaagtgcctgcggagcccgaggagaggagagagctgactggacgcttacgttattttcctccttcagaatccaagttcttgttgggctttaaagtagaaagtcagcattttccttgagctaaatacctaataaccaaaactgtgaggaaggttatcgggacagaggttccggataacctgtttcattttgggttttcttcctcttccccagactccagtcctcgttctagaggaaggagtaggacttccccgatccccgtagcttcagctttttctgcctcaaaaccagccctaactggactactctggatgcattttgtggtgggccccctagagggaagatgggcctttatctgctccgtggggtgcactggagtgaggggggtggccgggctgcctctcgcatctctgtcttcccctgcaggcgctgtgtgagctggccctgcccctcctcattacagtatgaagggagccgtgacacgcagcattttcctgccgttctctcagggactctcagggcagctcctgccactccgccagggccagcatgccagtccaggcagagcaggtggctggctgtctggccgtctcgccccgcccctccacaggaccctggaccagggcggtgcagggcgcagccccgaggaggcaggtggaggagctgcgggttttcacagggccgcgtcgccacggctcctctgatcctttagggttggcgagcatctctggaaatagcttttgcagaggagtggtgggaggaatagagggggacagtctgtcacctccctccccgccactttgtgtagatcctacctggagggaatggctttaggcacttttgtgccagagcttgtgagggtgacagaagagggtccaggctggaaacctgaactttctgggtgggagaaccaggtggtgcctgccgaggtctgggcgtgtttgggccggtgctggagcctgtccagctggcccgggccctggcctggttctcaagtgtttcctagacagagaggcacctgggtcagtattagtctatttatcagaggtgtaaataatctatgtatagtttttctccttttagattattttgtatttgtttaaaagaagttttgtcaaaatacaaaaatataaagaaatgactgaaagttgttgacagggtttttaagaaataattattctaattgtttttgtttgtttgtttttgccttgtaaactagcgccaaggaactgcagcaaataaactccaactctgcccaagcaaaaaaaaaa

SEQ ID NO: 76645 - DNA, 969 bp, Homo sapiens
agccattgcctgtctgttcaggaagcagctctgagctgccctagtggctggacagcttcacaggtatccccggcccctcccagtcagaccccacaggaaaacttggctcccagtaagttaccgctctcctggaagcacagaacggacttttcgtgtcccgctgtaaggaaacaagatggtccttaaaaccgaagaggaggacgttcccagtgacctgacagcagaggagcgtcaagaactggagaacatccgacggagaaaacaggagctgctggctgacattcagaggctgaaggatgagatagcagaagtagctaatgaaattgaaaacctgggatccacagaggaaaggaaaaacatgcagaggaacaaacaggtagccatgggcaggaaaaaatttaatatggaccctaaaaaggggatccagttcttaatagagaacgacctcctgaagaacacttgtgaagacattgcccagttcttatataaaggcgaagggctcaacaagacagccatcggcgactacctaggggagagagatgagtttaatatccaggttcttcatgcatttgtggagctgcatgagttcactgatcttaatctcgtccaggcactacggcagttcctgtggagcttccggctacccggagaggcccagaagatcgaccggatgatggaggcgtttgcccagcgatattgtcagtgcaataatggcgtgttccagtccacggatacttgttacgtcctctcctttgccatcatcatgttgaacaccagtctgcacaaccccaatgtcaaagataagcccactgtggagaggttcattgccatgaaccgaggcatcaatgatgggggagacctgccggaggagctcctccggaatctctatgagacgctagcagctgaagccgtgaagatgccggaaagacgcacggggacatgaactcactcagacagactccacgtcca

SEQ ID NO: 76646 - DNA, 724 bp, Homo sapiens
cggaggagaaaaagaaacctggctgggcagagggcaggctggtagtcccacactttgggaggctgacgcaggcagatcatttgagcccaagagtttgagactagcctgggcaacacagtgagcatggtggcatgcgcctgtggtcccagctacttgggaggctgaggtgggaggatcacttgagcccaggaggcagaggttgcaatgagccgagatagcaccactgcacttcagccttcagacagagagagaccctgtctcaaaaaaaaataaagaaaacctctgttccagggtagaaggagcaaatgagcttggagcttggagccaggttcaggcttcaggtttcagttggcctttcatagttccaccagattatgcctgttgctttcctggataaatctttcaaaaacctgtgtaaatcagtggaaatcatattagtctttcaagcctttccgatggcctgaagtactaaaatggctgtgatggttgacaggaaaaacatgcagaggaacaaacaggtagccatgggcaggaaaaaatttaatatggaccctaaaaaggtaagtgagaaagaagcgggaagtggtccatattagatggggtttttttatagtgctcagatagaccctaaaaacgtttttttccaagcgttacagttcatgttgccgttttgtagagcaaatgttatgcactaagcccttgttcctaaactgtgactccccgg

SEQ ID NO: 76647 - DNA, 3582 bp, Homo sapiens
ggagcagcacacactcggagcgtctgctagggctgcagctctgcgcgtccatctctgcgctctgcgccagccttccccaccgggcccagcgagtttccacctgcagggccggtgctctcagcttttgttttctctggacaccttcttctctacccctgctgtgctggcgcacacatgctgtccttgctccggctctccctgcacctacagctgtgggagctcccggcagcctggtactgtggggtcgctgcacggagccaccatggcctctgacgtggagagctgtgacctgccgaggctttgatgttgctgcccagggctggccaggacactggggccgcaggagaggggactcaccgtggttcccagtgacctgacagcagaggagcgtcaagaactggagaacatccgacggagaaaacaggagctgctggctgacattcagaggctgaaggatgagatagcagaagtagctaatgaaattgaaaacctgggatccacagaggaaaggaaaaacatgcagaggaacaaacaggtagccatgggcaggaaaaaatttaatatggaccctaaaaaggggatccagttcttaatagagaacgacctcctgaagaacacttgtgaagacattgcccagttcttatataaaggcgaagggctcaacaagacagccatcggcgactacctaggggagagagatgagtttaatatccaggttcttcatgcatttgtggagctgcatgagttcactgatcttaatctcgtccaggcactacggcagttcctgtggagcttccggctacccggagaggcccagaagatcgaccggatgatggaggcgtttgcccagcgatattgtcagtgcaataatggcgtgttccagtccacggatacttgttacgtcctctcctttgccatcatcatgttgaacaccagtctgcacaaccccaatgtcaaagataagcccactgtggagaggttcattgccatgaaccgaggcatcaatgatgggggagacctgccggaggagctcctccggaatctctatgagagcataaaaaatgaaccctttaaaatcccagaagacgacgggaatgacctcactcacactttcttcaatccagaccgagaaggctggctattgaaactcggaggtggcagggtaaagacttggaagagacgctggttcattctgactgacaactgcctttactactttgagtataccacggataaggagccccgtggaatcatccctttagagaatctgagtatccgggaagtggaggactccaaaaaaccaaactgctttgagctttatatccccgacaataaagaccaagttatcaaggcctgcaagaccgaggctgacgggcgggtggtggaggggaaccacactgtttaccggatctcagctccgacgcccgaggagaaggaggagtggattaagtgcattaaagcagccatcagcagggaccctttctacgaaatgctcgcagcacggaaaaagaaggtctcctccacgaagcgacactgagcgtgcagccaagggcgttggtctgcgggggccttggagctcctgctcttctcccgcacctccatggatgcactgctgccgagcagagcgtcctctgccaggccccgccctggattcctagagactagcttcagcttttgctattttttttaagtgggagaagggtgggcagttatcactggggaagagaggaccggccacctgtccagcatgggctccagagccttcctctctcacagggcagagctcttgtcggcagggcagcctcctggccagtttctctgctcagtgttctggtagcagagctcagagccaactgtttacctcttggttgtccccgtgaagaagccttcaaaccctgcaccataaatacatgtgtccatatattattatatgttaagagaaaaaggtggaaaggaagagaagccacatactataaagatctattttttttttttaagagagaacgtagggctgttcaggtgcattctgccctggctgcgctggggagcttctccctggagaagagcacctggggctgcggccaaggggcatcagcctgggcccgcggcagggcctggcctgcctctcctgtgctgtgggagctcgctgcctggtgcttgtcttggcgagatggacaggtgaggtcgaggacgcagagggcagaggcccagtggagcctcagacggcacagtcagagtcgggggcctgcctggccggggtcgcagtcggcagcagcgtgcagtccggcatctcccgcggatgcttttccatcccaagtgcctgcggagcccgaggagaggagagagctgactggacgcttacgttattttcctccttcagaatccaagttcttgttgggctttaaagtagaaagtcagcattttccttgagctaaatacctaataaccaaaactgtgaggaaggttatcgggacagaggttccggataacctgtttcattttgggttttcttcctcttccccagactccagtcctcgttctagaggaaggagtaggacttccccgatccccgtagcttcagctttttctgcctcaaaaccagccctaactggactactctggatgcattttgtggtgggccccctagagggaagatgggcctttatctgctccgtggggtgcactggagtgaggggggtggccgggctgcctctcgcatctctgtcttcccctgcaggcgctgtgtgagctggccctgcccctcctcattacagtatgaagggagccgtgacacgcagcattttcctgccgttctctcagggactctcagggcagctcctgccactccgccagggccagcatgccagtccaggcagagcaggtggctggctgtctggccgtctcgccccgcccctccacaggaccctggaccagggcggtgcagggcgcagccccgaggaggcaggtggaggagctgcgggttttcacagggccgcgtcgccacggctcctctgatcctttagggttggcgagcatctctggaaatagcttttgcagaggagtggtgggaggaatagagggggacagtctgtcacctccctccccgccactttgtgtagatcctacctggagggaatggctttaggcacttttgtgccagagcttgtgagggtgacagaagagggtccaggctggaaacctgaactttctgggtgggagaaccaggtggtgcctgccgaggtctgggcgtgtttgggccggtgctggagcctgtccagctggcccgggccctggcctggttctcaagtgtttcctagacagagaggcacctgggtcagtattagtctatttatcagaggtgtaaataatctatgtatagtttttctccttttagattattttgtatttgtttaaaagaagttttgtcaaaatacaaaaatataaagaaatgactgaaagttgttgacagggtttttaagaaataattattctaattgtttttgtttgtttgtttttgccttgtaaactagcgccaaggaactgcagcaaataaactccaactctgcccaagcaaaaaaaaaa

SEQ ID NO: 76648 - DNA, 3306 bp, Homo sapiens
gctacgggccgaaggtatttttatgcgagcggcgagccggagcgcggagcccggctcccgcaccatggaggaggacgacagctacgttcccagtgacctgacagcagaggagcgtcaagaactggagaacatccgacggagaaaacaggagctgctggctgacattcagaggctgaaggatgagatagcagaagtagctaatgaaattgaaaacctgggatccacagaggaaaggaaaaacatgcagaggaacaaacaggtagccatgggcaggaaaaaatttaatatggaccctaaaaaggggatccagttcttaatagagaacgacctcctgaagaacacttgtgaagacattgcccagttcttatataaaggcgaagggctcaacaagacagccatcggcgactacctaggggagagagatgagtttaatatccaggttcttcatgcatttgtggagctgcatgagttcactgatcttaatctcgtccaggcactacggcagttcctgtggagcttccggctacccggagaggcccagaagatcgaccggatgatggaggcgtttgcccagcgatattgtcagtgcaataatggcgtgttccagtccacggatacttgttacgtcctctcctttgccatcatcatgttgaacaccagtctgcacaaccccaatgtcaaagataagcccactgtggagaggttcattgccatgaaccgaggcatcaatgatgggggagacctgccggaggagctcctccggaatctctatgagagcataaaaaatgaaccctttaaaatcccagaagacgacgggaatgacctcactcacactttcttcaatccagaccgagaaggctggctattgaaactcggaggtggcagggtaaagacttggaagagacgctggttcattctgactgacaactgcctttactactttgagtataccacggataaggagccccgtggaatcatccctttagagaatctgagtatccgggaagtggaggactccaaaaaaccaaactgctttgagctttatatccccgacaataaagaccaagttatcaaggcctgcaagaccgaggctgacgggcgggtggtggaggggaaccacactgtttaccggatctcagctccgacgcccgaggagaaggaggagtggattaagtgcattaaagcagccatcagcagggaccctttctacgaaatgctcgcagcacggaaaaagaaggtctcctccacgaagcgacactgagcgtgcagccaagggcgttggtctgcgggggccttggagctcctgctcttctcccgcacctccatggatgcactgctgccgagcagagcgtcctctgccaggccccgccctggattcctagagactagcttcagcttttgctattttttttaagtgggagaagggtgggcagttatcactggggaagagaggaccggccacctgtccagcatgggctccagagccttcctctctcacagggcagagctcttgtcggcagggcagcctcctggccagtttctctgctcagtgttctggtagcagagctcagagccaactgtttacctcttggttgtccccgtgaagaagccttcaaaccctgcaccataaatacatgtgtccatatattattatatgttaagagaaaaaggtggaaaggaagagaagccacatactataaagatctattttttttttttaagagagaacgtagggctgttcaggtgcattctgccctggctgcgctggggagcttctccctggagaagagcacctggggctgcggccaaggggcatcagcctgggcccgcggcagggcctggcctgcctctcctgtgctgtgggagctcgctgcctggtgcttgtcttggcgagatggacaggtgaggtcgaggacgcagagggcagaggcccagtggagcctcagacggcacagtcagagtcgggggcctgcctggccggggtcgcagtcggcagcagcgtgcagtccggcatctcccgcggatgcttttccatcccaagtgcctgcggagcccgaggagaggagagagctgactggacgcttacgttattttcctccttcagaatccaagttcttgttgggctttaaagtagaaagtcagcattttccttgagctaaatacctaataaccaaaactgtgaggaaggttatcgggacagaggttccggataacctgtttcattttgggttttcttcctcttccccagactccagtcctcgttctagaggaaggagtaggacttccccgatccccgtagcttcagctttttctgcctcaaaaccagccctaactggactactctggatgcattttgtggtgggccccctagagggaagatgggcctttatctgctccgtggggtgcactggagtgaggggggtggccgggctgcctctcgcatctctgtcttcccctgcaggcgctgtgtgagctggccctgcccctcctcattacagtatgaagggagccgtgacacgcagcattttcctgccgttctctcagggactctcagggcagctcctgccactccgccagggccagcatgccagtccaggcagagcaggtggctggctgtctggccgtctcgccccgcccctccacaggaccctggaccagggcggtgcagggcgcagccccgaggaggcaggtggaggagctgcgggttttcacagggccgcgtcgccacggctcctctgatcctttagggttggcgagcatctctggaaatagcttttgcagaggagtggtgggaggaatagagggggacagtctgtcacctccctccccgccactttgtgtagatcctacctggagggaatggctttaggcacttttgtgccagagcttgtgagggtgacagaagagggtccaggctggaaacctgaactttctgggtgggagaaccaggtggtgcctgccgaggtctgggcgtgtttgggccggtgctggagcctgtccagctggcccgggccctggcctggttctcaagtgtttcctagacagagaggcacctgggtcagtattagtctatttatcagaggtgtaaataatctatgtatagtttttctccttttagattattttgtatttgtttaaaagaagttttgtcaaaatacaaaaatataaagaaatgactgaaagttgttgacagggtttttaagaaataattattctaattgtttttgtttgtttgtttttgccttgtaaactagcgccaaggaactgcagcaaataaactccaactctgcccaagcaaaaaaaaaa

SEQ ID NO: 76649 - DNA, 3423 bp, Homo sapiens
agccattgcctgtctgttcaggaagcagctctgagctgccctagtggctggacagcttcacaggtatccccggcccctcccagtcagaccccacaggaaaacttggctcccagtaagttaccgctctcctggaagcacagaacggacttttcgtgtcccgctgtaaggaaacaagatggtccttaaaaccgaagaggaggacgttcccagtgacctgacagcagaggagcgtcaagaactggagaacatccgacggagaaaacaggagctgctggctgacattcagaggctgaaggatgagatagcagaagtagctaatgaaattgaaaacctgggatccacagaggaaaggaaaaacatgcagaggaacaaacaggtagccatgggcaggaaaaaatttaatatggaccctaaaaaggggatccagttcttaatagagaacgacctcctgaagaacacttgtgaagacattgcccagttcttatataaaggcgaagggctcaacaagacagccatcggcgactacctaggggagagagatgagtttaatatccaggttcttcatgcatttgtggagctgcatgagttcactgatcttaatctcgtccaggcactacggcagttcctgtggagcttccggctacccggagaggcccagaagatcgaccggatgatggaggcgtttgcccagcgatattgtcagtgcaataatggcgtgttccagtccacggatacttgttacgtcctctcctttgccatcatcatgttgaacaccagtctgcacaaccccaatgtcaaagataagcccactgtggagaggttcattgccatgaaccgaggcatcaatgatgggggagacctgccggaggagctcctccggaatctctatgagagcataaaaaatgaaccctttaaaatcccagaagacgacgggaatgacctcactcacactttcttcaatccagaccgagaaggctggctattgaaactcggaggtggcagggtaaagacttggaagagacgctggttcattctgactgacaactgcctttactactttgagtataccacggataaggagccccgtggaatcatccctttagagaatctgagtatccgggaagtggaggactccaaaaaaccaaactgctttgagctttatatccccgacaataaagaccaagttatcaaggcctgcaagaccgaggctgacgggcgggtggtggaggggaaccacactgtttaccggatctcagctccgacgcccgaggagaaggaggagtggattaagtgcattaaagcagccatcagcagggaccctttctacgaaatgctcgcagcacggaaaaagaaggtctcctccacgaagcgacactgagcgtgcagccaagggcgttggtctgcgggggccttggagctcctgctcttctcccgcacctccatggatgcactgctgccgagcagagcgtcctctgccaggccccgccctggattcctagagactagcttcagcttttgctattttttttaagtgggagaagggtgggcagttatcactggggaagagaggaccggccacctgtccagcatgggctccagagccttcctctctcacagggcagagctcttgtcggcagggcagcctcctggccagtttctctgctcagtgttctggtagcagagctcagagccaactgtttacctcttggttgtccccgtgaagaagccttcaaaccctgcaccataaatacatgtgtccatatattattatatgttaagagaaaaaggtggaaaggaagagaagccacatactataaagatctattttttttttttaagagagaacgtagggctgttcaggtgcattctgccctggctgcgctggggagcttctccctggagaagagcacctggggctgcggccaaggggcatcagcctgggcccgcggcagggcctggcctgcctctcctgtgctgtgggagctcgctgcctggtgcttgtcttggcgagatggacaggtgaggtcgaggacgcagagggcagaggcccagtggagcctcagacggcacagtcagagtcgggggcctgcctggccggggtcgcagtcggcagcagcgtgcagtccggcatctcccgcggatgcttttccatcccaagtgcctgcggagcccgaggagaggagagagctgactggacgcttacgttattttcctccttcagaatccaagttcttgttgggctttaaagtagaaagtcagcattttccttgagctaaatacctaataaccaaaactgtgaggaaggttatcgggacagaggttccggataacctgtttcattttgggttttcttcctcttccccagactccagtcctcgttctagaggaaggagtaggacttccccgatccccgtagcttcagctttttctgcctcaaaaccagccctaactggactactctggatgcattttgtggtgggccccctagagggaagatgggcctttatctgctccgtggggtgcactggagtgaggggggtggccgggctgcctctcgcatctctgtcttcccctgcaggcgctgtgtgagctggccctgcccctcctcattacagtatgaagggagccgtgacacgcagcattttcctgccgttctctcagggactctcagggcagctcctgccactccgccagggccagcatgccagtccaggcagagcaggtggctggctgtctggccgtctcgccccgcccctccacaggaccctggaccagggcggtgcagggcgcagccccgaggaggcaggtggaggagctgcgggttttcacagggccgcgtcgccacggctcctctgatcctttagggttggcgagcatctctggaaatagcttttgcagaggagtggtgggaggaatagagggggacagtctgtcacctccctccccgccactttgtgtagatcctacctggagggaatggctttaggcacttttgtgccagagcttgtgagggtgacagaagagggtccaggctggaaacctgaactttctgggtgggagaaccaggtggtgcctgccgaggtctgggcgtgtttgggccggtgctggagcctgtccagctggcccgggccctggcctggttctcaagtgtttcctagacagagaggcacctgggtcagtattagtctatttatcagaggtgtaaataatctatgtatagtttttctccttttagattattttgtatttgtttaaaagaagttttgtcaaaatacaaaaatataaagaaatgactgaaagttgttgacagggtttttaagaaataattattctaattgtttttgtttgtttgtttttgccttgtaaactagcgccaaggaactgcagcaaataaactccaactctgcccaagcaaaaaaaaaa

SEQ ID NO: 76650 - DNA, 3217 bp, Homo sapiens
  misc_feature (10)..(11): n is a, c, g, or t
ggaggcgttnnccagcgatatgtcagtgcaataatggcgtgttccagtccacggacgacagctacgttcccagtgacctgacagcagaggagcgtcaagaactggagaacatccgacggagaaaacaggagctgctggctgacattcagaggctgaaggatgagatagcagaagtagctaatgaaattgaaaacctgggatccacagaggaaaggaaaaacatgcagaggaacaaacaggtagccatgggcaggaaaaaatttaatatggaccctaaaaaggggatccagttcttaatagagaacgacctcctgaagaacacttgtgaagacattgcccagttcttatataaaggcgaagggctcaacaagacagccatcggcgactacctaggggagagagatgagtttaatatccaggttcttcatgcatttgtggagctgcatgagttcactgatcttaatctcgtccaggcactacggcagttcctgtggagcttccggctacccggagaggcccagaagatcgaccggatgatggaggcgtttgccatcatcatgttgaacaccagtctgcacaaccccaatgtcaaagataagcccactgtggagaggttcattgccatgaaccgaggcatcaatgatgggggagacctgccggaggagctcctccggaatctctatgagagcataaaaaatgaaccctttaaaatcccagaagacgacgggaatgacctcactcacactttcttcaatccagaccgagaaggctggctattgaaactcggaggtggcagggtaaagacttggaagagacgctggttcattctgactgacaactgcctttactactttgagtataccacggataaggagccccgtggaatcatccctttagagaatctgagtatccgggaagtggaggactccaaaaaaccaaactgctttgagctttatatccccgacaataaagaccaagttatcaaggcctgcaagaccgaggctgacgggcgggtggtggaggggaaccacactgtttaccggatctcagctccgacgcccgaggagaaggaggagtggattaagtgcattaaagcagccatcagcagggaccctttctacgaaatgctcgcagcacggaaaaagaaggtctcctccacgaagcgacactgagcgtgcagccaagggcgttggtctgcgggggccttggagctcctgctcttctcccgcacctccatggatgcactgctgccgagcagagcgtcctctgccaggccccgccctggattcctagagactagcttcagcttttgctattttttttaagtgggagaagggtgggcagttatcactggggaagagaggaccggccacctgtccagcatgggctccagagccttcctctctcacagggcagagctcttgtcggcagggcagcctcctggccagtttctctgctcagtgttctggtagcagagctcagagccaactgtttacctcttggttgtccccgtgaagaagccttcaaaccctgcaccataaatacatgtgtccatatattattatatgttaagagaaaaaggtggaaaggaagagaagccacatactataaagatctattttttttttttaagagagaacgtagggctgttcaggtgcattctgccctggctgcgctggggagcttctccctggagaagagcacctggggctgcggccaaggggcatcagcctgggcccgcggcagggcctggcctgcctctcctgtgctgtgggagctcgctgcctggtgcttgtcttggcgagatggacaggtgaggtcgaggacgcagagggcagaggcccagtggagcctcagacggcacagtcagagtcgggggcctgcctggccggggtcgcagtcggcagcagcgtgcagtccggcatctcccgcggatgcttttccatcccaagtgcctgcggagcccgaggagaggagagagctgactggacgcttacgttattttcctccttcagaatccaagttcttgttgggctttaaagtagaaagtcagcattttccttgagctaaatacctaataaccaaaactgtgaggaaggttatcgggacagaggttccggataacctgtttcattttgggttttcttcctcttccccagactccagtcctcgttctagaggaaggagtaggacttccccgatccccgtagcttcagctttttctgcctcaaaaccagccctaactggactactctggatgcattttgtggtgggccccctagagggaagatgggcctttatctgctccgtggggtgcactggagtgaggggggtggccgggctgcctctcgcatctctgtcttcccctgcaggcgctgtgtgagctggccctgcccctcctcattacagtatgaagggagccgtgacacgcagcattttcctgccgttctctcagggactctcagggcagctcctgccactccgccagggccagcatgccagtccaggcagagcaggtggctggctgtctggccgtctcgccccgcccctccacaggaccctggaccagggcggtgcagggcgcagccccgaggaggcaggtggaggagctgcgggttttcacagggccgcgtcgccacggctcctctgatcctttagggttggcgagcatctctggaaatagcttttgcagaggagtggtgggaggaatagagggggacagtctgtcacctccctccccgccactttgtgtagatcctacctggagggaatggctttaggcacttttgtgccagagcttgtgagggtgacagaagagggtccaggctggaaacctgaactttctgggtgggagaaccaggtggtgcctgccgaggtctgggcgtgtttgggccggtgctggagcctgtccagctggcccgggccctggcctggttctcaagtgtttcctagacagagaggcacctgggtcagtattagtctatttatcagaggtgtaaataatctatgtatagtttttctccttttagattattttgtatttgtttaaaagaagttttgtcaaaatacaaaaatataaagaaatgactgaaagttgttgacagggtttttaagaaataattattctaattgtttttgtttgtttgtttttgccttgtaaactagcgccaaggaactgcagcaaataaactccaactctgcccaagcaaaaaaaaaa

SEQ ID NO: 76651 - DNA, 454 bp, Homo sapiens
gctacgggccgaaggtatttttatgcgagcggcgagccggagcgcggagcccggctcccgcaccatggaggaggacgacagctacgttcccagtgacctgacagcagaggagcgtcaagaactggagaacatccgacggagaaaacaggagctgctggctgacattcagttttggcagttgtcaatgtttttggagatcacagcgtagttgttttggattttatttttcattactaaattcagattatgttttggggggcaggaattttatagaaattatctttgcagtgcatattatcaataacacataatcaggctttcccaatgtaaaggttttctttccccctttacaattagtaattattttgtggaataaattgtgacactatatgtaatattccattccccatcagattttcagtttatatcagtatgtgtttaaggattcctgtgg

SEQ ID NO: 76652 - DNA, 312 bp, Homo sapiens
ccaagatcacgccactgcactccagcctgggtgacagagtgagactccatctcaaaaaaaaaaagaaaaaaaaaatcattggcagtttaacaattcatagagaaataaattgcctccccaagttctggaacactctgtctttacccactcaggcagttcctgtggagcttccggctacccggagaggcccagaagatcgaccggatgatggaggcgtttgcccagcgatattgtcagtgcaataatggcgtgttccagtccacgggtaaatacgatcattcatcctagtttatgatgggcgttttacactgg

SEQ ID NO: 76653 - DNA, 364 bp, Homo sapiens
tgggatgtttctgaacatctgagcatgcaacggctcccctttgcttttctctcatctttagatacttgttacgtcctctcctttgccatcatcatgttgaacaccagtctgcacaaccccaatgtcaaagataagcccactgtggagaggttcattgccatgaaccgaggcatcaatgatgggggagacctgccggaggagctcctccgggtaagcaaggaagaatggtcttcattcaagtcaagaaagagttcactgggaacaggatcgtcttttgtaggaaggaagaaaaaacatacaatttatcaagggtctcctcttttaatttgtttaaccatgtgaatttcattaagaaagtggtagt

SEQ ID NO: 76654 - DNA, 471 bp, Homo sapiens
ttggccctggtgcggtggctcatgccctgtaatccccaacacttttggaggccaaggtgggcagatcacaaggtcaagagttcaagagactgggagtttcaccatgttggccaggctggtcttgaactcctaacctcagataatctgcccacgttggcctcccaaattgctgggattacaggtgtgagccactgcaacaagccatctgctattttacttttaaaatattggaggctcttatgcatttcacttttatcttctgtattatcagtgttctgtcaatactttcacatgtgatattttgtaaacttacatctggcttatacagtataagttcaaggaataatgattcagaaaagaaaactcagaatttcttccctaagattttataggagctgtaaaactgcaaaggttattgtgaaaattaaagagagcttgagtaatgaaaaaaaaaaaagtcgacgcggccgc

SEQ ID NO: 76655 - DNA, 442 bp, Homo sapiens
tagagaggctgcagtagcgtgagggaaaaggagctgggcgtgtagccagagataaagacactggaagttgcctggagggttttgagcagaggggggtccatgatcaaaattacgtgtcaatggcatgactgtctgcctctttacagaaaggggtaaggtgtagaagctgagaatcacatcggatgagaaaaggtgaacagttggcaaaggaaacagtagaaatctggcaaatctaataaaactttgatggtagtaaaaacaacagtgcctaatatccggtgttaaacagcaacattaacatctagaaccagaataacccaaccgccaaaggagagagagcattattggagataaagaactttgtaccttttgactgaggtatgaagatattggcacttgtttagtgcatgtgtttaaatttttggagaaactactaaaaaaa

SEQ ID NO: 76656 - DNA, 415 bp, Homo sapiens
aattactaagagattagctctcaaatgttctcaccacaaataagtgcgaggtgggtatgttaattagctagatttaatttcacgaggtctatgtacatcaaaccatgtatattgtaaatatatacaatttttattttttaattataaccttaataaaagtgggaggaaaagtgataaacggtaataagcccttaaaggtaataagttaacttgtcacccaacgtatttattaatttttctatacaatgtaatgtgcttggagaacattgaggccgggcacggtggctcatgcttgtaatctcagcactttgggaggccaaggtgggcggatcacttgaggacaggagtttgagaccagcctggccaacatggtgaaaccccatgtctattaaaactacaaaaaaaaatagctgtg

SEQ ID NO: 76657 - DNA, 990 bp, Homo sapiens
cggggatgcatgagaaggtgagctgtcactcacaaaaaaagggaaaatgatttgaaaaatgtttcacatatacactttttatcattttagtggatggcagccttacgtcagtagtatatgccactatgaagtatggccaaaaccctagcgtcacttgtaaccattgtactcttatggatttgtgtcttacaccatttgccttgctttttaaatgactttgtttttcaaggtgctgtcattttgcaaaaggaaatctttatatgaaatgtacaaaaaccgttactaactggacaacagggaaggtgctggccccacattagtgcctgcccaccgctctacttctaaccagggacacggatcttccattctctacatccaccggactgcagcccaagtctggacctggctgcagtgggcatattaccgtatggatatctttttctttctttttttaaagtgaggagattcttcagggggtcaggctgagaatgtaataagcctgacattggaacagatttctcccgtgtggtctagctggacccctccggcatttgccacactccctgccagtcctgacattgacttcctgaatgtgattaggtggtaatgagcaagaatttcctaggatgttgaaacatctgtatccaggcccccaatcaaatgctgctgaatattgtgaatgtttttactccgctcactttcccactgtgctttcctctaaccaaaatatacgtgtagccattaccaatgtacaactctcaatgcggagttgccgccacggtttaaaataaatctctgtgaaaacctttctgcagctatggtcccatcacggttacatgtggccacgcacacaccgacaaccttgctgtgctgtttagccctgtgggttctgtccagttggtgggagggggaggttccagaccactccacctgctgtctagatgccagggagagctgctgtttggaggtgaagatgagccctgttcacca

SEQ ID NO: 76658 - DNA, 457 bp, Homo sapiens
ctcctgcctgaatggctggtgagagatttgaaggcacaggggttgaaggataattattcaaattgtgggattctccagtggatcctagcacatcataactaaaaagcaccaataaatttcctaagttaccacaagggggcagtaacgcccccactgagaatcactgggcaaatggtgtttcttagccttgcaactatggatattttgaattttggatcagagaattatttgttgtgtgtgtgtgtgggtggggagggggcggtgttgaggggagagagtgctgtcctgtgtattttagaatgtttagcagcatcttggactctacccaccagtaacaccagtaatactctacccaccagtaacagccctcctgaccaccagttagggcaaccagaatgtctccagacaccacctcttgttccatggtgggtaaattcacccgcaactgaaatcacca

SEQ ID NO: 76659 - DNA, 316 bp, Homo sapiens
gcctggtggcgcatgcctgtaatcccagctacttaggaggctgaggcaggagaattccttgaacccagaaggtggaggttgcagtgagctgagattgcaccactgcactccagcctaggtgacacagcaagactctgtcaaaaaaaaaaaaaaaagaaatccaaataaaatttccagaatatgtggaaaatagtgccaataaaaatattacacatgtgtaatcccagcattttgagatgccaaggtggcaggatcacttgagaccaggagttcgcaaccagcctggacaacatagggagactccatctccacacac

SEQ ID NO: 76660 - DNA, 510 bp, Homo sapiens
taaatggaaagacatgccatgttcacagattagaagactatttgtctaagatgataataaatattcccaaaattgatctacaagattcaatgtaatcttcattaaagtcccagatgacttctttgcagaaattgagtaactgatcctaaaagtcaagggacttagagtagccaaaacaaccgttaaaaagaacaaattaggtggagccagtttcaaaagtttctacaaagctatagtaatcagtatagcctggtactgccacgaagatgtcacatagttcaatcagataagatttagagtctagacataaaccctttggttaacagtcaattgattttcttttctatatatattttaagcagaaaaggatttatttttatttttatttttttactttaagttctgggatacgtgtgcagaatgtgcaggtttgttacataggtatacgtgtgccatgtggtttgctgcacctattgacctgtcctctaaattccctcagtcagttgattt

SEQ ID NO: 76661 - DNA, 1791 bp, Homo sapiens
ttttttttttgaaaccaaagctgtctcagaaatggccaatttaactttacagtaacaatagacagcacaacacaaactctctcaatacagataaactcacacatactggagatatatatataatagatatatataaaattattttaatgcattgtagtgtaatatttatgcatactatactgtataacatgttattcaaaagggattgccatttctgagacacagtaacaaaaaaatgaggaaattattttgcttctatttatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaatattttgatgatttattttgtttgtaattagttattataagaagatctagatcctagatattagaataaaatttattttctactgtatccatttcaaatgttcaaaatattgtttaatatttttgaaatccctgagtatcaggccttgttataaataagctgcataatcaataaatagaacaagggactttttgttgataatccaaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtttatatttacaaggagttttggtaagggtaatacaatgacagactgagcaaaat

SEQ ID NO: 76662 - DNA, 371 bp, Homo sapiens
aacaggcaggcaatgtgcacagcaattcttagcttgcagcactgagaaggtttctatttccttgattcaactgaaaatgaacaaaaagggtatatgcagtaaaaatgtccctgccatcgattttaaatcccaaaaacaaactcatccaccattcaaaacatactaaagtcttgatttcttgatagttcttgtttgtttgtttttgtagcgacgggggtcttgctatgttgctgaggctggtctcaactcctggtctcaagtaatcctcctgcctcagcctcccaaagcactgggattataggcttgagccactgcatccagcctaaagtcttgattattaagagtacctttataatttacacacactaagc

SEQ ID NO: 76663 - DNA, 516 bp, Homo sapiens
tggtggagttagttagggtctcactgtgttgcccaggctggtctcgaactcctaggcccaagtgatcctcccacctcagcctcccaaagtgctgggattacgactgtgagccactccacccgtccttaaaataattaaaaaaaaaaaaagtctaaggccacattgcctcaataacctccctcttggattctctgcagtgggggagatagctgtctataagcagccctaatttttttttttaaggaaattaatcgtggactaatagaaaattaatcctgactaatatgggattttggatcacataaagctctgttatacaaatacttattactgcctataatcccagcactttgagaggccaaggcaggcagatcatgaggtcaggtttcgagaccagcctgaccaacgtggtgaaaccctgtctctacttaaaatacaaaaattagccaggcgtggtggcacgtgcctgtaatcacagctactcaggaggctgaggcaggataatcgcttgaaccc

SEQ ID NO: 76664 - DNA, 316 bp, Homo sapiens
tcccaaatccatggtcatcctaatcacccccagaagtgatttttttaaacattcaggttgctgtattaaacccaccatgtaatactctgctttataatttctgcctttttactgtatgttttgaagctatttccatcaactcatagcaccctctccaacctccttgttgttattatctattggaacctgggtctctactcacctcttcatactggcttatggctaagactctatctctgttccatttccaatcatctttcatagtgacatcagtatacatgtggcttcttaagtttctcaacatttttaaatttcc

SEQ ID NO: 76665 - DNA, 2018 bp, Homo sapiens
agacgcccagagccgcgcgcgagccggaggagcccagccaggacgccccgcgagacccagcaggctgtggagatattattgcagaccaagaggaagaggcaggtcccagctgtgacaagcatgtccccgggccaggcaagccggctctgtctaaaaagaaccccggcgtggtggcctaccaaggaggcggggaagagatggccagcccggacgaggtggacgacacctatctacaggagttctgggacatgctctcccagaccgaggagcagggacccgagccccaggagggcgcggctaaggtggcagctgcgctggaaaccaaggtggtgcccgagacccccaaagacaccaggtgtgtggaagcggccaaggacgcgtcctcggtcaagcgcaggaggctcaaccggattcccatcgagccccatcctaaggaggagcccaagcacccggagaaggagcagcaggaaggcgtccccaacagcgacgagggctactgggactccaccacgccaggcccagaggaagacagctcgagcagcgggaagaaggcgggcatcccccgggatagctacagcggggacgcgctctatgatctctatgctgacccggacggaagtccagcaacccttcctggagggaaggacaacgaggagacgtcctccctgtcccggttaaagcccgtatctccaggcaccatcacctgtccactgcgaacaccaggcagcttgctgaaggactctaagatccctattagcatcaagcacctgaccaaccttccatctagccatcccgtggtgcaccagcaaccctccaggagtgagatgcccagaacaaaaatcccggtttccaaagtgctggtccgcagagtcagcaaccggggcttggctgggaccaccatcagagcaacggcctgccacgacagtgccaaaaagttgtgaggtcttccaggccaaggtggatgggccccatgccaaggaatacaacttttccctggaaaccactaaagtaagttttgcttttcctaaagaaagtcttttaggacaccacccgtcccccgccctgctccagagcgtggaccgaggaggtctttgtgccctgagcagggaccggataacaccagaaagagggatgctacacgggggtttctcctctcaagataagtccctgagaattattttcaagcacttttttcttttttacctttaagtttttcttccttttgctttaatatactgaacacttggaagtcacctttacttgcctttgcagaaaacagaacttagccaaacctaagtaagagtcatgcctggatattgggataagccagtgtctagaggcctgaaggaaccgctgaagaaccagaggagatctcctcttccaagacacgtttccttccttcccttctttcctctttcctttccagttaaaaaaaaacaaaaacaaaaacaaaaccctttgctgtatcactgtgtggaaaatacctccaaagctgaaagagccaggtatttacctgatgagcagaggggaccactgattggcagaaaacttccctacgttcagttgttagatatgcaaattgataaggatctaacactaggaaaataaaggcgagttttggtttggttggtttccagtcatttgtttggggagatataaaaggctcaggagagcaggcttttgcttttgcttttgtttgtttcttcccccacccagtgcagaaatcaggatcagggaaagattttattaaatgccaatagatacagtatttaagcatttataaactgaaaccttttcatgtgaagataatgcatattttaccgtttatccagctgttaacattttgtaatcagtcaattcaatagaattattctggataattctatatctagaatataaaatctggtcttatagctagacatgatgatggtccccaaaccattgatgttctgttatgtactgtaatgggaagcgattctgattttgttttatatgggttctctggttctcaaaaaaaa

SEQ ID NO: 76666 - DNA, 458 bp, Homo sapiens
ctcagacccgtcggcagatcgtatttgtttgatgttttctgacgtgacttcactgaaaagctttgactctcttacaggctgtggagatattattgcagaccaagaggaagaggcaggtcccagctgtgacaagcatgtccccgggccaggcaagccggctctgtctaaaaagaaccccggcgtggtggcctaccaaggaggcggggaagagatggccagcccggacgaggtggacgacacctatctacaggagttctgggacatgctctcccagaccgaggagcagggacccgagccccaggagggcgcggctaaggtggcagctgcgctggaaaccaaggtggtgcccgagacccccaaagacaccaggtgtgtggaagcggccaaggacgcgtcctcggtcaagcgcaggaggctcaaccggattcccatcgagccccatcctaaggaggagccca

SEQ ID NO: 76667 - DNA, 353 bp, Homo sapiens
ccttaacaccgtagtcaatcaactggatgtttttgttcaaagtcttcatccagctaactttgacctcaatagagaaacatgggagatgactggctgaatagtttatttttcccacaaatgctttagcattatatagacatggatgtagtgtgtcctcaggcatcataaggaactgacaatttttggttttgaaaaatgaactaaacttgtcccgataattttgcctggcactgcaactcaatgaataattcagctaatttacaccacagtcatttgtacattatgagtgtacacgctttgaaagtatttctgtacctttgtcatattgcctattaaatgtgttctgaaaatag

SEQ ID NO: 76668 - DNA, 1047 bp, Homo sapiens
gttaaatattaatgttttgtcctgttctaaatctctgtaaaagcagtattctttctattccttcttttcttaccctgtccccttcaacattctcagcactgcaggagtttgtgaccaagaacttcaagagtcaagacagaaggaagccaagggagcagtgcaatggatttctcagtaaaggtagacatagagaaggaggtgacctgccccatctgcctggagctcctgacagaacctctgagcctagattgtggccacagcttctgccaagcctgcatcactgcaaagatcaaggagtcagtgatcatctcaagaggggaaagcagctgtcctgtgtgtcagaccagattccagcctgggaacctccgacctaatcggcatctggccaacatagttgagagagtcaaagaggtcaagatgagcccacaggaggggcagaagagagatgtctgtgagcaccacggaaaaaaactccagatcttctgtaaggaggatggaaaagtcatttgctgggtttgtgaactgtctcaggaacaccaaggtcaccaaacattccgcataaacgaggtggtcaaggaatgtcaggtaggctccaagatagaggaagagagagcagagagcagaagatggtacctaatgtgaaatctccactttttttgtcctgctttattccccttgtcaccatagaacggagagccctgtgatctctttccatactctttgcttagtttctgatgcctgaaggacactgctgcacatcgttttatttaaaaaagagtacaaatttttagcaaggaaaaattgaatgaatggagaattgctttgtaagataagctttcattgcccctccgagaagaatagtatttttgggaacacgtctggttagatgtgggaagagtggcaatgaagggaagtctttccttactgcagggtctgctttttctctaggaaaagaatcaggctactcttgataagaggatggtgacttccatcatccaggaataaagaatacattcatctcctcagattttcccccatgccataggt

SEQ ID NO: 76669 - DNA, 801 bp, Homo sapiens
aagcagtggtatcaacgcagagggcccattacggccgggattgacgtcatgaaaaggagtgaaagctggacattgaagaagccaaaatctgtttccaagaaactaaagagtgtattccgagtaccagatctgagtgggatgctgcaagttcttaaagagctgacagatgtccagtactactgggtctaccatcagagaatactacaaacacctctatggaaataaactagaaaatctagaagaaatggataaattcctcgacacatacaccctcccaagactaaaccaggaagaagttgaatctctgaatagaccaataacaggagctgaaattgtggcaataatcaatagcttaccaaccaaaaagagtccaggaccagaaggattcacagctgaattctaccagaggtacaaggaggaactggtaccattccttctgaaactattccaatcaatagaaaaagagggaaacctccctaactcattttatgaggccagcatcatgctgataccaaagccgggcagagacacaaccaaaaaaacaacaacaaaacaaacacaaaaaacaaaacctttgtgggacgacttggggcctctgaaaaaagatttttttaacaccactttcgttgggcgaccccgcgggcccccatgaggattagcgttgacactgtggctcaataagcgtgtcacctgaagaaaaactccgtgctagcacatcagggcggtgagatttctctaccccatatgatagaaacggccgcggggggagacccggcgtgttttctgagaccaacattctgt

SEQ ID NO: 76670 - DNA, 314 bp, Homo sapiens
tctgcctcctgggttcaagcgattctgctgcctcagcctcccaagtagctgggattacaggcgtgtgccaccacgcttggctaatttttatagtcttacaccctgtatttcttaagggtcctactaacctctgactatcaacacaagttccgtttgatatcgacacaagtttcattttcaatatgtctcttctcaatgctgtaagacacacctatcccatatccttcacttgacttggtaattttttctacagtggagcaatggagtgtgcatacatttggaaaactgtggatcagtcactaactgaccagtca

SEQ ID NO: 76671 - DNA, 2920 bp, Homo sapiens
actcagctcctgtggggaaactcatttgtggagaccagccctctggcttggtgagtgaatctggtttacaccggctcctgccctgccttcactcttctcccctgattcaagactcctctgctttggactgaagcactgcaggagtttgtgaccaagaacttcaagagtcaagacagaaggaagccaagggagcagtgcaatggatttctcagtaaaggtagacatagagaaggaggtgacctgccccatctgcctggagctcctgacagaacctctgagcctagattgtggccacagcttctgccaagcctgcatcactgcaaagatcaaggagtcagtgatcatctcaagaggggaaagcagctgtcctgtgtgtcagaccagattccagcctgggaacctccgacctaatcggcatctggccaacatagttgagagagtcaaagaggtcaagatgagcccacaggaggggcagaagagagatgtctgtgagcaccacggaaaaaaactccagatcttctgtaaggaggatggaaaagtcatttgctgggtttgtgaactgtctcaggaacaccaaggtcaccaaacattccgcataaacgaggtggtcaaggaatgtcaggaaaagctgcaggtagccctgcagaggctgataaaggagaatcaagaggctgagaagctggaagatgacatcagacaagagagaaccgcctggaagaattatatccagatcgagagacagaagattctgaaagggttcaatgaaatgagagtcatcttggacaatgaggagcagagagagctgcaaaagctggaggaaggtgaggtgaatgtgctggataacctggcagcagctacagaccagctggtccagcagaggcaggatgccagcacgctcatctcagatctccagcggaggttgacgggatcgtcagtagagatgctgcaggatgtgattgacgtcatgaaaaggagtgaaagctggacattgaagaagccaaaatctgtttccaagaaactaaagagtgtattccgagtaccagatctgagtgggatgctgcaagttcttaaagagctgacagatgtccagtactactgggtggacgtgatgctgaatccaggcagtgccacttcgaatgttgctatttctgtggatcagagacaagtgaaaactgtacgcacctgcacatttaagaattcaaatccatgtgatttttctgcttttggtgtcttcggctgccaatatttctcttcggggaaatattactgggaagtagatgtgtctggaaagattgcctggatcctgggcgtacacagtaaaataagtagtctgaataaaaggaagagctctgggtttgcttttgatccaagtgtaaattattcaaaagtttactccagatatagacctcaatatggctactgggttataggattacagaatacatgtgaatataatgcttttgaggactcctcctcttctgatcccaaggttttgactctctttatggctgtgcctccctgtcgtattggggttttcctagactatgaggcaggcattgtctcatttttcaatgtcacaaaccacggagcactcatctacaagttctctggatgtcgcttttctcgacctgcttatccgtatttcaatccttggaactgcctagtccccatgactgtgtgcccaccgagctcctgagtgttctcattcctttacccacttctgcatagtagcccttgtgctgagactcagattctgcacctgagttcatctctactgagaccatctcttcctttctttccccttcttttacttagaatgtctttgtattcatttgctagggcttccatagcaaagcatcatagattgctgatttaaactgtaattgtattgccgtactgtgggctggaaatcccaaatctagattccagcagagttggttctttctgaggtctgcaaggaagggctctgttccatgcctctctccttggcttgtagaaggcatcttgtccctatgactcttcacattgtctttatgtacatctctgtgcccaagttttccctttttattaagacaccagtcatactggctcagggcccaccgctaatgccttaatgaaatcattttaacattatattctctacaaagaccttatttccaaataagataatatttggaggtattgggaataaaaactccaacatataaatttgaggaaggcacgatttcactcataacaatcttaccctttcttgcaagagatgcttgtacattattttcctaataccttggtttcactagtagtaaacattattattttttttatatttgcaaaggaaacatatctaatccttcctatagaaagaacagtattgctgtaattccttttcttttcttcctcatttcctctgccccttaaaagattgaagaaagagaaacttgtcaactcatatccacgttatctagcaaagtacataagaatctatcactaagtaatgtatccttcagaatgtgttggtttaccagtgacaccccatattcatcacaaaattaaagcaagaagtccatagtaatttatttgctaatagtggatttttaatgctcagagtttctgaggtcaaattttatcttttcacttacaagctctatgatcttaaataatttacttaatgtattttggtgtattttcctcaaattaatattggtgttcaagactatatctaattcctctgatcactttgagaaacaaacttttattaaatgtaaggcacttttctatgaattttaaatataaaaataaatattgttctgattattactgaaaagatgtcagccatttcaatgtcttgggaaacaattttttgtttttgttctgttttctttttgcttcaataaaacaatagctggctctaaaaaaaaaa

SEQ ID NO: 76672 - DNA, 2916 bp, Homo sapiens
ggctggtactggtcccgaatcctcttagatccagccctctggcttggtgagtgaatctggtttacaccggctcctgccctgccttcactcttctcccctgattcaagactcctctgctttggactgaagcactgcaggagtttgtgaccaagaacttcaagagtcaagacagaaggaagccaagggagcagtgcaatggatttctcagtaaaggtagacatagagaaggaggtgacctgccccatctgcctggagctcctgacagaacctctgagcctagattgtggccacagcttctgccaagcctgcatcactgcaaagatcaaggagtcagtgatcatctcaagaggggaaagcagctgtcctgtgtgtcagaccagattccagcctgggaacctccgacctaatcggcatctggccaacatagttgagagagtcaaagaggtcaagatgagcccacaggaggggcagaagagagatgtctgtgagcaccacggaaaaaaactccagatcttctgtaaggaggatggaaaagtcatttgctgggtttgtgaactgtctcaggaacaccaaggtcaccaaacattccgcataaacgaggtggtcaaggaatgtcaggaaaagctgcaggtagccctgcagaggctgataaaggagaatcaagaggctgagaagctggaagatgacatcagacaagagagaaccgcctggaagaattatatccagatcgagagacagaagattctgaaagggttcaatgaaatgagagtcatcttggacaatgaggagcagagagagctgcaaaagctggaggaaggtgaggtgaatgtgctggataacctggcagcagctacagaccagctggtccagcagaggcaggatgccagcacgctcatctcagatctccagcggaggttgacgggatcgtcagtagagatgctgcaggatgtgattgacgtcatgaaaaggagtgaaagctggacattgaagaagccaaaatctgtttccaagaaactaaagagtgtattccgagtaccagatctgagtgggatgctgcaagttcttaaagagctgacagatgtccagtactactgggtggacgtgatgctgaatccaggcagtgccacttcgaatgttgctatttctgtggatcagagacaagtgaaaactgtacgcacctgcacatttaagaattcaaatccatgtgatttttctgcttttggtgtcttcggctgccaatatttctcttcggggaaatattactgggaagtagatgtgtctggaaagattgcctggatcctgggcgtacacagtaaaataagtagtctgaataaaaggaagagctctgggtttgcttttgatccaagtgtaaattattcaaaagtttactccagatatagacctcaatatggctactgggttataggattacagaatacatgtgaatataatgcttttgaggactcctcctcttctgatcccaaggttttgactctctttatggctgtgcctccctgtcgtattggggttttcctagactatgaggcaggcattgtctcatttttcaatgtcacaaaccacggagcactcatctacaagttctctggatgtcgcttttctcgacctgcttatccgtatttcaatccttggaactgcctagtccccatgactgtgtgcccaccgagctcctgagtgttctcattcctttacccacttctgcatagtagcccttgtgctgagactcagattctgcacctgagttcatctctactgagaccatctcttcctttctttccccttcttttacttagaatgtctttgtattcatttgctagggcttccatagcaaagcatcatagattgctgatttaaactgtaattgtattgccgtactgtgggctggaaatcccaaatctagattccagcagagttggttctttctgaggtctgcaaggaagggctctgttccatgcctctctccttggcttgtagaaggcatcttgtccctatgactcttcacattgtctttatgtacatctctgtgcccaagttttccctttttattaagacaccagtcatactggctcagggcccaccgctaatgccttaatgaaatcattttaacattatattctctacaaagaccttatttccaaataagataatatttggaggtattgggaataaaaactccaacatataaatttgaggaaggcacgatttcactcataacaatcttaccctttcttgcaagagatgcttgtacattattttcctaataccttggtttcactagtagtaaacattattattttttttatatttgcaaaggaaacatatctaatccttcctatagaaagaacagtattgctgtaattccttttcttttcttcctcatttcctctgccccttaaaagattgaagaaagagaaacttgtcaactcatatccacgttatctagcaaagtacataagaatctatcactaagtaatgtatccttcagaatgtgttggtttaccagtgacaccccatattcatcacaaaattaaagcaagaagtccatagtaatttatttgctaatagtggatttttaatgctcagagtttctgaggtcaaattttatcttttcacttacaagctctatgatcttaaataatttacttaatgtattttggtgtattttcctcaaattaatattggtgttcaagactatatctaattcctctgatcactttgagaaacaaacttttattaaatgtaaggcacttttctatgaattttaaatataaaaataaatattgttctgattattactgaaaagatgtcagccatttcaatgtcttgggaaacaattttttgtttttgttctgttttctttttgcttcaataaaacaatagctggctctaaaaaaaaaa

SEQ ID NO: 76673 - DNA, 2821 bp, Homo sapiens
actcagctcctgtggggaaactcatttgtggagaccagccctctggcttggtgagtgaatctggtttacaccggctcctgccctgccttcactcttctcccctgattcaagactcctctgctttggactgaagcactgcaggagtttgtgaccaagaacttcaagagtcaagacagaaggaagccaagggagcagtgcaatggatttctcagtaaaggtagacatagagaaggaggtgacctgccccatctgcctggagctcctgacagaacctctgagcctagattgtggccacagcttctgccaagcctgcatcactgcaaagatcaaggagtcagtgatcatctcaagaggggaaagcagctgtcctgtgtgtcagaccagattccagcctgggaacctccgacctaatcggcatctggccaacatagttgagagagtcaaagaggtcaagatgagcccacaggaggggcagaagagagatgtctgtgagcaccacggaaaaaaactccagatcttctgtaaggaggatggaaaagtcatttgctgggtttgtgaactgtctcaggaacaccaaggtcaccaaacattccgcataaacgaggtggtcaaggaatgtcaggaaaagctgcaggtagccctgcagaggctgataaaggagaatcaagaggctgagaagctggaagatgacatcagacaagagagaaccgcctggaagaattatatccagatcgagagacagaagattctgaaagggttcaatgaaatgagagtcatcttggacaatgaggagcagagagagctgcaaaagctggaggaaggtgaggtgaatgtgctggataacctggcagcagctacagaccagctggtccagcagaggcaggatgccagcacgctcatctcagatctccagcggaggttgacgggatcgtcagtagagatgctgcaggatgtgattgacgtcatgaaaaggagtgaaagctggacattgaagaagccaaaatctgtttccaagaaactaaagagtgtattccgagtaccagatctgagtgggatgctgcaagttcttaaagagctgacagatgtccagtactactgggtggacgtgatgctgaatccaggcagtgccacttcgaatgttgctatttctgtggatcagagacaagtgaaaactgtacgcacctgcacatttaagaattcaaatccatgtgatttttctgcttttggtgtcttcggctgccaatatttctcttcggggaaatattactgggaagtagatgtgtctggaaagattgcctggatcctgggcgtacacagtaaaataagtagtctgaataaaaggaagagctctgggtttgcttttgatccaagtgtaaattattcaaaagtttactccagatatagacctcaatatggctactgggttataggattacagaatacatgtgaatataatgcttttgaggactcctcctcttctgatcccaaggttttgactctctttatggctgtgcctccctgtcgtattggggttttcctagactatgaggcaggcattgtctcatttttcaatgtcacaaaccacggagcactcatctacaagttctctggatgtcgcttttctcgacctgcttatccgtatttcaatccttggaactgcctagtccccatgactgtgtgcccaccgagctcctgagtgttctcattcctttacccacttctgcatagtagcccttgtgctgagactcagattctgcacctgagttcatctctactgagaccatctcttcctttctttccccttcttttacttagaatgtctttgtattcatttgctagggcttccatagcaaagcatcatagattgctgatttaaactgtaattgtattgccgtactgtgggctggaaatcccaaatctagattccagcagagttggttctttctgaggtctgcaaggaagggctctgttccatgcctctctccttggcttgtagaaggcatcttgtccctatgactcttcacattgtctttatgtacatctctgtgcccaagttttccctttttattaagacaccagtcatactggctcagggcccaccgctaatgccttaatgaaatcattttaacattatattctctacaaagaccttatttccaaataagataatatttggaggtattgggaataaaaactccaacatataaatttgaggaaggcacgatttcactcataacaatcttaccctttcttgcaagagatgcttgtacattattttcctaataccttggtttcactagtagtaaacattattattttttttatatttgcaaaggaaacatatctaatccttcctatagaaagaacagtattgctgtaattccttttcttttcttcctcatttcctctgccccttaaaagattgaagaaagagaaacttgtcaactcatatccacgttatctagcaaagtacataagaatctatcactaagtaatgtatccttcagaatgtgttggtttaccagtgacaccccatattcatcacaaaattaaagcaagaagtccatagtaatttatttgctaatagtggatttttaatgctcagagtttctgaggtcaaattttatcttttcacttacaagctctatgatcttaaataatttacttaatgtattttggtgtattttcctcaaattaatattggtgttcaagactatatctaattcctctgatcactttgagaaacaaacttttattaaatgtaaggcacttttctatgaattttaaatataaaaataaatattgttctgattattactga

SEQ ID NO: 76674 - DNA, 2784 bp, Homo sapiens
gttaaatattaatgttttgtcctgttctaaatctctgtaaaagcagtattctttctattccttcttttcttaccctgtccccttcaacattctcagcactgcaggagtttgtgaccaagaacttcaagagtcaagacagaaggaagccaagggagcagtgcaatggatttctcagtaaaggtagacatagagaaggaggtgacctgccccatctgcctggagctcctgacagaacctctgagcctagattgtggccacagcttctgccaagcctgcatcactgcaaagatcaaggagtcagtgatcatctcaagaggggaaagcagctgtcctgtgtgtcagaccagattccagcctgggaacctccgacctaatcggcatctggccaacatagttgagagagtcaaagaggtcaagatgagcccacaggaggggcagaagagagatgtctgtgagcaccacggaaaaaaactccagatcttctgtaaggaggatggaaaagtcatttgctgggtttgtgaactgtctcaggaacaccaaggtcaccaaacattccgcataaacgaggtggtcaaggaatgtcaggaaaagctgcaggtagccctgcagaggctgataaaggagaatcaagaggctgagaagctggaagatgacatcagacaagagagaaccgcctggaagaattatatccagatcgagagacagaagattctgaaagggttcaatgaaatgagagtcatcttggacaatgaggagcagagagagctgcaaaagctggaggaaggtgaggtgaatgtgctggataacctggcagcagctacagaccagctggtccagcagaggcaggatgccagcacgctcatctcagatctccagcggaggttgacgggatcgtcagtagagatgctgcaggatgtgattgacgtcatgaaaaggagtgaaagctggacattgaagaagccaaaatctgtttccaagaaactaaagagtgtattccgagtaccagatctgagtgggatgctgcaagttcttaaagagctgacagatgtccagtactactgggtggacgtgatgctgaatccaggcagtgccacttcgaatgttgctatttctgtggatcagagacaagtgaaaactgtacgcacctgcacatttaagaattcaaatccatgtgatttttctgcttttggtgtcttcggctgccaatatttctcttcggggaaatattactgggaagtagatgtgtctggaaagattgcctggatcctgggcgtacacagtaaaataagtagtctgaataaaaggaagagctctgggtttgcttttgatccaagtgtaaattattcaaaagtttactccagatatagacctcaatatggctactgggttataggattacagaatacatgtgaatataatgcttttgaggactcctcctcttctgatcccaaggttttgactctctttatggctgtgcctccctgtcgtattggggttttcctagactatgaggcaggcattgtctcatttttcaatgtcacaaaccacggagcactcatctacaagttctctggatgtcgcttttctcgacctgcttatccgtatttcaatccttggaactgcctagtccccatgactgtgtgcccaccgagctcctgagtgttctcattcctttacccacttctgcatagtagcccttgtgctgagactcagattctgcacctgagttcatctctactgagaccatctcttcctttctttccccttcttttacttagaatgtctttgtattcatttgctagggcttccatagcaaagcatcatagattgctgatttaaactgtaattgtattgccgtactgtgggctggaaatcccaaatctagattccagcagagttggttctttctgaggtctgcaaggaagggctctgttccatgcctctctccttggcttgtagaaggcatcttgtccctatgactcttcacattgtctttatgtacatctctgtgcccaagttttccctttttattaagacaccagtcatactggctcagggcccaccgctaatgccttaatgaaatcattttaacattatattctctacaaagaccttatttccaaataagataatatttggaggtattgggaataaaaactccaacatataaatttgaggaaggcacgatttcactcataacaatcttaccctttcttgcaagagatgcttgtacattattttcctaataccttggtttcactagtagtaaacattattattttttttatatttgcaaaggaaacatatctaatccttcctatagaaagaacagtattgctgtaattccttttcttttcttcctcatttcctctgccccttaaaagattgaagaaagagaaacttgtcaactcatatccacgttatctagcaaagtacataagaatctatcactaagtaatgtatccttcagaatgtgttggtttaccagtgacaccccatattcatcacaaaattaaagcaagaagtccatagtaatttatttgctaatagtggatttttaatgctcagagtttctgaggtcaaattttatcttttcacttacaagctctatgatcttaaataatttacttaatgtattttggtgtattttcctcaaattaatattggtgttcaagactatatctaattcctctgatcactttgagaaacaaacttttattaaatgtaaggcacttttctatgaattttaaatataaaaataaatattgttctgattattactga

SEQ ID NO: 76675 - DNA, 2737 bp, Homo sapiens
  misc_feature (10)..(10): n is a, c, g, or t
ctcgatcatntcggctatgggatcaagactcctctgctttggactgaagcactgcaggagtttgtgaccaagaacttcaagagtcaagacagaaggaagccaagggagcagtgcaatggatttctcagtaaaggtagacatagagaaggaggtgacctgccccatctgcctggagctcctgacagaacctctgagcctagattgtggccacagcttctgccaagcctgcatcactgcaaagatcaaggagtcagtgatcatctcaagaggggaaagcagctgtcctgtgtgtcagaccagattccagcctgggaacctccgacctaatcggcatctggccaacatagttgagagagtcaaagaggtcaagatgagcccacaggaggggcagaagagagatgtctgtgagcaccacggaaaaaaactccagatcttctgtaaggaggatggaaaagtcatttgctgggtttgtgaactgtctcaggaacaccaaggtcaccaaacattccgcataaacgaggtggtcaaggaatgtcaggaaaagctgcaggtagccctgcagaggctgataaaggagaatcaagaggctgagaagctggaagatgacatcagacaagagagaaccgcctggaagaattatatccagatcgagagacagaagattctgaaagggttcaatgaaatgagagtcatcttggacaatgaggagcagagagagctgcaaaagctggaggaaggtgaggtgaatgtgctggataacctggcagcagctacagaccagctggtccagcagaggcaggatgccagcacgctcatctcagatctccagcggaggttgacgggatcgtcagtagagatgctgcaggatgtgattgacgtcatgaaaaggagtgaaagctggacattgaagaagccaaaatctgtttccaagaaactaaagagtgtattccgagtaccagatctgagtgggatgctgcaagttcttaaagagctgacagatgtccagtactactgggtggacgtgatgctgaatccaggcagtgccacttcgaatgttgctatttctgtggatcagagacaagtgaaaactgtacgcacctgcacatttaagaattcaaatccatgtgatttttctgcttttggtgtcttcggctgccaatatttctcttcggggaaatattactgggaagtagatgtgtctggaaagattgcctggatcctgggcgtacacagtaaaataagtagtctgaataaaaggaagagctctgggtttgcttttgatccaagtgtaaattattcaaaagtttactccagatatagacctcaatatggctactgggttataggattacagaatacatgtgaatataatgcttttgaggactcctcctcttctgatcccaaggttttgactctctttatggctgtgcctccctgtcgtattggggttttcctagactatgaggcaggcattgtctcatttttcaatgtcacaaaccacggagcactcatctacaagttctctggatgtcgcttttctcgacctgcttatccgtatttcaatccttggaactgcctagtccccatgactgtgtgcccaccgagctcctgagtgttctcattcctttacccacttctgcatagtagcccttgtgctgagactcagattctgcacctgagttcatctctactgagaccatctcttcctttctttccccttcttttacttagaatgtctttgtattcatttgctagggcttccatagcaaagcatcatagattgctgatttaaactgtaattgtattgccgtactgtgggctggaaatcccaaatctagattccagcagagttggttctttctgaggtctgcaaggaagggctctgttccatgcctctctccttggcttgtagaaggcatcttgtccctatgactcttcacattgtctttatgtacatctctgtgcccaagttttccctttttattaagacaccagtcatactggctcagggcccaccgctaatgccttaatgaaatcattttaacattatattctctacaaagaccttatttccaaataagataatatttggaggtattgggaataaaaactccaacatataaatttgaggaaggcacgatttcactcataacaatcttaccctttcttgcaagagatgcttgtacattattttcctaataccttggtttcactagtagtaaacattattattttttttatatttgcaaaggaaacatatctaatccttcctatagaaagaacagtattgctgtaattccttttcttttcttcctcatttcctctgccccttaaaagattgaagaaagagaaacttgtcaactcatatccacgttatctagcaaagtacataagaatctatcactaagtaatgtatccttcagaatgtgttggtttaccagtgacaccccatattcatcacaaaattaaagcaagaagtccatagtaatttatttgctaatagtggatttttaatgctcagagtttctgaggtcaaattttatcttttcacttacaagctctatgatcttaaataatttacttaatgtattttggtgtattttcctcaaattaatattggtgttcaagactatatctaattcctctgatcactttgagaaacaaacttttattaaatgtaaggcacttttctatgaattttaaatataaaaataaatattgttctgattattactga

SEQ ID NO: 76676 - DNA, 3796 bp, Homo sapiens
actcagctcctgtggggaaactcatttgtggagaccagccctctggcttggtgagtgaatctggtttacaccggctcctgccctgccttcactcttctcccctgattcaagactcctctgctttggactgaagcactgcaggagtttgtgaccaagaacttcaagagtcaagacagaaggaagccaagggagcagtgcaatggatttctcagtaaaggtagacatagagaaggaggtgacctgccccatctgcctggagctcctgacagaacctctgagcctagattgtggccacagcttctgccaagcctgcatcactgcaaagatcaaggagtcagtgatcatctcaagaggggaaagcagctgtcctgtgtgtcagaccagattccagcctgggaacctccgacctaatcggcatctggccaacatagttgagagagtcaaagaggtcaagatgagcccacaggaggggcagaagagagatgtctgtgagcaccacggaaaaaaactccagatcttctgtaaggaggatggaaaagtcatttgctgggtttgtgaactgtctcaggaacaccaaggtcaccaaacattccgcataaacgaggtggtcaaggaatgtcaggaaaagctgcaggtagccctgcagaggctgataaaggagaatcaagaggctgagaagctggaagatgacatcagacaagagagaaccgcctggaaggcaggaggagacacctcctaagggataattagacaggaatctgggcaggaccctgggctctatcacaaggagaccccttcctctttgctgtgctagaattaacaagcatagaagtcatttgattaggtctcaatttaactccttccctgttggagtttaggggctggaaagtagacatatcataaatcaacactatatttggaagtgaaggcatggagggaaatatctgtgaaaacgcttcctgtgaatcctgtgttccatttgtgtcatcaggtttgaggctccaatccttccagtaaacaccctggagaaagacccaggattccctgtttagggggtttcagtagggggatttttttgtttgtttgtttgtttgttttttgagacagagtctctctctgtcatccaggctggagtgtagtggcgcgatcttggctcactgcaacctctgcctccctggttcaaacgattctcctgcctcagcctcccgagtagctgggactacaggcatgtgccaccatgcccagctaattttttgtatttttagtagagatggggtttcatcatgttagccaggatggtctcaatctcctgaccttgtgatccacccatctcagcctcccaaagtgctgggattacaggcatgagccactgtgccaggccaggtagagggatttaagacacagaaaggcaaagttgttcaggacaggtgtctacaatccaagcctcacccaggcatcacattttgtctcagattaggcctcaataaaactgacttgagtgtattgctttgggaggagctcaggttaaaaagtagaaaaacatggcttcaccagaaattgtgtattggcttttgcctcctattccttttgagaactccctgaggaaaactgttcttatcctgtctcccaggctcatacaaagcaggccttcaaccagccagactgactgcctctttctcttttcattcccaagaattatatccagatcgagagacagaagattctgaaagggttcaatgaaatgagagtcatcttggacaatgaggagcagagagagctgcaaaagctggaggaaggtgaggtgaatgtgctggataacctggcagcagctacagaccagctggtccagcagaggcaggatgccagcacgctcatctcagatctccagcggaggttgacgggatcgtcagtagagatgctgcaggatgtgattgacgtcatgaaaaggagtgaaagctggacattgaagaagccaaaatctgtttccaagaaactaaagagtgtattccgagtaccagatctgagtgggatgctgcaagttcttaaagagctgacagatgtccagtactactgggtggacgtgatgctgaatccaggcagtgccacttcgaatgttgctatttctgtggatcagagacaagtgaaaactgtacgcacctgcacatttaagaattcaaatccatgtgatttttctgcttttggtgtcttcggctgccaatatttctcttcggggaaatattactgggaagtagatgtgtctggaaagattgcctggatcctgggcgtacacagtaaaataagtagtctgaataaaaggaagagctctgggtttgcttttgatccaagtgtaaattattcaaaagtttactccagatatagacctcaatatggctactgggttataggattacagaatacatgtgaatataatgcttttgaggactcctcctcttctgatcccaaggttttgactctctttatggctgtgcctccctgtcgtattggggttttcctagactatgaggcaggcattgtctcatttttcaatgtcacaaaccacggagcactcatctacaagttctctggatgtcgcttttctcgacctgcttatccgtatttcaatccttggaactgcctagtccccatgactgtgtgcccaccgagctcctgagtgttctcattcctttacccacttctgcatagtagcccttgtgctgagactcagattctgcacctgagttcatctctactgagaccatctcttcctttctttccccttcttttacttagaatgtctttgtattcatttgctagggcttccatagcaaagcatcatagattgctgatttaaactgtaattgtattgccgtactgtgggctggaaatcccaaatctagattccagcagagttggttctttctgaggtctgcaaggaagggctctgttccatgcctctctccttggcttgtagaaggcatcttgtccctatgactcttcacattgtctttatgtacatctctgtgcccaagttttccctttttattaagacaccagtcatactggctcagggcccaccgctaatgccttaatgaaatcattttaacattatattctctacaaagaccttatttccaaataagataatatttggaggtattgggaataaaaactccaacatataaatttgaggaaggcacgatttcactcataacaatcttaccctttcttgcaagagatgcttgtacattattttcctaataccttggtttcactagtagtaaacattattattttttttatatttgcaaaggaaacatatctaatccttcctatagaaagaacagtattgctgtaattccttttcttttcttcctcatttcctctgccccttaaaagattgaagaaagagaaacttgtcaactcatatccacgttatctagcaaagtacataagaatctatcactaagtaatgtatccttcagaatgtgttggtttaccagtgacaccccatattcatcacaaaattaaagcaagaagtccatagtaatttatttgctaatagtggatttttaatgctcagagtttctgaggtcaaattttatcttttcacttacaagctctatgatcttaaataatttacttaatgtattttggtgtattttcctcaaattaatattggtgttcaagactatatctaattcctctgatcactttgagaaacaaacttttattaaatgtaaggcacttttctatgaattttaaatataaaaataaatattgttctgattattactga

SEQ ID NO: 76677 - DNA, 2760 bp, Homo sapiens
actcagctcctgtggggaaactcatttgtggagaccagccctctggcttggtgagtgaatctggtttacaccggctcctgccctgccttcactcttctcccctgattcaagactcctctgctttggactgaagcactgcaggagtttgtgaccaagaacttcaagagtcaagacagaaggaagccaagggagcagtgcaatggatttctcagtaaaggtagacatagagaaggaggtgacctgccccatctgcctggagctcctgacagaacctctgagcctagattgtggccacagcttctgccaagcctgcatcactgcaaagatcaaggagtcagtgatcatctcaagaggggaaagcagctgtcctgtgtgtcagaccagattccagcctgggaacctccgacctaatcggcatctggccaacatagttgagagagtcaaagaggtcaagatgagcccacaggaggggcagaagagagatgtctgtgagcaccacggaaaaaaactccagatcttctgtaaggaggatggaaaagtcatttgctgggtttgtgaactgtctcaggaacaccaaggtcaccaaacattccgcataaacgaggtggtcaaggaatgtcaggaaaagctgcaggtagccctgcagaggctgataaaggagaatcaagaggctgagaagctggaagatgacatcagacaagagagaaccgcctggaagaattatatccagatcgagagacagaagattctgaaagggttcaatgaaatgagagtcatcttggacaatgaggagcagagagagctgcaaaagctggaggaaggatgccagcacgctcatctcagatctccagcggaggttgacgggatcgtcagtagagatgctgcaggttatcaatttttgttatcactaggagtgaaagctggacattgaagaagccaaaatctgtttccaagaaactaaagagtgtattccgagtaccagatctgagtgggatgctgcaagttcttaaagagctgacagatgtccagtactactgggtggacgtgatgctgaatccaggcagtgccacttcgaatgttgctatttctgtggatcagagacaagtgaaaactgtacgcacctgcacatttaagaattcaaatccatgtgatttttctgcttttggtgtcttcggctgccaatatttctcttcggggaaatattactgggaagtagatgtgtctggaaagattgcctggatcctgggcgtacacagtaaaataagtagtctgaataaaaggaagagctctgggtttgcttttgatccaagtgtaaattattcaaaagtttactccagatatagacctcaatatggctactgggttataggattacagaatacatgtgaatataatgcttttgaggactcctcctcttctgatcccaaggttttgactctctttatggctgtgcctccctgtcgtattggggttttcctagactatgaggcaggcattgtctcatttttcaatgtcacaaaccacggagcactcatctacaagttctctggatgtcgcttttctcgacctgcttatccgtatttcaatccttggaactgcctagtccccatgactgtgtgcccaccgagctcctgagtgttctcattcctttacccacttctgcatagtagcccttgtgctgagactcagattctgcacctgagttcatctctactgagaccatctcttcctttctttccccttcttttacttagaatgtctttgtattcatttgctagggcttccatagcaaagcatcatagattgctgatttaaactgtaattgtattgccgtactgtgggctggaaatcccaaatctagattccagcagagttggttctttctgaggtctgcaaggaagggctctgttccatgcctctctccttggcttgtagaaggcatcttgtccctatgactcttcacattgtctttatgtacatctctgtgcccaagttttccctttttattaagacaccagtcatactggctcagggcccaccgctaatgccttaatgaaatcattttaacattatattctctacaaagaccttatttccaaataagataatatttggaggtattgggaataaaaactccaacatataaatttgaggaaggcacgatttcactcataacaatcttaccctttcttgcaagagatgcttgtacattattttcctaataccttggtttcactagtagtaaacattattattttttttatatttgcaaaggaaacatatctaatccttcctatagaaagaacagtattgctgtaattccttttcttttcttcctcatttcctctgccccttaaaagattgaagaaagagaaacttgtcaactcatatccacgttatctagcaaagtacataagaatctatcactaagtaatgtatccttcagaatgtgttggtttaccagtgacaccccatattcatcacaaaattaaagcaagaagtccatagtaatttatttgctaatagtggatttttaatgctcagagtttctgaggtcaaattttatcttttcacttacaagctctatgatcttaaataatttacttaatgtattttggtgtattttcctcaaattaatattggtgttcaagactatatctaattcctctgatcactttgagaaacaaacttttattaaatgtaaggcacttttctatgaattttaaatataaaaataaatattgttctgattattactga

SEQ ID NO: 76678 - DNA, 1978 bp, Homo sapiens
tctgcctcctgggttcaagcgattctgctgcctcagcctcccaagtagctgggattacaggcgtgtgccaccacgcttggctaatttttatagtcttacaccctgtatttcttaagggtcctactaacctctgactatcaacacaagttccgtttgatatcgacacaagtttcattttcaatatgtctcttctcaatgctgtaagacacacctatcccatatccttcacttgacttggtaattttttctacagtggatggacgtgatgctgaatccaggcagtgccacttcgaatgttgctatttctgtggatcagagacaagtgaaaactgtacgcacctgcacatttaagaattcaaatccatgtgatttttctgcttttggtgtcttcggctgccaatatttctcttcggggaaatattactgggaagtagatgtgtctggaaagattgcctggatcctgggcgtacacagtaaaataagtagtctgaataaaaggaagagctctgggtttgcttttgatccaagtgtaaattattcaaaagtttactccagatatagacctcaatatggctactgggttataggattacagaatacatgtgaatataatgcttttgaggactcctcctcttctgatcccaaggttttgactctctttatggctgtgcctccctgtcgtattggggttttcctagactatgaggcaggcattgtctcatttttcaatgtcacaaaccacggagcactcatctacaagttctctggatgtcgcttttctcgacctgcttatccgtatttcaatccttggaactgcctagtccccatgactgtgtgcccaccgagctcctgagtgttctcattcctttacccacttctgcatagtagcccttgtgctgagactcagattctgcacctgagttcatctctactgagaccatctcttcctttctttccccttcttttacttagaatgtctttgtattcatttgctagggcttccatagcaaagcatcatagattgctgatttaaactgtaattgtattgccgtactgtgggctggaaatcccaaatctagattccagcagagttggttctttctgaggtctgcaaggaagggctctgttccatgcctctctccttggcttgtagaaggcatcttgtccctatgactcttcacattgtctttatgtacatctctgtgcccaagttttccctttttattaagacaccagtcatactggctcagggcccaccgctaatgccttaatgaaatcattttaacattatattctctacaaagaccttatttccaaataagataatatttggaggtattgggaataaaaactccaacatataaatttgaggaaggcacgatttcactcataacaatcttaccctttcttgcaagagatgcttgtacattattttcctaataccttggtttcactagtagtaaacattattattttttttatatttgcaaaggaaacatatctaatccttcctatagaaagaacagtattgctgtaattccttttcttttcttcctcatttcctctgccccttaaaagattgaagaaagagaaacttgtcaactcatatccacgttatctagcaaagtacataagaatctatcactaagtaatgtatccttcagaatgtgttggtttaccagtgacaccccatattcatcacaaaattaaagcaagaagtccatagtaatttatttgctaatagtggatttttaatgctcagagtttctgaggtcaaattttatcttttcacttacaagctctatgatcttaaataatttacttaatgtattttggtgtattttcctcaaattaatattggtgttcaagactatatctaattcctctgatcactttgagaaacaaacttttattaaatgtaaggcacttttctatgaattttaaatataaaaataaatattgttctgattattactga

SEQ ID NO: 76679 - DNA, 2683 bp, Homo sapiens
  misc_feature (2415)..(2415): n is a, c, g, or t
  misc_feature (2417)..(2417): n is a, c, g, or t
  misc_feature (2683)..(2683): n is a, c, g, or t
actcagctcctgtggggaaactcatttgtggagaccagccctctggcttggtgagtgaatctggtttacaccggctcctgccctgccttcactcttctcccctgattcaagactcctctgctttggactgaagcactgcaggagtttgtgaccaagaacttcaagagtcaagacagaaggaagccaagggagcagtgcaatggatttctcagtaaaggtagacatagagaaggaggtgacctgccccatctgcctggagctcctgacagaacctctgagcctagattgtggccacagcttctgccaagcctgcatcactgcaaagatcaaggagtcagtgatcatctcaagaggggaaagcagctgtcctgtgtgtcagaccagattccagcctgggaacctccgacctaatcggcatctggccaacatagttgagagagtcaaagaggtcaagatgagcccacaggaggggcagaagagagatgtctgtgagcaccacggaaaaaaactccagatcttctgtaaggaggatggaaaagtcatttgctgggtttgtgaactgtctcaggaacaccaaggtcaccaaacattccgcataaacgaggtggtcaaggaatgtcaggaaaagctgcaggtagccctgcagaggctgataaaggagaatcaagaggctgagaagctggaagatgacatcagacaagagagaaccgcctggaagaattatatccagatcgagagacagaagattctgaaagggttcaatgaaatgagagtcatcttggacaatgaggagcagagagagctgcaaaagctggaggaaggtgaggtgaatgtgctggataacctggcagcagctacagaccagctggtccagcagaggcaggatgccagcacgctcatctcagatctccagcggaggttgacgggatcgtcagtagagatgctgcaggatgtgattgacgtcatgaaaaggagtgaaagctggacattgaagaagccaaaatctgtttccaagaaactaaagagtgtattccgagtaccagatctgagtgggatgctgcaagttcttaaagagctgacagatgtccagtactactgggtggacgtgatgctgaatccaggcagtgccacttcgaatgttgctatttctgtggatcagagacaagtgaaaactgtacgcacctgcacatttaagaattcaaatccatgtgatttttctgcttttggtgtcttcggctgccaatatttctcttcggggaaatattactgggaagtagatgtgtctggaaagattgcctggatcctgggcgtacacagtaaaataagtagtctgaataaaaggaagagctctgggtttgcttttgatccaagtgtaaattattcaaaagtttactccagatatagacctcaatatggctactgggttataggattacagaatacatgtgaatataatgcttttgaggactcctcctcttctgatcccaaggttttgactctctttatggctgtgcctccctgtcgtattggggttttcctagactatgaggcaggcattgtctcatttttcaatgtcacaaaccacggagcactcatctacaagttctctggatgtcgcttttctcgacctgcttatccgtatttcaatccttggaactgcctagtccccatgactgtgtgcccaccgagctcctgagtgttctcattcctttacccacttctgcatagtagcccttgtgctgagactcagattctgcacctgagttcatctctactgagaccatctcttcctttctttccccttcttttacttagaatgtctttgtattcatttgctagggcttccatagcaaagcatcatagattgctgatttaaactgtaattgtattgccgtactgtgggctggaaatcccaaatctagattccagcagagttggttctttctgaggtctgcaaggaagggctctgttccatgcctctctccttggcttgtagaaggcatcttgtccctatgactcttcacattgtctttatgtacatctctgtgcccaagttttccctttttattaagacaccagtcatactggctcagggcccaccgctaatgccttaatgaaatcattttaacattatattctctacaaagaccttatttccaaataagataatatttggaggtattgggaataaaaactccaacatataaatttgaggaaggcacgatttcactcataacaatcttaccctttcttgcaagagatgcttgtacattattttcctaataccttggtttcactagtagtaaacattattattttttttatatttgcaaaggaaacatatctaatccttcctatagaaagaacagtattgctgtaattccttttcttttcttcctcatttcctctgccctnanagattgagaagaaacactgtcaatctattcccgtattagccaagtctagatctattcctagaagttcccagacggttggctccgtgcaccatttctcaaatagccaagtcccacctcctgccacgggcactagccccagcggccactcactctcacacagccacctacaaccaatcggccacccatgggcgcattttcctcttggcccctggctccactacactcgtcacgcgccccctgttcttataggcgcggattgatttgcn

SEQ ID NO: 76680 - DNA, 1364 bp, Homo sapiens
actcagctcctgtggggaaactcatttgtggagaccagccctctggcttggtgagtgaatctggtttacaccggctcctgccctgccttcactcttctcccctgattcaagactcctctgctttggactgaagcactgcaggagtttgtgaccaagaacttcaagagtcaagacagaaggaagccaagggagcagtgcaatggatttctcagtaaaggtagacatagagaaggaggtgacctgccccatctgcctggagctcctgacagaacctctgagcctagattgtggccacagcttctgccaagcctgcatcactgcaaagatcaaggagtcagtgatcatctcaagaggggaaagcagctgtcctgtgtgtcagaccagattccagcctgggaacctccgacctaatcggcatctggccaacatagttgagagagtcaaagaggtcaagatgagcccacaggaggggcagaagagagatgtctgtgagcaccacggaaaaaaactccagatcttctgtaaggaggatggaaaagtcatttgctgggtttgtgaactgtctcaggaacaccaaggtcaccaaacattccgcataaacgaggtggtcaaggaatgtcaggaaaagctgcaggtagccctgcagaggctgataaaggagaatcaagaggctgagaagctggaagatgacatcagacaagagagaaccgcctggaagaattatatccagatcgagagacagaagattctgaaagggttcaatgaaatgagagtcatcttggacaatgaggagcagagagagctgcaaaagctggaggaaggtgaggtgaatgtgctggataacctggcagcagctacagaccagctggtccagcagaggcaggatgccagcacgctcatctcagatctccagcggaggttgacgggatcgtcagtagagatgctgcaggatgtgattgacgtcatgaaaaggagtgaaagctggacattgaagaagccaaaatctgtttccaagaaactaaagagtgtattccgagtaccagatctgagtgggatgctgcaagttcttaaagagctgacagatgtccagtactactgggtggacgtgatgctgaatccaggcagtgccacttcgaatgttgctatttctgtggatcagagacaagtgaaaactgtacgcacctgcacatttaagaattcaaatccatgtgatttttctgcttttggtgtcttcggctgccaatatttctcttcggggaaatattactgggaagtagatgtgtctggaaagattgcctggatcctgggcgtacacagtaaaataagtagtctgaataaaaggaagagctctgggtttgcttttg

SEQ ID NO: 76681 - DNA, 1277 bp, Homo sapiens
actcagctcctgtggggaaactcatttgtggagaccagccctctggcttggtgagtgaatctggtttacaccggctcctgccctgccttcactcttctcccctgattcaagactcctctgctttggactgaagcactgcaggagtttgtgaccaagaacttcaagagtcaagacagaaggaagccaagggagcagtgcaatggatttctcagtaaaggtagacatagagaaggaggtgacctgccccatctgcctggagctcctgacagaacctctgagcctagattgtggccacagcttctgccaagcctgcatcactgcaaagatcaaggagtcagtgatcatctcaagaggggaaagcagctgtcctgtgtgtcagaccagattccagcctgggaacctccgacctaatcggcatctggccaacatagttgagagagtcaaagaggtcaagatgagcccacaggaggggcagaagagagatgtctgtgagcaccacggaaaaaaactccagatcttctgtaaggaggatggaaaagtcatttgctgggtttgtgaactgtctcaggaacaccaaggtcaccaaacattccgcataaacgaggtggtcaaggaatgtcaggaaaagctgcaggtagccctgcagaggctgataaaggagaatcaagaggctgagaagctggaagatgacatcagacaagagagaaccgcctggaagaattatatccagatcgagagacagaagattctgaaagggttcaatgaaatgagagtcatcttggacaatgaggagcagagagagctgcaaaagctggaggaaggtgaggtgaatgtgctggataacctggcagcagctacagaccagctggtccagcagaggcaggatgccagcacgctcatctcagatctccagcggaggttgacgggatcgtcagtagagatgctgcagatgtgattgacgtcatgaaaaggagtgaaagctggacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtatgtatgggggctattactacactgctaagaccccttatgtactcgtgttgctggatcacgatcaaggatagctgacaaacaac

SEQ ID NO: 76682 - DNA, 299 bp, Homo sapiens
attacacagaggggaagaccttcccaagattacacacagacaggtagacatgagcacatttctctggactccagtgtcaggcatctcccctctactgtcctcagggaagagggtccaagtgcgtcagcaagtatggtgaaaggtgaaagagacagtgatcttggatggagagaaatagggcaaaggtgtaaaggttatcaatttttgttatcactaggagtgaaagctggacattgaagaagccaaaatctgtttccaagaaactaaagagtgtattccgagtaccagatctgagtggg

SEQ ID NO: 76683 - DNA, 638 bp, Homo sapiens
ccgcggacgcgtgggttcgtaaggaagcaaatcctaggaacaatcacgtgagcttggaaggagacctttccccagctgagcctcagcctgggccatcacctgcatctggactgaagacccaaagaaactactccatcaggaattgtttgagaccatgcattatgtggacactcatatcgtggaattatattgccaattggcattcctaaagcttctacgctagcaggtttggagtaattcaccagtgaagtcttctcaacctgggcaatcatgtgagcttggaagatgatgcatccccatctcatctttcaggtgaaacctcagccttggccatcacctacatctggatttctgacccagagaaactagaaagcaggaggttattcgaggatgctgggctcccctcacaaatctgtttctcaaagtattgcagaaaggtgtgtcttctggacactcccagagtaggctggagtacagtggcatgatttcagcttaccgcaaactctgcctcctggattcaaaccatcctccggcctcagcctcctgagtagctggggcaacaggtgtgaaggctggtcttaaactcctgacctcaagtgatggacctgtcttggcttccaaaagtgctggaattacag

SEQ ID NO: 76684 - DNA, 2349 bp, Homo sapiens
taagaaaaaaaggctagcactagattctgaagcagcagtctctgctgataaaccagactcagtactgactcatcatgtccccagtttcctgcagaagctgtgcaaagagagggcccagaagttgtgcagaaatagcaccagggtgcctgcacagtgcacagtcccttcccatcctcagtccactcctgtacatagcccagacagaatgctggactcacccaaaagaaagagaccgaaatcccttgcgcaagtggaagagcctgcaattgaaaatgttaagcctccaggttcccctgtggccaaactggcaaaatttactttcaagcagaagtcaaaactgatccactcctttgaagatcacagccatgtgtcacctggtgcaactaaaatagcagttcatagtcctaaaatttcccagcgtagaacaagaagagacgcagccttgccggtgaagcgtccaggaaagttaacatctaccccaggaaaccagatctccagtcagccacagggtgagacaaaggaggtgtcgcagcagccaccagagaaacacggaccaagagagaaggtgatgtgtgcccctgagaagaggattattcagcctgaattagagcttgggaacgagactgggtgtgctcatcttacttgtgagggagacaaaaaggaagaggtttcaggcagtaataaaagcggcaaggttcatgcctgcacattagccagattggcaaacttctgcgttactcccccatcggaatccaaatcaaaatcccctcctcctgaaaggaagaaccgaggtgagagaggcccaagctcccctcctacaaccacagctccaatgcgtgtcagtaaaaggaaatcttttcagctccgtgggtccaccgagaaactgattgtttccaaagaatccctcttcactttaccagaactaggtgatgaagcatttgattgtgactggggtgaagagatgagaaaaaagtcatagttgggaaaagctttctggtcaaatctcaccttcttcaactccacagaggaccttcaggatatcaatatggtatttataaatgtatagaacaattggccatattgaggatcactctgaatactggctcccccttaaggctttctaatttcaggttaatcttcatgacttaaaaagttgtataatcagttgaggtcagtgtgataccagcagctgagctgaattaattatgttgtgcttaattttacaaatggagtacttgtattcctgttcctgaagctgtttctgttttttgttttgttttgtttttaagggggagaggttcttccctagattaatttcttctttcattcactcaggaacaaatgtcaagaaggtagcactcataaatctaacaaggcagatgaactcttttctacttttttttttttttttttgtattttcacctggaatgggctaagtacagtgaatataatcacttggatgatttgccaaaatcagactatttttctagtattatttttgtattgatttgtgtggatcaggttaaatgtgactaatgcttttctttctttgagaggtatccttacaattccatgatgttcttagagatctggccactggtcaaacagtacctttctgaagtactgaccttctgagttgtcctttctttcttgagccaacattttgtacttcagattcttttttctcttgggggcctaccttcaaccaagtaaaatactgtgattagaagaagagagagtatgagccaggcacagtgactcactcctgtagtcctagctactcggggaggctgaggcaggatgattgcttaagcccaggagttcggggttacagtgagctgtggtcacaccactgtattccagcctgggtgacagagtgagatcctgtctctaaaaataaaataaatgaagaagagagactatgtggtagtctcaatcaaacatcatgtctcatctacccagctggttaatatggaaatgtgattcctactaagttgtgattcacttgtctttaaaaccaaggaaattatgtactgtttttggtcagaatagataacctcaagctttgtctttctatgtgcttttaaaatcacttattcctttggattctaataagggttattaggattcagtaattatggactttctcttctgaagtgtgaatttgtaaactgattgtttaattgtcagagggacttttggacatagaatactcaaaactatatgtattttgtttaattttcacttcattcaattcacgcattgaaaacaaatttagaaaatccaatttttcttaagcatttaaacgttctaaaattcactaataaaattttctgaaaaaatttaaa

SEQ ID NO: 76685 - DNA, 2932 bp, Homo sapiens
taagaaaaaaaggctagcactagattctgaagcagcagtctctgctgataaaccagactcagtactgactcatcatgtccccagtttcctgcagaagctgtgcaaagagagggcccagaagttgtgcagaaatagcaccagggtgcctgcacagtgcacagtcccttcccatcctcagtccactcctgtacatagcccagacagaatgctggactcacccaaaagaaagagaccgaaatcccttgcgcaagtggaagagcctgcaattgaaaatgttaagcctccaggttcccctgtggccaaactggcaaaatttactttcaagcagaagtcaaaactgatccactcctttgaagatcacagccatgtgtcacctggtgcaactaaaatagcagttcatagtcctaaaatttcccagcgtagaacaagaagagacgcagccttgccggtgaagcgtccaggaaagttaacatctaccccaggaaaccagatctccagtcagccacagggtgagacaaaggaggtgtcgcagcagccaccagagaaacacggaccaagagagaaggtgatgtgtgcccctgagaagaggattattcagcctgaattagagcttgggaacgagactgggtgtgctcatcttacttgtgagggagacaaaaaggaagaggtttcaggcagtaataaaagcggcaaggttcatgcctgcacattagccagattggcaaacttctgcgttactcccccatcggaatccaaatcaaaatcccctcctcctgaaaggaagaaccgaggtgagagaggcccaagctcccctcctacaaccacagctccaatgcgtgtcagtaaaaggaaatcttttcagctccgtgggtccaccgagaaactgattgtttccaaagaatccctcttcactttaccagaactaggtgatgaagcatttgattgtgactggggtgaagagatgagaaaaaagtcatagttgggaaaagctttctggtcaaatctcaccttcttcaactccacagaggaccttcaggatatcaatatggtatttataaatgtatagaacaattggccatattgaggatcactctgaatactggctcccccttaaggctttctaatttcaggttaatcttcatgacttaaaaagttgtataatcagttgaggtcagtgtgataccagcagctgagctgaattaattatgttgtgcttaattttacaaatggagtacttgtattcctgttcctgaagctgtttctgttttttgttttgttttgtttttaagggggagaggttcttccctagattaatttcttctttcattcactcaggaacaaatgtcaagaaggtagcactcataaatctaacaaggcagatgaactcttttctacttttttttttttttttttgtattttcacctggaatgggctaagtacagtgaatataatcacttggatgatttgccaaaatcagactatttttctagtattatttttgtattgatttgtgtggatcaggttaaatgtgactaatgcttttctttctttgagaggtatccttacaattccatgatgttcttagagatctggccactggtcaaacagtacctttctgaagtactgaccttctgagttgtcctttctttcttgagccaacattttgtacttcagattcttttttctcttgggggcctaccttcaaccaagtaaaatactgtgattagaagaagagagagtatgagccaggcacagtgactcactcctgtagtcctagctactcggggaggctgaggcaggatgattgcttaagcccaggagttcggggttacagtgagctgtggtcacaccactgtattccagcctgggtgacagagtgagatcctgtctctaaaaataaaataaatgaagaagagagactatgtggtagtctcaatcaaacatcatgtctcatctacccagctggttaatatggaaatgtgattcctactaagttgtgattcacttgtctttaaaaccaaggaaattatgtactgtttttggtcagaatagataacctcaagctttgtctttctatgtgcttttaaaatcacttattcctttggattctaataagggttattaggattcagtaattatggactttctcttctgaagtgtgaatttgtaaactgattgtttaattgtcagagggacttttggacatagaatactcaaaactatatgtattttgtttaattttcacttcattcaattcacgcattgaaaacaaatttagaaaatccaatttttcttaagcatttaaacgttctaaaattcactaataaaattttctgaaaaaatttaaaaaaaaaaaaaaaaaaaaaaaaaaaaaaaaaaaaaaaaaacaaaaaaaaaacacaacaaaacaaaacaacaccaaaaaaaaaaacaaaacaaacaacaaaacaagacaccaacgagcggcgcgcctaaacacagaagccacaccggcggcgacaccacagcgccgccccaccacctcaacccgagccagccaccccccatgcgcggaatatcaacagcaaacaggacgcggcaaaaaccgccgaggaaacaaaccagagcacaggcgcataaggaacacccaacaccggctggggagactgacgaggccgcacccgccaccacgagatcatgagcgcggagcagcaaaatcacatacgagcgagctggaaggcaaacacaacacgatagcgctgggccgacgacctcgccacgagaagtcacacagaaaatcaacgggcaggaagacaacccgaagccagccggccgccgcgcagagcgaccccggacgacgtcgcagcggccctcgtccgtgcgaagacgggacgcgccccgagaggccaggcacccgcgagcgacccgccagacaacgacccgcacaacgat

SEQ ID NO: 76686 - DNA, 344 bp, Homo sapiens
cagagatagaagaaaatataaaactattttctttttaaaactgtactgaatgtagggccgggcatagtggctcactcctgtaatcccaatactttagggggccaaggtaggaggatcacttgaggtcagcagttcaagaccagcctaggcaacatggcgagactccatctctacagaaaatttttttaaaaattagctggacatggtggctcatgcctgtggtcctagctactcaggaggctaaggtgggaggattgcttgagcccaggaggttgaggctgcagtgagccgtgatcgtgccactgcactccagcctgggtgacagaatgagactcaatctcaaa

SEQ ID NO: 76687 - DNA, 454 bp, Homo sapiens
tatacatacacacacccacaccctaccccatgccaccccaccccccaccccacaatagagaagagcagggaaagtagataggcactttcctatctttttgaaacctagtcacaaagaacatgggcattacccttgtcacacgcagggtattactgtttttattcattcaaaagttatttaacgagctcctactgtggtgagcaagtccagtggaatccaggcccttgctctgctattagagggatgagggcctttctcttcaaggggagattccctttccttgtgtcagccttacatagtcctttctgggtttcctaatggtggaaccaccaggcagagttccaagatggccaagccttcctcccttctcttcctaaacttcccacagctatttaagaagtacagatgacttcacagcccacgggaggcatggccaatagcaccttgagaaaac

SEQ ID NO: 76688 - DNA, 403 bp, Homo sapiens
tgttgcccaggctggtctcgaactcctgagctcaagcaattcgtccacctcagcctccgaaagtgctgggattacaggtgtgagccactgcacccgccttcaagagttatcaagagataaattatatttcctctctgaagagaaggtgaagtcatcttctgagagtgaaatagggagtgaggtgggagttcagaaagaatggaaacgtttttgaagagtcaaaattattgactggggacaaaggaaaagatttccatacagtgttctgttggagttggaaagcatgctctatgtggcatgatcgtctcaatctgcaccataccccatgagcagcgagttggggtcctctttgggtagatgttttgggaaggctggcagaatcacaaggcgctgagcatgctgg

SEQ ID NO: 76689 - DNA, 453 bp, Homo sapiens
ctgtgggctatgactttgtcctcatgcctttgccatgtggatggtgaatgatgcaggtgttgccctttctgatctccagccccccagcctttcatactttacctggctgattctacatcttttttgaatgatgaatttttgtttcaggaatcagcctgatggttttaattcacttctccagtgcttggagataactaaaagcttccctccctatatatgagttctggtggaacacagattatttacttctgagagtcttttgctagttggaaatggtgcttttctatctctaaatccctcaaggatatgggtagtgtggttcttgcatgtaagaaatgtttctttaaaatgcacccagtataataagagaactgaattaccctctccgggcagttctctcagatactgagtcattgttagaacatcaaattagcaaatagctagaccagaagg

SEQ ID NO: 76690 - DNA, 1435 bp, Homo sapiens
ttctcgtcttgtgtacctgggcatccctccagggtttggggagccagcctcccccgcccccctacactggaatttgtttgtgtttcttcactgggggtggagggctcaaggggctctaagagggaaaagctccccacacccccagatgctgctcctcctcccggctagagggaacccaacacccaccagtgaaatctgatgcagctgggagtttggaccttgggtctagacagctggtgcgcccaagaggtagggggaggggtgcggcttctccccagttcccagggagtcttgtttgttaagcggggccttgggcagtgttttcctgctgagggtggttttacattttttttcctcattggcccacagagagtggagttggcctagctctgacgcgtcccctctttatccccaatgtgccccctccattaggggctccaggtgggctccagcccacacttgctctctgcctctgctgacacgtgcacacacacacacatgcacacactgctcctctctgcctgctttcccctggagtcccatgccctgccccatccagacactgcccaaggcccacccgtctatttccacctcattccccctttaagctgagaatggggtctgcctatagaagcttccagagacagctgagactgggtccccggtgcctccaccctaggatctcaggcctgccccaaactgcttcttacagcgtggaggtttctctgatttctcccttatctagcaacacttggttcttttggctagtcagggctgggatcccagggggatccacctgcaggagtcagaggtaaagaagcatccacacggagggtagtggggaaggaagcccacatggcagaagctctgcaaacacagtccgagggactgagtgagtccatacaatgcctcacacacaaaggccattgtcaaagcctcgggcctggcagaaagtgaggggggtggggccgctaggccacctcctgctcagccacccctggtcctcattctgggatgaggggagggcctaggagaagccctccctttcagtgcagattcccttcttgaatgggacattgagttcctatcagccaccccagactgggtcttcccatgtatataatggaggaagacccctcccagccctctcagtcccccagctcaaagtgcctcagttcctccatctgctcccagatcccctggcactctagacaggcatgcccatgggaaggaccctgggatggagaggcaggcttcgcggcccttcatgcctgcccactgggattccagttaactcaccccagggtgtcaggggctctgcaggatggcaagtgttggggaggagggaggcagaccactctgtgccccacgggcactgacccaccctgccataggcttcctaagggaggcccccaaaaccctctcccctcccctc

SEQ ID NO: 76691 - DNA, 497 bp, Homo sapiens
gataaattaaggctagtataggcctgcgtgtttaatcggccgaccctgggatggagaggcaggcttcgcggcccttcatgcctgcccactgggattccagttaactcaccccagggtgtcaggggctctgcaggatggcaagtgttggggaggagggaggcagaccactctgtgccccacgggcactgacccaccctgccataggcttcctaagggagcccccagaaacacaatcgacaatcagcactagcagcgacacaagggtagaacaagtagaagagagaacaagagtcgcacgagcaacaaaacgcacgtaacaggaaagacacaggaaccgagaagagagagaaaagagagaaagaaaaggacagcagcaagagacgagagacagcacagcgagagggggaaggagaggaggagaacgaacaaacacagaaaaacgacaaggaaaggaagagcagaggggataggcagcagaggcagaagaaaggagaaca

SEQ ID NO: 76692 - DNA, 2945 bp, Homo sapiens
ttctcgtcttgtgtacctgggcatccctccagggtttggggagccagcctcccccgcccccctacactggaatttgtttgtgtttcttcactgggggtggagggctcaaggggctctaagagggaaaagctccccacacccccagatgctgctcctcctcccggctagagggaacccaacacccaccagtgaaatctgatgcagctgggagtttggaccttgggtctagacagctggtgcgcccaagaggtagggggaggggtgcggcttctccccagttcccagggagtcttgtttgttaagcggggccttgggcagtgttttcctgctgagggtggttttacattttttttcctcattggcccacagagagtggagttggcctagctctgacgcgtcccctctttatccccaatgtgccccctccattaggggctccaggtgggctccagcccacacttgctctctgcctctgctgacacgtgcacacacacacacatgcacacactgctcctctctgcctgctttcccctggagtcccatgccctgccccatccagacactgcccaaggcccacccgtctatttccacctcattccccctttaagctgagaatggggtctgcctatagaagcttccagagacagctgagactgggtccccggtgcctccaccctaggatctcaggcctgccccaaactgcttcttacagcgtggaggtttctctgatttctcccttatctagcaacacttggttcttttggctagtcagggctgggatcccagggggatccacctgcaggagtcagaggtaaagaagcatccacacggagggtagtggggaaggaagcccacatggcagaagctctgcaaacacagtccgagggactgagtgagtccatacaatgcctcacacacaaaggccattgtcaaagcctcgggcctggcagaaagtgaggggggtggggccgctaggccacctcctgctcagccacccctggtcctcattctgggatgaggggagggcctaggagaagccctccctttcagtgcagattcccttcttgaatgggacattgagttcctatcagccaccccagactgggtcttcccatgtatataatggaggaagacccctcccagccctctcagtcccccagctcaaagtgcctcagttcctccatctgctcccagatcccctggcactctagacaggcatgcccatgggaaggaccctgggatggagaggcaggcttcgcggcccttcatgcctgcccactgggattccagttaactcaccccagggtgtcaggggctctgcaggatggcaagtgttggggaggagggaggcagaccactctgtgccccacgggcactgacccaccctgccataggcttcctaagggagcccccggaagcctgccctcgctcgtaccacgtggatgcatgcgtaagtgggaacgaccccatgcgcagactcacgataaactggcgccatgggaaaaccactggggacaaaagcaaagagtgggatacgaaaggaaagaacaagggacacatccaaaaggacaaaagggaacccaagcacccaagggccaggcacgccaggaacgcacaacgggctcagccaagaaagatcactggacagcccactgcacagagccaccccgggactgccgaggactcaatcaccacatagtaacaacaagtaccaggaggggaaagcgtggaggacataaggagaagacgcacaagacacaaccgagcagggaagcacagcaccacgcaagggcacgactccgtccacccacgcgacccacagaccaaagagggcaacgaacaagagcaagcgacgacacaggaacaaacaaggcagaaacggggaagaacaacacccaagcgcaacgaagacatacccagcccgctccccaccagaagaggaacaaagaagagcaggaagcccacactaacaccaccagatggaacaatcggaccacaggcaagcaccacagagcaggaagacacaaaacaaaagaaacgagccagcgacaacacgaccacaagaccagtggagacaacccaaacacacaaggccaaaacaaagcgacaaagaggcaaggcagaaacaacaacacacagaagtggcaaaccaagcacacctagaacaaacgcagggcacaccaccgcccagacaccaccacggagcaaccaccaacaaaagacgacaacgggagaagcatcgtacagcagccagaccacaacagccccaacacgcaacaaacaaacaacacaaaaacacgcagccagaacggacacgtcagacagaaacgagacacgagaaaagaccagagcagcagaaaaccacacaaacaagcaaacaaaacgagataagagcaaaccgacccacgacaaaagcaagcaaaacaccactacacgaaggccacaacacaacacaacaagagagaacacaagaacagcaatggagacacaaaaaacgaacgagagcgacacacgacaatagacagccaagggcgcgagagagcgccagcagcagacagacacacggcgagacacacaaccagcaccacaactagtaaggcaggacgacacaacagaggacgccgcacacacagacacacacgcaacacacagacacacgacgacgaccgcaagagcacgacagagcgcaaagagaagggagacccgacgcacactgcaccaacactagacaacgaccatcgagaacaccaacagatcagcgcacccagacacaagacgaatcagagcaagaacagacagccacgccgaacagaaacacaccagaccgaaagcacgacgcgacacaacgcagacgacccgaagcaagcaagagacgcaagcaacagacgaacaacagaggcacaccatcgacacaacgccacagacacagggacggcatacggcac

SEQ ID NO: 76693 - DNA, 1687 bp, Homo sapiens
ttctcgtcttgtgtacctgggcatccctccagggtttggggagccagcctcccccgcccccctacactggaatttgtttgtgtttcttcactgggggtggagggctcaaggggctctaagagggaaaagctccccacacccccagatgctgctcctcctcccggctagagggaacccaacacccaccagtgaaatctgatgcagctgggagtttggaccttgggtctagacagctggtgcgcccaagaggtagggggaggggtgcggcttctccccagttcccagggagtcttgtttgttaagcggggccttgggcagtgttttcctgctgagggtggttttacattttttttcctcattggcccacagagagtggagttggcctagctctgacgcgtcccctctttatccccaatgtgccccctccattaggggctccaggtgggctccagcccacacttgctctctgcctctgctgacacgtgcacacacacacacatgcacacactgctcctctctgcctgctttcccctggagtcccatgccctgccccatccagacactgcccaaggcccacccgtctatttccacctcattccccctttaagctgagaatggggtctgcctatagaagcttccagagacagctgagactgggtccccggtgcctccaccctaggatctcaggcctgccccaaactgcttcttacagcgtggaggtttctctgatttctcccttatctagcaacacttggttcttttggctagtcagggctgggatcccagggggatccacctgcaggagtcagaggtaaagaagcatccacacggagggtagtggggaaggaagcccacatggcagaagctctgcaaacacagtccgagggactgagtgagtccatacaatgcctcacacacaaaggccattgtcaaagcctcgggcctggcagaaagtgaggggggtggggccgctaggccacctcctgctcagccacccctggtcctcattctgggatgaggggagggcctaggagaagccctccctttcagtgcagattcccttcttgaatgggacattgagttcctatcagccaccccagactgggtcttcccatgtatataatggaggaagacccctcccagccctctcagtcccccagctcaaagtgcctcagttcctccatctgctcccagatcccctggcactctagacaggcatgcccatgggaaggaccctgggatggagaggcaggcttcgcggcccttcatgcctgcccactgggattccagttaactcaccccagggtgtcaggggctctgcaggatggcaagtgttggggaggagggaggcagaccactctgtgccccacgggcactgacccaccctgccataggcttcctaagggagcccccagaaacacaatcgacaatcagcactagcagcgacacaagggtagaacaagtagaagagagaacaagagtcgcacgagcaacaaaacgcacgtaacaggaaagacacaggaaccgagaagagagagaaaagagagaaagaaaaggacagcagcaagagacgagagacagcacagcgagagggggaaggagaggaggagaacgaacaaacacagaaaaacgacaaggaaaggaagagcagaggggataggcagcagaggcagaagaaaggagaaca

SEQ ID NO: 76694 - DNA, 372 bp, Homo sapiens
ggattcaagggtaaatgaagatgagcataacttagctattatagtaggtgacaggtaccctgatgatgctgaccagccgacttgctgcccttgcacgcagtcataaaatggggtgggataggatgcagtgagaatggatttaacttagattacatccgctcatgagactgggttttgccaagcattgttttaaaccagaattccctaatgatttgggatttatcactcagtctgagcaattgctgatttggttggcttggtggttctcaaactgactgaaggttggactcactctgggagcttttaaaaaaatgcccatggccgggcttggtggctcatgcctgtaatcccagcactttgggtggcagaggc

SEQ ID NO: 76695 - DNA, 168 bp, Homo sapiens
tacctaccagcggtagtaaatgtctcagaataagaaggctcagaaacagtatttgccctgtttccccatctgttaaacttggagggaggctgaaacagtctgcaaggtcccttaatcctgatatcttctcaatctttatgactctgttccacctttccctggagccac

SEQ ID NO: 76696 - DNA, 262 bp, Homo sapiens
ctttgtcttaaaaaaacaaacgaacaaaactaaaaacaatattaattcagttttcttaccttccaccttaggaagctacagaaaaaactatagtgtaatgtaaaccagatataaaaatagaacaaaaaattatttacagaaatcattataatagaaatgataaacaaaaccaagggctgcttcataggaaagataaatagaattgataaacctccagccaggctaaccatcaagaaaagctaggagacacaatttacaaata

SEQ ID NO: 76697 - DNA, 320 bp, Homo sapiens
agttcgagaccagcctgaccaacattgagaaaccccatctctactaaaaatacaaaaaattagccgggcatggtggtgcatgcctgtcatctcagctacttgggaggctgaggcaggagaatcacttgaacccgggaggcggaggttgcagtgagccaagatcgcgccattgcactccagcctgggcaacaagagcaaaactctgtctttaaaaaaaaaaagagagagagctaagagaactctcttaccccttctgccctgtgagggcacaatgagaaaacagccatctatggactaggaagtgagccttcatcacactg

SEQ ID NO: 76698 - DNA, 698 bp, Homo sapiens
ctttgggaggccgaggcaggcggattgcctgagctcagtagttcaagaccagcctggacaacacagcaaaaccccatctctactaaaaatagaaaaatattagccaggtgtggtggtgcatgcctgtggtcctagcttcttgggaggctgattcaggagaattgcttgaatctgggaggcagaggttgcagtgagctgagatcacatcactgcacttcagcctgggtaacagagcgagactctctccaaataataataataataataataataataaaataaacttcaaaactaaaacaactttaggctaactgggaaaactgaaataggaagacctcgccttgaccctagggaatgaagccaaaactcagagggctggaggtatccagctgcctagctgctgtccagctaggagcacagtttctttggaggtccccaaaccatgctggtggagcctcatctatctctttagctccccatcaaagggatcactttatcagctgcacagtctttaagcccaacgtccacagcaggactctcttttaaaacagtttggccttgagagaggcagtccgcttgttatctatgttttgttttgtgttggcttcctggcgagttatcagggagactttggtttctttgtcttctgttatctccctgctgggtttcaaagctgccctctgagctgctgtcagcct

SEQ ID NO: 76699 - DNA, 678 bp, Homo sapiens
tgtcctttagcttgaggccctcgctttcctccattctcatgaccttgcccccttccctgtggagggtcttgttatgctgaaggcacctttccctccttccggactggcgttcctacttcttgggaggctgattcaggagaattgcttgaatctgggaggcagaggttgcagtgagctgagatcacatcactgcacttcagcctgggtaacagagcgagactctctccaaataataataataataataataataataaaataaacttcaaaactaaaacaactttaggctaactgggaaaactgaaataggaagacctcgccttgaccctagggaatgaagccaaaactcagagggctggaggtatccagctgcctagctgctgtccagctaggagcacagtttctttggaggtccccaaaccatgctggtggagcctcatctatctctttagctccccatcaaagggatcactttatcagctgcacagtctttaagcccaacgtccacagcaggactctcttttaaaacagtttggccttgagagaggcagtccgcttgttatctatgttttgttttgtgttggcttcctggcgagttatcagggagactttggtttctttgtcttctgttatctccctgctgggtttcaaagctgccctctgagctgctgtcagcct

SEQ ID NO: 76700 - DNA, 691 bp, Homo sapiens
agaatgagtaatgtataaaaatgttataccatttttgtcaaaaggaagtgccactttaattttatttgatcaaactcttgagagtttgatttccatgattctctctggtgatactagactggacatagaccacatgtaaaggcttctcaggggcccttgtcctcaccactctcccaacaggcacagtccccagcctcagagccttctcacccctctgcctggccacatactctggaattctttggaatatgaaatcctggggaaggttttcaccttctccccacagttatcccaactaaggaatcacctcagtatattcccaaaataaagctgtgtggccgattcatccaaaacttgcatcatcaggtacccaagtcctcatccctcaaacctttcctcacctcagctttgaatgttcctgaacttgagcaacttgggctacttcaacaacagtagcacctctcctttcaagccacctcttttcctgaaggcatgggagatgcccatcatgtttcatttctctctttcttactccaaaattgctcagtatttgctctttatccatttgcatcagaatcatgtgggataaattgaaatcagaaagacatctaatgcattcagctctgccacacaaacttctccaaaaaaggagcctggagatcctggctcccttctcagagtggggatgaaa

SEQ ID NO: 76701 - DNA, 1889 bp, Homo sapiens
ctgaaccctcgtggagccattcatacaggtccctatttaaggaacaagtgattatgctacctttgcacggttagggtaccgcggccgttaaacatgtgtcactgggcaggcggtgcctctaatactggtgatgctagaggtgatgtttttggtaaacaggcggggtaagatttgccgagttccttttactttttttaacctttccttatgagcatgcctgtgttgggttgacagtgagggtaataatgacttgttggttgattagatatctcatgctgttgactaagaacattcaatcttcgtaaactggccattggtgttctgagaaattgaatcttacagagttctttaattttgaaagtttcttgttctcagataatagccttgtaaatgtctccaaatttcagagtcctattcatcttacctaaaatacactaagcctttgttctctttaagtagtacagatatcttagcagccggtaatggttaagggtgtgagtacaaggaacattctgttttggccctctctgttgtgcattgtagatgcctcatcacttcataaatatttattgagtgtttttcttgttaagcactagataaacctacaaaggtaaataagactagagttcctgacctgtcaaggatatcaccacctggtctaccatccatctgtagcaaagtgaccccagcgttcctatgcttacactctcctttttggcagcttggccatgttagttcatgtgtgttagctgttattttttatttttgcttttgccaaaaatctcagtaagctaaacattgggatcagataggtttcattcttagatttcttgatagatttctttggtttaagttatggtttgagtttgtttccctttttcgttagtaaggccacatttttgtgaacatttatttgaattaaatttctgttttctttgatttaagccattttcatgaattttctccagatgcgtgaattgacattagatatcacatttcttttttaatggccattatggtttaatatgttgctattaaaaggttgttttagctgtttttcaactcgtttcatgatctatgtgtaagttcccaaagggagagatcatattttatcttttcccgtaaacgccacagcatataatagagtgccctgtatatggcggttgtcagtaaatgtttgactggattctctgaatggagtaaaacggtttttaaattcttttcatagcaggatagcccaaatggctataaaagaggtcaaaaattctttgtataaatgtttttgacttttggctgaaactattaaattctttataaaataaatcatcgttaaaaagatacccacatttatgttataagccaaactctgttattctggtaactgaaagtttgtgagctttttagatggttaatgggaatgttcagatagatacgactttgtcatctattgtctctgcatttgttaaaatagtaatgctatcactttctttagcctctaagttagttgatatttatttacccttgttaccaatgttcttatgttaaaacattcattcattcaatattaacaccttattgtagctaggtattttaataagtaaattaacttcctgatgcaaggagttggtagcatagtacagtgtagtgtttcacaaatataacctgttgatcctataaggtcaaaactattttcatcatagtaagatgtggttttctgttatcattgttttagtgtttgtactgataatgtggaagcaaacaccaaaacaatgaaaacagaaaaccacatgatgggtaaaactgctgatgcctcagcatgaatcagtgctgtgacaccagtctgtactagtagtcattgtattcttcaccatcacaaacttagttgaaaa

SEQ ID NO: 76702 - DNA, 357 bp, Homo sapiens
atatgaaaaaaaacatgagacagacaagaaccaaaaaaaatttgacatcaggatgataaatatagtcttagacattacttcgaaaatatatctacctacctacacacacacacacacacacacacacacacacacacacacacccctcaagggaaagtgtatagaaaagcatggccaaaagagcattgcatagtaatgaaaaataatagtgaatagagggtgaatttagaagcctcttgctgtctcttgctaaggtttatttatttgtcatgcaagtgagaaggggttgcttcccctaatgctagagtagtaattctcaaacttcatcaaagatcagaatcaccaagaggtcttgtg

SEQ ID NO: 76703 - DNA, 779 bp, Homo sapiens
gaggaccccttgaagccaggagttccaggctgtagtgagccgtggttctgctactgctctccagcctgggtgacagagcaagactctgtccaccccccacccccaacaaaaagaatttcactatatagatgtttcttgatttttcaaactggtctgttagtttgtgttcagtttgtcacctttgtgagaaaaaaaacactcataagttagtgtgtacttcctacttaatttctcctgggtcatcgtgaagcactccctgccctccatgagaacagtatgtcacccgctctcttccctgtgccaagcccataaagggctgttggcaaatatgtcggacaaatagactcgcctaagagggcctttctctccaagccctcgccagcacaggctgtgtcactttcttaggtggcacctaccgtctgttgcacacttgctgcagatgatttggcacaggatgtcgcttcagaaaaccttgtaggaagccgtgagtcgttaccgtccccatttcacagacaggaaagtgcaggccttagatgcactgcctgataccctgtggcccccgcgttcctagacagatacactgcctggtacactgtacccccccacccccgctatcgtttgcagctggggttgaaccctgcattcatagacaggttcccccttgagtgagccccccatctgcttaactgagggcttgtcctggttataaatgtctgggtgggggtgggcactgctggctgcagctgtcaggactgggaatgctgaacctgcactgaggg

SEQ ID NO: 76704 - DNA, 469 bp, Homo sapiens
catttagctcattggttgccatctttaattagtggcagtgacactaaagatattcagatttgtcctaaatgccttttggaggttgtaatggctcatgaattggccttgggtgccatcacaagggtctgaaattaaacctacaggttctgaatacaacatcatggttgcctgagtctgggcatctgtgaagaagggtaatggatggtgaggtcagtactgcaggctaccttaccttggtgattaggtttctaagatcatagcattaagaatttctgtatgagataagtcatctagattggtcccagcccctgttagtagctgccagtgtggcacattcatgtcaaaatttcccagaagccaagatgatgtaggccccagaggtgggttgttaaaagatgctcctctaagggtctcttctgttcccacggatcctgcagagcatggcaggtatgaaaccatccttaactgc

SEQ ID NO: 76705 - DNA, 711 bp, Homo sapiens
agcggaaaaatcgtgcttgcaagatcgttcatatatttgagaatacaccttatgacctgcttgttctctgtactgtttttagtgactttgaaggtaaatccagagtatacttagaggatacaagcaagtaactatttctctagaagtgacattggtgatcactcatgctcaaagagaattgcatttcattgcttcctctttcagttcctgtgaacatgactttgtcccaatcaaaaaatgtaatttattttcaaatcactgggaaaatattggtctagatgagaatataagcctttttccctcctctataaatagaaaattaaacattaaggggaagaaccttatgtgctgtgaactaaggggtttaatttaaccttctgtatctgaggtctagagaaagagaaataatgacagtttacaactgtgtgccgagctgttgtgcttaaatgtgtttttgacagaggtggcagtgaaaactaggctatttttcttttttaaaaaatggtacaagcttttaattggtttatgtaaaagaaaataggcaagatatacttttaattctaacaatagttttagtagatactctgataggaaatataatattcctcggaaatgtagaagacataccctaaaaaaagttatgatttagtattttacgaatcgtcctagctactacagggagattaagaactcttccgtaacttaaatctg

SEQ ID NO: 76706 - DNA, 2639 bp, Homo sapiens
ggcacgagccgccagcaaacctcgggggccaggaccggcgctcactcgaccgcgcggctcacgggtgccctgtgaccccacagcggagctcgcggcggctgccacccggccccgccggccatgaggcgcgcgccttccctggtccttttcttcctggtcgccctttgcgggcgcgggaactgccgcgtggccaatgcggaggaaaagctgatggacgaccttctgaacaaaacccgttacaataacctgatccgcccagccaccagctcctcacagctcatctccatcaagctgcagctctccctggcccagcttatcagcgtgaatgagcgagagcagatcatgaccaccaatgtctggctgaaacaggaatggactgattaccgcctgacctggaacagctcccgctacgagggtgtgaacatcctgaggatccctgcaaagcgcatctggttgcctgacatcgtgctttacaacaacgccgacgggacctatgaggtgtctgtctacaccaacttgatagtccggtccaacggcagcgtcctgtggctgccccctgccatctacaagagcgcctgcaagattgaggtgaagtactttcccttcgaccagcagaactgcaccctcaagttccgctcctggacctatgaccacacggagatagacatggtcctcatgacgcccacagccagcatggatgactttactcccagtggtgagtgggacatagtggccctcccagggagaaggacagtgaacccacaagaccccagctacgtggacgtgacttacgacttcatcatcaagcgcaagcctctgttctacaccatcaacctcatcatcccctgcgtgctcaccaccttgctggccatcctcgtcttctacctgccatccgactgcggcgagaagatgacactgtgcatctcagtgctgctggcactgacattcttcctgctgctcatctccaagatcgtgccacccacctccctcgatgtgcctctcatcggcaagtacctcatgttcaccatggtgctggtcaccttctccatcgtcaccagcgtctgtgtgctcaatgtgcaccaccgctcgcccagcacccacaccatggcaccctgggtcaagcgctgcttcctgcacaagctgcctaccttcctcttcatgaagcgccctggccccgacagcagcccggccagagccttcccgcccagcaagtcatgcgtgaccaagcccgaggccaccgccacctccaccagcccctccaacttctatgggaactccatgtactttgtgaaccccgcctctgcagcttccaagtctccagccggctctaccccggtggctatccccagggatttctggctgcggtcctctgggaggttccgacaggatgtgcaggaggcattagaaggtgtcagcttcatcgcccagcacatgaagaatgacgatgaagaccagagtgtcgttgaggactggaagtacgtggctatggtggtggaccggctgttcctgtgggtgttcatgtttgtgtgcgtcctgggcactgtggggctcttcctaccgcccctcttccagacccatgcagcttctgaggggccctacgctgcccagcgtgactgagggccccctgggttgtggggtgagaggatgtgagtggccgggtgggcactttgctgcttctttctgggttgtggccgatgaggccctaagtaaatatgtgagcattggccatcaaccccatcaaaccagcccacagccgtggaacaggcaaggatgggggcctgggctgtcctctctgaatgccttggagggatcccaggaagccccagtaggagggagcttcagacagttcaattctggcctgtcttccttccctgcaccgggcaatggggataaagatgacttcgtagcagcacctactatgcttcaggcatggtgccggcctgcctctccatcaccatctctctccacttccccttgtccagttcctcacacacttctagattcttcccagctcagaggcttggcatttgccatatcatcatctttttttttttcttttaaacggagtcttgctatatcgcccaggctcaagtgattctcctgcctgaacctcccaagtagctgggattacagaaagccgccaccgtgcccagctaatttttgtatttttgttggccaggctgatttcgaactcctgacctcagatgacccacctgcctcggcctcccaaagtgctgggattacaggtgtgagccactatgcctggccttccctatcttctacctgaaccttcttcctcttcccccagggcttcccaagctctttccacagccacatcagtcagggcatggctccaatccattctttgctccaatgtcacctcctctgagaggccttccctaaccacccaatcattctaaagcagcctccctacagtcacgttaccctgcctccttcctcgagcactcctgtgtacctgtcgctcttatctggtggcatgtatgtcatccacagctcacccactagagtgtgagctccatgagaacagggacctgctccttcacattcgtggtagtatccccagggcctaggacagagcttggcacacagtaggtgctcaataaatgtttgttgaatga

SEQ ID NO: 76707 - DNA, 480 bp, Homo sapiens
caccgcactccagcctgggcaaaagaggaagactccgtctcaaaaaaaaacaaaaacaaaaacaaaaaaagaatgcatggagttagttcattcttctcgccccctggaacttctgatcaaaagtcaatacctttgtgacctacaagtctctttatttgccctccattatagactgagctgttaataacatttaatgagctcacatggattcactggctaataaagaagaatagagttgaggacattgctgccctgtttatgcccaaaaattaccctaaactgaaagttgctttgtgttccttcactcccctctgctggtaaattttaatatagttcttaatttttttaagtcaaattgatagaaatatcaattgtgtttttaaaactgtaagaaaaaataatgttgaacatcacaaaaatgtactcaatctttcccaaaacccatttctttccagttagttttcataactgtaggttctt

SEQ ID NO: 76708 - DNA, 381 bp, Homo sapiens
gcttggagaggctcttcctgggtgtgtctagttggccctcttttccctcctcttcttaggatactttttatttctttgctatcagttgtaacgtttcctctttcatttctgatttttgttattcgaatcttctttcttttttcttagtctggttaagaatttgctgaatttacctttaaaaaaccgaactttccattgtggaagacattgtggcgattcctcaaggatctagaactagaaataccatttgacccagcaatcccattactgggtatatagcaaaaggattataaatcatgctgctataaagacacatgcacacacgtatgtctattgtggaataatgccgcaattaaacatatgtgtgcatgtgtcaaaaaa

SEQ ID NO: 76709 - DNA, 459 bp, Homo sapiens
ataactttgtaaatgtgagcaaatttgtttatatacatgaggggtctggaatgctgttgggaacgacatgaatcttcccctgattccagaccaaatggccctatattaataatatcccaactcaactgtggtaaagaaacaaaattaagaaggcttctggctgttaccagtgaaaaaacaggttgctcattatggcaatatatacgtgtctcagcagtaactttctgcctcttctacctggttttgtgcacagttttacacatggtcccactttgctgataattatgttccattgctccctctggaccttagacttctgctgtccatttcagtttttcctctctgatttcctacaggcattttctaaaagcagggagagaatttaagtaatcatctaggagatcgaaaactaaaaaaaaaataccctttctgtaattcaaacagacttaccatcctaga

SEQ ID NO: 76710 - DNA, 351 bp, Homo sapiens
caaggtaaatgtctgaatataatgtaactaaagctacattcctataaaaatgcctggccaaaaggtagctcttcaagccagcagtcatctccaggataatacattgaatctgtagagcttattttacccagtttttcccctcccctgcaaaggcaattctttaatctgctctacaaagtctctacctactaagaagtcatctttggttgagggacctcctgggacaggcagctcattccattttcaaatagttctaaatgggggaaatggtttcctttgttcagccaaatgttgtcttctttaaggcctgcttctccacattagctcttccttctggaatgagacacagta

SEQ ID NO: 76711 - DNA, 1097 bp, Homo sapiens
agtagccccagactcccatcttcttagcttaactccagtggaaagcagtctctatcttctacctttcataagtcagtctcgggaaaggattctgattgcccctacttggctcatatacccatccctggactaattcctgttgccgagtaaatagcacagtatgattatcctgcctggatcccatgtaatacctgtgggtagggcaaggaagttggagtcctgtgaccgacagtcttgttagagacattattagtatgaccccatcggtggtagctaatgactgagaaaaacatggtgattattttcaaaaatgagtatgaaaatctaaagtatccaaacttaaaaaaaattatttaaatgttttcccagaatgaatctctatctctcttttagaaacatcccattttgtaagaccaaggtatgaaagtattcatctgagtttcaaatgattgcctaatcttacctgtaatcattattgagaaccaaacacccattaatggtgtggtctaaggacaaggtcctgaagagatgagactggcgcatattaaagatgcctgctatgatgatgtggctgtcatggctacattatcatgagggatttggaatctggggttccagagagcacgtttttagccactatctctgactattaaatcacttacaacagctttggataataaaattctctgtttctctcttggtttggttccatattagaatctgcaagtgcaaaggcaaaacagtcagcaaaacagcagacttaaatagaaaaaagccccaaaaggaaaggaaaacaattgaaaatttaaaagaaaaacacccccacccccaaacatgatctaatcagtcttccttatggagaagttatgaatcatcctacttagcaaataagacaattgaatgtgcaagcccaaacttgaattaaagttattctcaacttcctgtttctcttattaacatgcatttattatttaataagtatttatgtatataattgagatatttaagctctgggtaacttaagtggctgtagagtactacctgaacacacaaggagaaataaactttgaatatgtgcctgtatatttacaacacac

SEQ ID NO: 76712 - DNA, 723 bp, Homo sapiens
agtcttgctctgtcacctacactggaattcagtggcacagtctcagctcagctcactgcaacctccacctcccgggttcaagtgattctcatacctcagcctcctgagtagctgggattacaggaaaaaaagtccttgggaattgagaagccaatgagattagtcgttcaagctgaagtcattctatctgctagctgtctggagccactgaagctgtgggcgaacagcaagaagtttaagctacatctgcacactctgcggtccatccagagaccaagaaagaagcacaaggatcctgcagagtcttccgaagcccaagccaaatatatgaggcagggagctagagaatgtggaggaagtggtcagtaggaaaaggaatgggaacagacattctccttcagaaacttgaggtccagtccctgaactttagctggccccaaaacttgagcaagctctaaaaagcagaacatctcccacttaacagtttattctgagaactggccaaccacaggagggaaaatcatatctccagttaaagtgccctgatcatgccatctgctcatcctaccccctttgccctgctcccacacaaagttcctgctagccctgtttacgtcttcttttttaaactctttttttaaaatttgatttttagacatttgaagatttccatggtcagagggtctgtaatagtcttttttgaataaagctgctccttaccta

SEQ ID NO: 76713 - DNA, 431 bp, Homo sapiens
agtcttgctctgtcacctacactggaattcagtggcacagtctcagctcagctcactgcaacctccacctcccgggttcaagtgattctcatacctcagcctcctgagtagctgggattacaggtccctgaactttagctggccccaaaacttgagcaagctctaaaaagcagaacatctcccacttaacagtttattctgagaactggccaaccacaggagggaaaatcatatctccagttaaagtgccctgatcatgccatctgctcatcctaccccctttgccctgctcccacacaaagttcctgctagccctgtttacgtcttcttttttaaactctttttttaaaatttgatttttagacatttgaagatttccatggtcagagggtctgtaatagtcttttttgaataaagctgctccttaccta

SEQ ID NO: 76714 - DNA, 762 bp, Homo sapiens
attgtactcgtcccatacccataaagcttcaaatgttcttgctaaaaatttgataataaaaacttatgggacagaaatcatagataagacttaatataccacttaccaaataacaaacagtggtatgaatatttaatttatgtaattgcctccaaaattctgaaaggtatttattatatgcctatttcatagccaaggaagctgagacagagtttaagtaacttagatttagattcaataaatggcacaacagggataaactcagacagaatttgtagtggttgtgctcttattcacttctgtatattggttctcaaataggatataaatatcctaaactaatataatattagagtaaaacatcaaaacttagaatcagagtccaaagagactatattaataagaaaaaattagatagtgtagcatactttaaaatgtcaatcatctcgaagcaaacaagaacaatgcaagagtagcaacaacaaaatataatttaaaacaaaaatgtataatatagcttaaatatgactattttacactgatgagaaaagtgcaatttattaacatatagcagtcctctgcttttgtgtatgaaatgacatagtaaacaaacaaacaaaaatgttcactacaagtataatttgacagaactgtagtccagtgggaaatcctcttagaatatgacagatcaaatacaaaacttcagtaacacaattatttgactttgtgaaacatatatgaatttgtgccctcccctctctc

SEQ ID NO: 76715 - DNA, 296 bp, Homo sapiens
actgtaagaggccaggggcagtctcatgaccacacgagtcaaatcaagccaggcttcatgagaactggccttgggaagttgccaaggaccaaagtagtttcttcatctctcagaggcctcatggtttctgtgatctttgcttctctccgtgccagtctgattctattctgtctctcagaccacattctctgtttgcccatggcccaacctgattgtcaaccccaagtgaatacattttcacaagtccacaatcaatgatgatggatctcctctgtttcctaatttgaattcttagc

SEQ ID NO: 76716 - DNA, 1057 bp, Homo sapiens
ggcccagattttcttataaagtcaaatgggagatacttgtttgcaagaaatagttcttttggttcttacttttccataaggattgagtctcaaaatgtctggtagcatccactgcattttgtaggggacaataacaaagaagatgccagcaatatcttctatcttttccaacattattcacctctcccacccaaggacaatggtgggctggacagagcattcaatgaccgagaatctaccataagctactagggccacatcttcccctttcttctcccccaggtttgtcccatttgtactgactctgacccaggttgtcatgacttgagactcactagaagtttcagaaagatgcagactgctttaaaaaaaaaaaaaaaaagggcaaggggaggtgtgagaagaaagtataattctttttcttctaacgggagatataaaaatcatataagcatgatttatcatttgattggaacattgtattttatggttgcagagcacatgtatcatcctatctgcttctgacacccagtaagcagctctggcttttataattttgatgaaagaggtttcctaacagtatttcggtgtgcatgctcacacaccagccctggtcatcagtgaacagattcttccaggtcttcattgtagcggaagaaagtgagatcagagatcccgaggaagggcttcagtttcaccagtagtggagctagggagtagcggggcagaagccgcaggaagtcagtgcaggacgccggaggccactcctaattgcttcatgtgttgttgccgtgctgatgaccttggaggcgctgctggtcctggatccttgcgaccttttcttccaagaggaaatgtggtgctgagccccccttccactggctgtgacaaagaaggacccctcatgtgggggcctaattctagtgaatccccaaaggtacatgttgaaatagggaaaaggcccaggtgaggctgtctatgtaatagagaagatccattgcaaaatgaaaatatggggttctagccaggggcagggaacttaatctcccttttccat

SEQ ID NO: 76717 - DNA, 400 bp, Homo sapiens
caagcacctgtagtcccagctactcaggaggctgagacaggagaattacttgaacctgggagacagaggttgccatgagccaagatctcaccagtgcattacagcgtgggtgacagagcgacactctgtcaaaaaaaaaaaaaaaaaaaaaaaaagtccaaaaagtaagtaaagaggaggtttggaattagatatttggtgtatgaatgaatgggctaaagtgcaaaagaacaggcagaataactgagctggtacagaggaaaaaaatcacacttaaaatctaaaagtatctgcttctcaatttgggctttcccacttagcagctttgacaccttagaaagaacacttaacttacctgagcttctattacttctaaaaagtgcataaagtgcaggctaag

SEQ ID NO: 76718 - DNA, 449 bp, Homo sapiens
ttccgcagatgaaattctctggctaaacactctccttattttagggatcagacacagagcctgcttatccccaaacagtaggcttcagttccctgccagctcaaggacgaattattcagacaagccagtcacaccctcccgtgggaaccaggctcactctgcacttttgttactacaaagcctgcctccagcagcccctccttgttaccgtgttccggagtgtagcctccacattgccctgcatagtgtgcagggtccttctcccctggactggagtatctgtgaccagtcagctgctgttgattgcatccgtcctgcatcaagtgttgtgtgttcggccatccccgtatctctgggggtggggacaggggcgggggcaggagcgtggggggaaggaatccctctttcatcaatggagtaaagagtgtgaataaaacgattggcatcac

SEQ ID NO: 76719 - DNA, 459 bp, Homo sapiens
agaactacccaaagccatgcctggctttcgctctgagtatcctaagcccaacctgatgcctcttcaacgataccactctttccacttcagataatctgacctgtgccaagatgcccaggtggatgcctgtttaaactgatatacaccctcacccaccttattctcatttctgctgcctgtaagaacccacctgccccaaatacttaaagagtaacaatttctggttgaggcactgaaaattaaacatggctgttttgactaatccacaacttcactcagttgctctataataagtaaggacatgctccactgtaactataatcaggaatcatgatgtgaaaaatatttctttttaaaaaaatgtagttatataaaaagtcacaagtcattgtaaaaaaaatctttggttatatatttgaggaattatttttattaaaaataatatgacattagatttct

SEQ ID NO: 76720 - DNA, 2040 bp, Homo sapiens
  misc_feature (1)..(1): n is a, c, g, or t
  misc_feature (4)..(4): n is a, c, g, or t
  misc_feature (137)..(138): n is a, c, g, or t
  misc_feature (155)..(155): n is a, c, g, or t
  misc_feature (168)..(169): n is a, c, g, or t
  misc_feature (261)..(261): n is a, c, g, or t
  misc_feature (263)..(263): n is a, c, g, or t
  misc_feature (326)..(326): n is a, c, g, or t
  misc_feature (378)..(378): n is a, c, g, or t
nacncctgacctcaggtgatccacccacctcggcctcccaaagtgctgggattacaggcatgagcacccacccagtgagagatttatatctataagggttgtagcctgcagggttgtccttctgacaggctgggaannatagcctccagccagangcagaaacagacnnttcaaggaggaggtaaaggaaatagcaatttatgctgagtggaatggccaaatagatttatttaataagctctaggaggagtcatgaatatntntggaaggagaaatgcatgcacgcacaattgagtttcttgcttcttcatgggtcccatgtacanaaatggcagtgttagcatgatcccagggtggagttttcagccctctgacatnaaaaggtgaagcagaggacatgaaaactcgctctgtgcatcctctgtacgctggccagaacctctccatcgtgggtggtctcttatcaggcaagaaaggagaggttgatatcagtggtggaggctttgaaagggctggtttctgttaaatccttagggaagaaagcctcatcatggttagcaaaggagggggtataacgatgtgtatcttaaccccatcatcccatcctagcaaagctgagaactcagttttgaaagttactctggggtcccctcagccaagagtgggtctgttcagtcagttgggagcttagaatttcattttcatttatcaatgctaatgcgaaagagtacgctgtcttcatggcagctgaatttgcaagaaactccttggatggggttaatggcagctgtatttttctgggagctctgctttaattggataaagtaagttctggtaagatttcttcatcttcagtatctcaaatgttttcatttaaataatctttataacaacttttgatgtctgagtggattcccacacagtcatctattgtaagactttctgattccttttttttcctttggtcattatgaatagggcttctgtaaataactgcatggtagcttttgatgggaaataacatcaaagtagttgtcaaaatacttaggaatgttatttttggattgtaaggtgagacttgtttagctttggaaaaaaatgcacaacttgtaataggggaggaaaaataattttctgtttttggaattcttagatggaacgctctgtaaaaactgacagattaaaatgagaaaaacagaaaagtttaaaaacatgtatatcttatggttacatgggagatactcagggaaaaatgagtaaatctccaacaggtggctttcaattcaagcataaatactatcttcaacttaaagaaagaagatttgaggtgcagtagtggggagctaaccagcaaaagcacattagacaagggtaaggtgcgttatacagacttaagtccacgcattctcattgataagactcttcagtgatttagtatccttctcttcttggcgtcgagagaggtagcttttaaatggtgatttccttatagatgtaaattttccttacacaagtaacttctctattttcacaacttcctttgttagcattttttttcaaaataattagcttggaataattcttaagccaaagggacatattttggggttgcatattctggtttcctaccattatatttcggggtggcatagtttggtcttatacactgtgttccactggcaatgaaaagagttcttggttttcctccagcaatttgtcatttgttaaagagcttagcagttctaagagatatagaccagctgtgctatctttttgtggttttcagttctctagtatgttgagcatctttttgtaagtgtacttgccatctgtagatcttctttggtgaagtgtctgttcagatctgtgtgcatttttaattgggttgtttaacttattgtttagttttaacaattttttatatattttgaatacaaattctcagatctgtattttgcaaatattttcttcaacatgtggcttgtctttttgttctcttaacaaggtctcttccagagtataaactgtaaatattaagaa

SEQ ID NO: 76721 - DNA, 381 bp, Homo sapiens
catctgcctcttcttgatccaggctcgcttttctgtcctgtctcctctgtcatctagaactttgatccaccactcctctttttcatgtgtcttcaactctccctctccaaagataatttcctgtgaatctgtcatactctatgtgctttctctactcttaaacacatccttgatcctaactgtcccttacactattgtcctctcccctcttgctgcttcgtttatatgaaccagcctttctcacctggggctgtgggtgataactaagctctgatgtcctaaggaagggacaaactgtcacctgaaagccacatgtggccaccatctttttttgtagggcttgtgggctaagaatggtttatatattttttgaaggttgaa

SEQ ID NO: 76722 - DNA, 496 bp, Homo sapiens
tgatgatgatgatgttgatgatgatgatgatgatgacaacctatacttatagagggtggcagtgtagtttactaagagtcaaggcaacttattttataatactggctgtgtcttcttggccaagtcattaacttctctgagcctctgtttctgcatctgttcatagggttgtgacaattaaacaaaaaaaaaggcatgaggagcccttatcatgatgattgacatagaataagagctccataactggaatccattttttaaaataatctttttgaatgtattatatatatatatttgtatacaaaatacatgtatgtatttttatatacatcctctcctttgaccctcagagtaaccatgtccaagtttggaatttgagatctggaaatgtggattctaaaatccttcacctctttgagccttggtttcctcatctgtaaaatggggagaattgttaggaatattaaatgaactaataaatgcaaagttgttcaag

SEQ ID NO: 76723 - DNA, 1629 bp, Homo sapiens
aaaaggtggagatccagatctagggggagaattggctaggttcttcatcacagtcactgtcttgagacacataggtggtccatggaaacatttccatgagggatttcagaggggagaatgggcagactgcaaagcctcggtactctaataccaggcaaaaagaagaaagggaacaggcattttagttttcacattgaaacagagtgtatgtgtatggccctatgcaaatgttgttcctggtgaatattcatcaatgtactcatcacacataggtatatttagacagaaaggggtcctcatcacagacacccaaattatgagcacattactgcctcctctcccctagaggtgcttcttccagcctcccccattggaggccagcacaagacgggctctccaacccaatatcttccccttccctccttcctttctgctcaggtggctgagtatacacattgaactcttttgtttcaacttcacgtgtatataggttggtgcaaaagtaactgtggtgttttccattaaaagcaatgtcaagaaccgcaattactttggcaccaacctaatatgtatgcaagtacattctttaacctttccaactcccagtccaagccatcaggctaatttccgcgtggaatttgtggtcactggtttgcagtcctttcatttctggtgtggtcagaagtctccttcagactcttcccgataagttgccataggcttcttcatcacctttagtacctacccacttttgctgggataacactacccaagataaattcaaaaaaattgtcctaagtgttagtgtgtttctgttttggttgaagtctattattgctatatggttttctactgtttctacttgatggaagactattaagggttaagtaggctggcctaggaagctgaccaccatttataacatacttttgagtgggaaaatgcattcagaggcctgtaatcaatacttaggtggactttgggaatatagtatttattttatgagtgactagaatattggtagaaccatagaaactttgaatgtggagctggaaagcctcctccttcccccactgagatcaattgattaacaagctaggttgtagaaaccaagtgaaagaggcaaaaacttggccaagggcatgtagtcggggacttctgaagattctgctgggctgggggcaggaaaggggtcacagacggtcttagggttgtctcactcagcaactcactgtgttggccttgggaaatgtaagtcactgtgttgggctgtaatggaaatattgagaaagcagctcagctagtggcgtggggagaggttgtctagtcctctggcttatctgtaaattcctggcatgtgcttgttggagcagaatgaatggggctgctgtgttttacctgcagctaggagcatggctggagtggtggagacactccctgtggtctgttctaaaaatagcagtgggaacagagctgaggggaagaggagggggctccttcgggagctgggtggggaggcctcacccccttcctcttcctgccaggcccgatgtgaggaagtcccatggagtcacataattccatctgggagagtcctggagccatcagccctcacaccccctcctcata

SEQ ID NO: 76724 - DNA, 692 bp, Homo sapiens
actcatagtatagctatttgtgtgtgtgtgtgtctgtgtatgtgtgtatgtgtgtgtgtttactagaactttagtagcatctggtctcataggttatttgggcattcagatgaagaagatttgtcccagaaattagaaactcttttagtgctaagcctcttactttgatattgtctagctaagtttaatgagtactttgggacatgccaagccagagatacaaaccaaagtgaagcaattggccttttctctgggatatattatcaggcagctttaaaagtaagattcaagtatatgaccagtgttatctgtaatatgttaatgtcagccacatacctgcatgaagatcatgcaactgatgtataattcagaattgaaccatataggttctttgagaacctgactttttattagctccaggtttacagactgacactgtcacagcagctcaagtctgaacttgccaaggtacaacagtgtgaatgattgactttaattccctgtcatgtgttttcttgagcctgttacaccactgcggtatggatgtgtgacccagtgacaatgttcactgccagttgttttgtccagtgccacagagatcattggccctctactgcagttgtgttacaatttgcaaatgtttggatgataccatgttttttatccaaaattaaaaaccttcagtcttttgc

SEQ ID NO: 76725 - DNA, 350 bp, Homo sapiens
tgtttgttttacaggggatcctagctaaatagaagagtagaggaaaaacgactgtttcaacccttaccgtaatcaactttattgtgataaagattcacatattttgcaatatgtcttatctttatggaaattaaaaaatccaatcacagaatcaaaacttcagaaatatagccaaatataagtggaaatttagtatacaataaatgcaacatctcaaattagtggagaaaaatagaattattaaaaagcagtattggaaaaaccatatacctatatggaacaagataaaattagatctattcattacattcaataccaaaaaattctaaatatatcagatatttaaatgt

SEQ ID NO: 76726 - DNA, 962 bp, Homo sapiens
accgcgaacctgttttaatcagcaaagtcttttataaccctgtatttttgtggctgacttccaatcccatcctgtgacttagaatgcctaacactgtctggaatgcagcccgatctgtggagtggctgcagcacctgtgtttcagcctgaagaatgggcacagatatttcatgattctgaagaagaattggaggtgagacttgagaaaatggagaaaaagatatgctttggattttcttgaagactagaagctttcttaaccatccaccaccttgttgactggttattattctctctaccttctgtgaaacaaactgatggatactaatggcacaattacacttatagctagtcagttgcatagtttatgcacatagttctgcttccagtgtttagtaatgagttaaacattttggctatatttgtctctgaagctataatttcattaatcattatgtatagcaataataacaagtaaaacaaaaagaagaattttttgtttttatggtaattatgttgggtgctttggatcctcccaataaagttgacttccctaaaataattacacttgaattaggtatagagaagctaattgtaacaaattgaaagttactgtaaatcttctaatcgtagttctctgcaagtgtacttaagttattgctccacttgaaataaatgaaaactggaaatctgaggtgatgaattatgggtcccttttatgtaagaaagatgacaaggaaatctaatctgctgagttatactaaaataaaataccttggcctgggatcaaatataggtgaaagaattaacatttatgttttttaattaagataaaatgtacaagttttatgtacatattttatgatttcctgatataacaaaaagtgttgataaaagcacccaatactgattctaatgacatttgattagcattaaagagttgctattattattgttgttgt

SEQ ID NO: 76727 - DNA, 990 bp, Homo sapiens
accgcgaacctgttttaatcagcaaagtcttttataaccctgtatttttgtggctgacttccaatcccatcctgtgacttagaatgcctaacactgtctggaatgcagcccgatctgtggagtggctgcagcacctgtgtttcagcctgaagaatgggcacagatatttcatgattctgaagaagaattggaggtgagacttgagaaaatggagaaaaagatatgctttggattttcttgaagactagaagctttcttaaccatccaccaccttgttgactggttattattctctctaccttctgtgaaacaaactgatggatactaatggcacaattacacttatagctagacgggacgcatacgcacatgcacatagaatatggtctcaggcgccgaaacttgagcaaaacattccgccgtagtattagaatcctgccctctaccagcattgggggttatgactaccaggtggagccccccctgcccagccaccaccaccccccccgccctcgaggcggagtagagctccgcagaacgagtgagaagatagatagaatcacctgtcctcgggggagggatacaaccccgcggcgaggtctccccaccgcaggggtagaaagagccaccactccgagtaccacccccccccacgactcgtcaagtggcctcagattgagtcgatcgtgccgcgtgcccgaccgtataccccggtaccaactctggtgggcaccgacattggcgcctcggcagggctacgccgcccaccccccgcgggccggaggatgacacccaagtagcacaccttgagagcccagtacggatcagcagcgatgactggatggtccctatgccctacagagagagggggctaccggcgaatgagggcggctttccacgcggcgccgtaccagaatctggactgtgcggaagggcggcgcatctccgtcgataaagtgacccagatatagagagacctgtccagctctc

SEQ ID NO: 76728 - DNA, 438 bp, Homo sapiens
gctagctccacttctctacttcctcacacagctaaaaaaaacaaaaccgtctattctagaacagtttaagcacatgaaactagagaattgtgtgatgaaccccaaactagttttacttaaccaacacacacacaccacacacacacttttaaagtatgtcaggtcagaggccgttttcacctatcggcacttcagtatgcgtcactaactagtgaggaccttattaaatgaaacagtcaccaaccatgccatcacagcaaggttaataagaatcccttcctgtcctccgacacgcagttcacagtcacatttccctgattgacttaaaaggtctttttcacagttgatttattttgatcagtatctaaacagaatccacacatgacacttggttgctatgtctgttaaaactcttttatttatagggtctgccttccc

SEQ ID NO: 76729 - DNA, 533 bp, Homo sapiens
tatgccctccatcctcacctcttaatgtcctttaatgaactgttcacctatcatatgtctataggttgtaggttttttgtcccgagcaaggtttaaagtcataattttcaattcagtactttggaaaacttcactaaatttaactacgtatgttcagatgtctcttttaaggtttattttatataatagtgtaagataagtagccaaataccatgaggaaagacttgtccttcctgtcatggcagaaagactgaaatatgacttggggaatcatatggacataaaccaaaatgtatttttctgtgtgcaaattactgtataaataagcacacaaaaagctgttgaggatcatagggcagagtggggaaactagtattagaaaaattatctagtgtgagaaatttgccataaagttggtagtacaaaccatttttctaatataccttagcttatagtctttgctggcttcttaatgaaatatgaaaatttgtaagaaagtatctacaggaaaacattctcaactacaaattcat

SEQ ID NO: 76730 - DNA, 538 bp, Homo sapiens
gtcaagaaaggaatttggaggataggagtatctacatgtagtgggggaggccttgtatctggagcaggtttttaaattctctcccttttttttttttttttttttaaaggacacaatgtggcatagtataaacaggaagatactgttgagggttacgtttctcaggtattcggcaggtgatctgcacagatggagagaaggaagatggagcagggccggtcaggagagggaagacagcagtgatgaggccttatggagcccaaagccccacctccctgggatccactcagctaatactgaggagggcatctctgtcctcagcttgtgactcttcagaggctgtggtaccagagtgcacaccttacagagaatacatgaatgaatagatgttgaaattttctacccctataatttttcaaccttttgccccttactccttccctcttctccttccttccttttctaaaatttttttttaaaaagtgctcacaaaaaagcaaattaaaaatcccggtatcatttacaaagtaaaaagaaa

SEQ ID NO: 76731 - DNA, 461 bp, Homo sapiens
tgagatggagtcttcctctgtcacccaggctggagtgcagtggtgccatcttggctcactgaaacctctgcctccctggctcaagcaattctcctgcctcagcctcctgagtagctgggattacaggcatgcgccacctgtaatggctaatttttgtatttttagtagagatggcgtttcaccatgttggccaggatggtctccaactcctgaactcaaatgatcctcctgcctcagcctcccaaagtgctgggattacaggcgtgaaccaccatgcccagccaatatgtgaaattttttttaactgcttactataactcttattctaatgtcatagacactgaaagagagaagttaaactgtgctaaaaatattacattttgaaggaaacattaatttctgatatacaccaacagaatgaggaattctaaaaagagcatttggtgtgcaattataatgta

SEQ ID NO: 76732 - DNA, 472 bp, Homo sapiens
ggtttcaccatgttggccaggttggtctcaaactcctgacctcaggtgatccacctcagcctcctaaagtgctgggattaaaggcgtgagccaccacacccacacctggccctcaaccatctctttcaccttctgctcatgacagtttactagaatttttttcccttgagactgaatgtcaagtcaaaaacaataaaaaattgctaatcattactatgactccagagctacttgcttctttaaaaattcctgaaattataaaatataaagccaaagcaatgaatttctaatggtggaattgtagacactgtggccccctggggatgttatttcagatggggcaaggggatattcctaacctattttaaatcatgccagcctagataactatgtgaaaattatatgggtgcttagcaaaactattaactagcacccctttggcagttttacattaaaaatcctttattagctt

SEQ ID NO: 76733 - DNA, 487 bp, Homo sapiens
gtttattcagtttgaagaaaaaaattgaaactaaaaaacatacatagaatgttacaaaaatatttaaaattttgtctaaatggacaagtatttaacaatttcagctttctagaaatggagtcaccccctttaacatgttctttggacattggactgttgtatatattttcagaaagacatgattatatagcactatatctcttcaggacaggaactgtgttttactcttctttatgcccatgtgacctagaacgtattttgttcttaataagtatttgtccacaagtgaactatcacacagaaaaaggaatctggatcagataggattaagtttatctacatactacagaaaaacccaaaataacgatgttgaagagatagagctgtacttttatgtgtagaagtaccaagacaggcaggcagtccaggattggtgtggaggctccagaagttcctaggctctctccagctttctgcccaacataac

SEQ ID NO: 76734 - DNA, 461 bp, Homo sapiens
ctgactgtagtaactgagaatggtttcacaggagaggtggcacagcattctctcaacaagtagggaacacagcatgagccaaatcatggaggtataaaagcgtgagctacattagcaagcatctaatagatctgaaatctataatgcaagccaagctgtaatgacctgtggaaggctgtgaatgctattctcttaacagtacaataatagctatcatttattgagtatgtaccaagcattgaaatattttaacattttttatttcattcaaataacatcttcctaacactcttatgtagaggaactattattatgcccattttataggagaggaagctaaggctaaagaattaagcaaattcccaatgtatcatggctagaaagtagaagaaaggaaattcaagtcagtcagatccaaagccttgcttttaacttctgacttagaatacaatgatgagcca

SEQ ID NO: 76735 - DNA, 213 bp, Homo sapiens
gggccaaatgtctgagatccctttctgtcttcattgtagatttctactctgtttgtttgttgaactgaatccctcttttcttttacgtcaatttaatctgccttgttcctccatcattgcaaaaagaaaaacaaagtctagctacacccacctacctactcagagataagaaagcttcttttgtacatgtgtaaattatttcatttaaaatga

SEQ ID NO: 76736 - DNA, 394 bp, Homo sapiens
ggataattattttgtacttaattttatatacagtaaaagcctgggttgtcatttttaaaaatcctgtgcttcaaacaattgagcagacatcaagtccctgaaactgaaacttccatttatttaatgcggcgactcgcagactctttggactcaagaattcctttgaccgtcttaaaaattgtaccccagagagcttttctttaggtgggttataacttcagtatttaccatattagactacactttgagaacactgttttaatgtatttccttgatctgactaaataaaataacagggatattttaaggagagggatttggtgtaattcagtattgagtactggcaatgcataaaacatgggtaggtgtcactcacacaggaagacttgaccaa

SEQ ID NO: 76737 - DNA, 343 bp, Homo sapiens
ctctggctccaagagtctgaacctccccaaattgctcctgtggataatatcactattgtaaaacctagatcagcgcttgagatattttgcagaccctgcactggatggatcaactgataccacccagactggtaatctggctcaaccagttctgccatcctacccaggaacagaagacagcaagaaaacatcacttaaatcccctattcaatccatctccaacctaaccaatcagcactccccgcctcccaagctcttacccaccaaattatcttttaagactctgatccccatatgcttgggaagactgatctgaataataataaaactctggtttcaccca

SEQ ID NO: 76738 - DNA, 554 bp, Homo sapiens
tcattagtaagtagaagtaccataaagtatctaaaactccagtggtgattactggaatgggtgaagagtgaatagggcagggtggtgaagtaggaggaagacaatccttggcattagactctcctggctcctcacttcttagccgtgcatcctttggaggttacttcatttctctaaaggtggctttctcaactgcaaaatagcactgcttacgcctaccccgtgaggtgctgtagatcctcagcctgttgaagggttgatatgggcctggcacagagtgagccctgtggatgctctgtatccctgtctctcttcacctgcacatgtaggcttatccaaaatgaggactagaggtaataaaattgcaccatgttgggattcctgctcaatgagtaaattttagccgctcttgtcccaaaaacagcaaaatgggtaattatgtgagataatggatatgttaatttgctttttcatagtaactattttactatctatatgtatcccataacgtcatattgtgtaccttaatatacacaatacactttatttaaaaa

SEQ ID NO: 76739 - DNA, 724 bp, Homo sapiens
ggatggtagacaaagttagtgaaagtaaaaccaatcatttacttagctactagccatttaaatgcattcttgaagaggaagtattaatagattaaacttacatgaacttaaaatatttttatgtcttctttatgaataactaagaattgaacctatattgttgattctaaagcgaaaaatcagaaaaggattgtgtgaaaagtaaaatgaatgtagcataactgctttatgaagtgtggaaatacaatgcagaaagacaatgtccggctgggcacagtggctcacacctgtaatcccagcacttaaggagaccgaggcgggtagatcaattgagttcaggagttccagaccagcctggccaacatggtaaaaccccgtctctaaaaaaaaaaaaaaaagaaaaaagaaaaagaaagacaatgtccaaggcactttaattcaactaaaaccttgcatcacctgaatgaaaaattgggaacctatttttttccctttaattttgaactcttttagtaaaatgacagaatgtcaatccctttgttatatatagtaaagcaggatactttatattggttcagtgtgtcatgtttgttcatttggacaaatgtaacttacaggtgaaaatgcttatagggacctggtagagttatttgagagagagacacttaagtacagagcagttgtattaacagtttatatttgtttaaaatacagtttatatata

SEQ ID NO: 76740 - DNA, 154 bp, Homo sapiens
  misc_feature (143)..(145): n is a, c, g, or t
  misc_feature (148)..(151): n is a, c, g, or t
gcctgtctgtttgtgccgccaggagaccttggaagggacagagaaagagctggggttttgccatgttgcccaggctgatctccaacacctgggatcaagcagtctgcccaccttggcctcccaaagtgctgaaattacaggtnnnacnnnnatg

SEQ ID NO: 76741 - DNA, 426 bp, Homo sapiens
cccgaaggagtcactgatcacatcagaccacaggggtcggcccacctcgggtttgggacagtgttctttcctggaatgaagcagtggcaatgcctctggcacaggattgctgggcctgcaggaggccaggaggcacctctgtgctgtgttcccagtaggaggaggcagctactacttgtaaggcacacatatcattttgcattggaaaagtgaagataggcttgctgcagagggagtgatgggagagttcaccttaaattgttctactgaggaagggctccaaagagccagtgggttttccgcaggcagacggggttctccctgtccggctcaccagtgcaggaagccagggaagaaattactgtgggaattctgttatttcacaagcacttcatacctgcatccctgcacttggcaccgcaggcc

SEQ ID NO: 76742 - DNA, 637 bp, Homo sapiens
cgcgccagatggggcgggaggaggggagacccggcacccaccggcccagagctgcctgacgcggcctgggcggaccccgccgcccgggtgcctaggcacgattccagggatccagggtaaagcggttcgcgcgggaacaggaggatatgtcaggcacaggctattccccatcactatagccacagaggactggtccagatgcggatcccgatctgtgcttcttcagatggttggataccaagaaagctgctcaggaaaccttacaacacaatggaaaaaacattggagctcctggttaagccttcagactccaggaggcacaccattgggctcctcaagttctcacccctttggtctcagactgaattataccaccaacttccctggttctccaccttgcagatggcagattgtggaacttcttggcctccatagttgcatgaagcaattctcatattaattcgccacttacatatctatacatattctcttgggtctgtttctctggagaaccctgacttatacatgaccttcatgtatagctaaataacaatgtattaatattttccacagaggtgtcatgtctctgtatattaaatgatccaaggccaggcgcggtggctcacgcctgtaatcc

SEQ ID NO: 76743 - DNA, 2408 bp, Homo sapiens
atgggagttgcataggagagatggatgtgtgtaaacattatcactaaaatgataaacagaatacccattagaattcttagaactattaatgatcaagaggggtggaggcatttcttggtatcaaataactggttaaggttactttgggcgaaatctatttcctttttgtttttgttgttggataacaagaaatgtctagactaatattcatcagttttacaaacataatgaaaattagttgatttttagttgatttttttgtcccaacattttttttaacctttttgccactcattatatgtttgcagttctaggtctttgacagctgaagaccacaggaatcaaacaggcgagacacacagaatactgacccttctttacgcttttatagtgtttataccatatggcccagtgtggaattcttgattatccaagtgcctttggtcatttgtggcaggaaaacttaatagtttttagccagcagtgccacagccagcttttactgcaatacctaaagggtcaagtagtgtttttgtaccactattatttcaaatttaagtattctgccatgaaacgatccatactgggctggaacttgacatgtgaaatctttaatactaaagcttatctctgcttggcagctttttaggagaataatgagagttacaattttgactcttgcgttcctagaattcaaatggcatagctttctgaaatgagtatttcaagtttagtagtccgtataggagtgttgtgacttcaatttcagtgttcttgttaaaagaaataatatgatatatatatacacacatatatataacttgatgccagttttctagtaagcctcagtcttttattcactactcaatgataatgcattgtacaaacactgtcacatgagtaaataaaaatgaataattccttagaagatggagagtgttaaattatatttgtgataggaagcttagacatatcttttggttattagcttccattgccaattgtatttcagatgcatagggttttcttcccaaaaatatattgttaacttttatagctaactagcacctggaaaaaatgtatttgtacaactttactattgtatatagttttataataatgaaaaataaacccaatggccatattagaatgcaatttcgacatacagcttatctagatagttttccagaggattttgaaatttggcttaactgggaggataactgctcagcacaccactgaaacataaccactgacaccattcatttattttaactgagattcttgacatttttctctcctatgccttgttactttagcatacttgaactcacataaatgcttctttggattacatgggctatctgattccattttggatctgattgtccatcttgaattcaatatggtattcatctggactattcaaaaattatgccatttctagtctgtgaaataagatgtaaaaaatctttatttttgccctttggtaaaaacctatgtgacaacttttaaaatgtgaagcaacatctaatatagttgactggtatactaataggaaagtgaaagtatttcatgggtactttgtcacagaatgtgaaaagaaacttggcatagtggcctttataatgaggcatccacttactcctctgaagtgaagtctgtagcttagcttgtgtatagtttttgaaagaaatctcatgatcttcgttcattctcttgccttctcttttatctcatatggcacaagtagagggggaagccaggaggaaattcatcaccttgctatgcttttatttgatttttaattcctgagtgcctaaatgtggtgaccggcacctcacataactttttgagattcttgatgtcatttttatccttcctgtcaaccagcaatgtatttttatgttactaaaaccagtaacgtcataattgttgagggcaagcttcattgttgatagtgcaaagtgtcgctgttgtgatgtgtgtttattttattcaagtttgaatattgacaagtgtaacttaagctggtgactgacacctattgatctgctgtgtgcaaatgatagtactattttttagaaaactcttaagtaaattttaaaaatatttgaatacaaaatatctgagcaattttgaactcaaaagtttttcattgttttaaggattgccacaggactctttaatggtttttaatggacatacatgcctaatatttattggtgtgtttaaaatattttttgatagagtgttatgtcttaagcgcattagaaaacaattgtttgtaatggaatcaaagtgtttccctggacagtttgatgtgcttatggttgagatttataatctgcttgtactttgctttttaacttattaactgtaaataaattttagagaatacaaaaaaa

SEQ ID NO: 76744 - DNA, 2013 bp, Homo sapiens
  misc_feature (1992)..(1992): n is a, c, g, or t
  misc_feature (1994)..(1994): n is a, c, g, or t
atgggagttgcataggagagatggatgtgtgtaaacattatcactaaaatgataaacagaatacccattagaattcttagaactattaatgatcaagaggggtggaggcatttcttggtatcaaataactggttaaggttactttgggcgaaatctatttcctttttgtttttgttgttggataacaagaaatgtctagactaatattcatcagttttacaaacataatgaaaattagttgatttttagttgatttttttgtcccaacattttttttaacctttttgccactcattatatgtttgcagttctaggtctttgacagctgaagaccacaggaatcaaacaggcgagacacacagaatactgacccttctttacgcttttatagtgtttataccatatggcccagtgtggaattcttgattatccaagtgcctttggtcatttgtggcaggaaaacttaatagtttttagccagcagtgccacagccagcttttactgcaatacctaaagggtcaagtagtgtttttgtaccactattatttcaaatttaagtattctgccatgaaacgatccatactgggctggaacttgacatgtgaaatctttaatactaaagcttatctctgcttggcagctttttaggagaataatgagagttacaattttgactcttgcgttcctagaattcaaatggcatagctttctgaaatgagtatttcaagtttagtagtccgtataggagtgttgtgacttcaatttcagtgttcttgttaaaagaaataatatgatatatatatacacacatatatataacttgatgccagttttctagtaagcctcagtcttttattcactactcaatgataatgcattgtacaaacactgtcacatgagtaaataaaaatgaataattccttagaagatggagagtgttaaattatatttgtgataggaagcttagacatatcttttggttattagcttccattgccaattgtatttcagatgcatagggttttcttcccaaaaatatattgttaacttttatagctaactagcacctggaaaaaatgtatttgtacaactttactattgtatatagttttataataatgaaaaataaacccaatggccatattagaatgcaatttcgacatacagcttatctagatagttttccagaggattttgaaatttggcttaactgggaggataactgctcagcacaccactgaaacataaccactgacaccattcatttattttaactgagattcttgacatttttctctcctatgccttgttactttagcatacttgaactcacataaatgcttctttggattacatgggctatctgattccattttggatctgattgtccatcttgaattcaatatggtattcatctggactattcaaaaattatgccatttctagtctgtgaaataagatgtaaaaaatctttatttttgccctttggtaaaaacctatgtgacaacttttaaaatgtgaagcaacatctaatatagttgactggtatactaataggaaagtgaaagtatttcatgggtactttgtcacagaatgtgaaaagaaacttggcatagtggcctttataatgaggcatccacttactcctctgaagtgaagtctgtagcttagcttgtgtatagtttttgaaagaaatctcatgatcttcgttcattctcttgccttctcttttatctcatatggcacaagtagagggggaagccaggaggaaattcatcaccttgctatgcttttatttgatttttaattcctgagtgcctaaatgtggtgaccggcacctcacataactttttgagattcttgatgtcatttttatccttcctgtcaaccagcaatgtatttttatgttactaaaaccagtaacgtcataattgttgagggcaagcttcattgttgatagtgcaaagtgtcgctgttgcagtgtgcttcgngngatcctctggaacagctat

SEQ ID NO: 76745 - DNA, 1252 bp, Homo sapiens
  misc_feature (1)..(1): n is a, c, g, or t
  misc_feature (148)..(148): n is a, c, g, or t
  misc_feature (151)..(151): n is a, c, g, or t
  misc_feature (274)..(274): n is a, c, g, or t
  misc_feature (492)..(492): n is a, c, g, or t
  misc_feature (508)..(508): n is a, c, g, or t
  misc_feature (620)..(620): n is a, c, g, or t
  misc_feature (753)..(753): n is a, c, g, or t
ncacaaagctaagttttgaatactctgtgtcactgcttccagctgatattataaaaggcagtggtgaggatttcagctaaaaaaagattcgttgtttcaaaagcccagcctgaagtaagacagtgccatagacacgaccacaccaganggnaggtggttcacaaagggccttgcattcttctttgctcttgtttactttacatgagggcaaggagtctcagaagcgtaagatataatactacactagacaggcaagcagacctaatgtgcaaantctcatgttggctatataggtagtttatatgtcagttccaattatgaatacattcctcagcaactagagttttctcattcattcttactgaactgttagggcatgtggcagcccagagctctgtcaaaatgaattgtcccccttgaaaagttggcaatgcaaggaagtgacaacctaatgcatgttagcactcttgataacaggacccagaggagacngcgaagaacaattggntatgtgtctgggcactggctgttgttcctgcctgggttcaaatctcctctctgccgcttatgatctgtgtgcatttacaagtttgttagcccccttacctctttgttccttntaaggttgtcgtgcaaattacatgaaatgatgttacaggtgtaagccaatgcctgacacacatatgtattctacagtaatcattatcaaagtggtaagcaggaaccagtgccatttcacaactatcaggtacncttctgggtactcatcatgaaagactgcagtgttccatttacaggcattggttggtggtttactaaagagtgtgtttttgtccaagaagttcactcactacattttgctcaaccagtcctctcatttgcagcgatttttttttctttgagcgtcccttgttgtgcagcataaacatctgggctgcatggtcagacccatgaggcttctcttccatctggccacctgttatataattaagcctgattgcagatgcgattctcatttagctgtcagcagcagcctgggagactagcaactgaggtgaataaaggtagctcaccacatctacaagggtagaagggctgaagcgaagggttgaccagccaggacaacaaaggttattgcttatggcagtgtcagcctaagagctcaagttcaagatcagaagcatgagagggtaagacctctaggggagtctgcataggtccaggtgaaaccctgggtgtctcttgattgtcg

SEQ ID NO: 76746 - DNA, 1106 bp, Homo sapiens
aagaaactccctttatctcccaaagggagatacaactacaggaaagccaaccaggcagcctcgtcgagtggctaagccaggcaagcccagcttggggctgacaagtcgggtggggagttgagaagttgttcacaaagtcctaatgactaaactccaccttgttgaaagagaccaactacatataatgtctgctcacaagtggtccgaccttgaggttaaaattgtctggactctggcaggatatgtgtatggattttaagtgacaggatcatggatcacctcctctaaacctgtcatttcccagacaaggacactgagacccacagaagtgaatgccttgcctggggctggcacgagttggcaaagttgctccccaccgggcccagggaaggaagctggctggctgcaggaggggcgtcgttctgcagctgcccaaatgcagccatgatgcatttgttttaaactagctttattttcagggggtgatgtttacctgaccttatccccaaattctttggcacctcacagtggaccccatgtgtacatccccatccctcccaggccactactgactttgtatcttgcgactcttcaaaggactggtgagaatggcactttgtacagaagacacacctgaaatgggagggggggtggacagaacttaaaaaaataaaagggccagccacagtggctcacacctgtaatcctaacattctgagaggttagaagcaagaggatggcttgagcccaggcatttgcagccagcctgagaaatagagcgagaccctgtctcaatcaatcaatcaaaaacgacagagatagatagatagatgatagattgatagatgatagatagatagatagatagatagatagatagatagatagcaacatggtctaaatgagtctaggagtggagtgtccttgaacttggggagaccaccctccactgcatttgcattattgatactatggctggagagggccttttgcctaaaagcttggagtatgttggggcccccgagagcaggtgagggccagaggttcagatcagaggatggaaaaaggaggtggagaacaggaaagaaaaacattttaataagaac

SEQ ID NO: 76747 - DNA, 1359 bp, Homo sapiens
gcatttggcgggatctgtgtctctcgctggtgctggcacaggagcttgggatctgtctcctctttcgcctcctgcaccttgagagccctgggctactctgtcacagcccctgttgccctgcgatctgtaggtccttggggacgcatagttaaggtgccaggacatcctggaagctgggaaatgaccatggctggagaaggaaagaaggtgtgttttgcctgactcagtgactatagagagaaccaagttctgcaggcctgtcacctaagtctcagctgggtgtcacaaactctgaactggattccaaggctttcatgaatgcacttatgtttgctgtggcagctgcattatgtcgtgggggatgtggatgcagaacctcccattctgtcgtcttgcttatgttactctcctttatgtttcactttctcaaatgaatgtcaagcaggtgattttcagattcaaaagttctaaaataaattgctcaaatttacacattatgtaagctgttaataaaatttcttgtaggtgctacatatttattaaaatttttggttgtaattttaagctcactgtaggcagaaaggaatcattaagatttctattcttttttagtctgtatctaaatgaccatatattttaattccaaatatttactttatacttcagtaatgctcattgtattttgcaaaatttatattgttcttttatttgaaaatataaggctttttttagctcctgaaatctatattatagtcatatagttttattatagtatttgataagaagagcagcaacatattgagaacagaataaaattctgctgtctttttaatgattatttattaaattcttctcattaaagcctattattaatgattgtaatgtatttactgtataattttactgcaatttattaaatgccaatgacttctaatgtctgcttttcatgactgcacacagtttaaagctgtagatatctaaagggttatttttcagcccggcatggtggtcacgcctgtaatcccagcactttgggaggccaaggtgggtggatcacgaggtcaggagatcaagaccatcctggctaccacggtgaaaccccgtctctactaaatatagaaaaaattagccgggcatagtggtgggtgcctgtattcccagctactcgagaggctgaggcaggagaatggcgtgaacccagtaggcggagcttgcagtgagccgagatggcaccactgcactacagcctgggcgacagggtgagactgtctcaaaaaaaaacaaaaagggcttatttttcattgtatatttatgttgtattcaggattttatgcattaaaatctctcttcttattttca

SEQ ID NO: 76748 - DNA, 1549 bp, Homo sapiens
gcatttggcgggatctgtgtctctcgctggtgctggcacaggagcttgggatctgtctcctctttcgcctcctgcaccttgagagccctgggctactctgtcacagcccctgttgccctgcgatctgtaggtccttggggacgcatagttaaggtgccaggacatcctggaagctgggaaatgaccatggctggagaaggaaagaaggtgtgttttgcctgactcagtgactatagagagaaccaagttctgcaggcctgtcacctaagtctcaggtgagtatgaattctcttgtgtttttcacagattgttgcagtggcaggaccaaggtcaaatgagttatagccaagtctacagtaagatgtggcagtattctgttttgaagccgggaccatgattgggcaagcttgccacttggtcaagtgctcaccctctgaaaatgtcttccttggtctttgcctccagctgggtgtcacaaactctgaactggattccaaggctttcatgaatgcacttatgtttgctgtggcagctgcattatgtcgtgggggatgtggatgcagaacctcccattctgtcgtcttgcttatgttactctcctttatgtttcactttctcaaatgaatgtcaagcaggtgattttcagattcaaaagttctaaaataaattgctcaaatttacacattatgtaagctgttaataaaatttcttgtaggtgctacatatttattaaaatttttggttgtaattttaagctcactgtaggcagaaaggaatcattaagatttctattcttttttagtctgtatctaaatgaccatatattttaattccaaatatttactttatacttcagtaatgctcattgtattttgcaaaatttatattgttcttttatttgaaaatataaggctttttttagctcctgaaatctatattatagtcatatagttttattatagtatttgataagaagagcagcaacatattgagaacagaataaaattctgctgtctttttaatgattatttattaaattcttctcattaaagcctattattaatgattgtaatgtatttactgtataattttactgcaatttattaaatgccaatgacttctaatgtctgcttttcatgactgcacacagtttaaagctgtagatatctaaagggttatttttcagcccggcatggtggtcacgcctgtaatcccagcactttgggaggccaaggtgggtggatcacgaggtcaggagatcaagaccatcctggctaccacggtgaaaccccgtctctactaaatatagaaaaaattagccgggcatagtggtgggtgcctgtattcccagctactcgagaggctgaggcaggagaatggcgtgaacccagtaggcggagcttgcagtgagccgagatggcaccactgcactacagcctgggcgacagggtgagactgtctcaaaaaaaaacaaaaagggcttatttttcattgtatatttatgttgtattcaggattttatgcattaaaatctctcttcttattttca

SEQ ID NO: 76749 - DNA, 699 bp, Homo sapiens
gcatttggcgggatctgtgtctctcgctggtgctggcacaggagcttgggatctgtctcctctttcgcctcctgcaccttgagagccctgggctactctgtcacagcccctgttgccctgcgatctgtaggtccttggggacgcatagttaaggtgccaggacatcctggaagctgggaaatgaccatggctggagaaggaaagaaggtgtgttttgcctgactcagtgactatagagagaaccaagttctgcaggcctgtcacctaagtctcagcttttgcatatgcagaagaagaattggatgaaattcagccttgattatgatgaaaactctcaacaagttaggaatagaaggtcctgtagctttttcttttgagacggagttttgctctgttgcccaggctggagtgcagtggtgcaatcttggctccctgcaagctccgcctcccggattcacgccattctcctgcctcagattccccagcagctgggaattcaggcacccgccaccatgcccggctatttttatttttatttgtttattttttttagtagagacagggtttcactgtgttagccaggatggtctcaatctcctgacctcgttgatccacccacctcggcctcccaaattgctaggattacaggcgtgagccaccgctcctggccggtcctgtagctattatttcctgtttttc

SEQ ID NO: 76750 - DNA, 3259 bp, Homo sapiens
gacccacgcgtacgacgagacgcgtgggatcagaaccacgacgtccgatagagtcacatttattgatttgcatatgttgaatcaaccttgcatcctggggacaaagccaactccattgttgcggatgaactttttaatgtgctgctggatttgttttgccagtattttattgaggatttttgcacagtgtttaccaaagacattggcatgatgtgttgttgttgttgttgttgttgtagtatctatgttaggttttggtatctggatgatgctggcctgatagaatgagttagagagaacttctttgtcttcaattttttttggatggttttaggagaaaaggtaccatctcctctttgtacctctgctcaaattcagcttgcttggtaggctagtttttactgcctcagtttcagaacacattattgatctattcagggttcagtcttgtggagggtttattttgcaaggaaattgtctatttcttctagattttctggtttatgtgcatacatatgtttatagtgttctctgattgttgttcatatttccatgggatcagtgatgatatctcccttattatttctaattgtgtttggttctcctttcttttcttatttatttgcctagctagtgttccatctagtttattaatttttttcataaaaacagctcctggatttgttgacttttttttttggaagagttttcagtgtctctatctccctcagctctactttgatcttggttatttcttgttttctgctacctttctggttagttttcacttggttttctagttcttttcatcaagatgttaggctgttaattttagatcttctagtttctcttttttttcttcttgtggcagagtctcactctgtcacccaggctggagtacagtggcatgatctccgctcactgcaacctccacttctcagttttaagtgatttctgctgtctcagcttcctgagtagctgggattacagatgtgcatcacaaaaaccagctaatttttgaattttttttgtagaggtggggttttgttgtgtggtccagactggtcttgaacatctggccttaagtgatttgcctaccccagcctcccaaagtgctggaactacaggcatgagccaccacacccagccctttctatctttttgatgtggacattagtgctataaatttccctcttttcttggtttccagtgattattttattctatcttggtgagtcatcagggaaataatcttaaatttacaatcaacatatagtttaaatccatataattgtgtgagaagaaccctttgttatttgaaggtgatgtttgaaagattttctaacggtgccttttagttagtcttaaatttctaattgtagttaaaaacatgccattgtcatttctgacattttaagtatatggtttagaagtggttagtatagttctattgttttgcagtaggttttagataatttgtgtcttacaaaagtaaaagtgaatactcattacttatgaaagaagttagttagcttgccttaggtagatagcaagagaagagtccctggaaagtccctggtcagtgcctcatccctgcataacatataaagaagcctggaaaaaatcaagctgcagacactaacaagggaactagcatatgttgttgtgcttggggacatgcccgtggctgcacagatagaaaaacctctggcccatttggataaaaacttgtagaaacctccagctcactcagataaaggaacaagaacgacctagcatagaaatgcctttgtttggccaggcacggtggatcatgcctgtaattccaacaatgtcggaggcagctgtgggcggatcatctgaggtcgggagtttgagaccagcatgaccaagatggacaaactctgtctttactaaaaatacaaaactagccaggcatggtgctgcatgcctataatcccagctacttgggaggctgaggcaggagaatcgctagaacccaggaggcggaggtttctgtgagccgagatcgcaccattgcactccaggctgggcaacaagagcaaaactgcaaaaaaaaataaaaataaataaaaaaagaaagtacatctcaaaaaaaagaaagacaagaaaaagaaaaaaaagaagcacttttgtctttgtacagtcagtgggctcccaggaaaatgttccttctctttttgttggcatgggcactgtgggatctggtgcattccggtcgacactctcgtttatttggactgtaagtctgacctctatgaataattacttcagaccctgagtgctcccgggccaagctccttggccaaactttcaccttagcttctgataagtcttgggccaagctaagcagcatctatcaatcatcccttcagctcctgattgatcccgggccaaaggctgggccaagctgagccacacgtttttcaagacagcctgtgaactaggcacatatccttcccttcccagtccataaaaaccctggacccagcctcgtagagggcaccactttcagacacctatctctgctggcaaagagctttcttctcttgcttcttaaactttcactccaacctcacctttgtgttcacgctccttaatctccttagaggtagaacaaagaactctggatgttatctcagactacgagagactgttacatcttggtgcactgctgagactacgacacttggtttctttgagtttgactaaatattttacatgagtgtaattatacagctttcctttttgactgtcttattttacttaacagaatgttttgaagatttgtccttattgtagtacttttcaagatttccttatttttaaggctgaatgctatcccagtgattgtacgtgccctgtttgctgaatctactcatccttaagggtacatttgcttccaggtaacatgtttgtgagtaatactacaatgtgcatatatctattccatgttctgctttgtctgtttgggatatttttcatacactgattcagtaccatgtgtattcccttgcttttgttgtctcatccgttgatgctacgtcccccaaattattgccacgaccagttgtaatgaagcttcacccttctgtattgtgctaggaattttacagctataggttttacattatagtcttcattcattttttaaaattgacacatgtaattgtgcatattttggggaaacaattatatatatgtgttgtataacaataaaaatcagagtacttctata

SEQ ID NO: 76751 - DNA, 994 bp, Homo sapiens
gcatttggcgggatctgtgtctctcgctggtgctggcacaggagcttgggatctgtctcctctttcgcctcctgcaccttgagagccctgggctactctgtcacagcccctgttgccctgcgatctgtaggtccttggggacgcatagttaaggtgccaggacatcctggaagctgggaaatgaccatggctggagaaggaaagaaggtgtgttttgcctgactcagtgactatagagagaaccaagttctgcaggcctgtcacctaagtctcagggcggggagaccttccttccccacgggtttgaggctatggctaagtggtgagccttggtgagacgcagaaaggatccatcccaggcacttggctagaggcaggttcctgggatctgataaaactgatattggagacgctggagctgatccgacatagcaatggtgttgactccctccttatgtgtggattgctcagcgggggaacttgactgtccaacatgctgggtgcaagaacagcagaaaggggacttttaagatgtggcaaacatgaggcctcttcggagaggactttggaaaccaggccttgcttggctgaatgctatcccagtgattgtacgtgccctgtttgctgaatctactcatccttaagggtacatttgcttccaggtaacatgtttgtgagtaatactacaatgtgcatatatctattccatgttctgctttgtctgtttgggatatttttcatacactgattcagtaccatgtgtattcccttgcttttgttgtctcatccgttgatgctacgtcccccaaattattgccacgaccagttgtaatgaagcttcacccttctgtattgtgctaggaattttacagctataggttttacattatagtcttcattcattttttaaaattgacacatgtaattgtgcatattttggggaaacaattatatatatgtgttgtataacaataaaaatcagagtacttctata

SEQ ID NO: 76752 - DNA, 973 bp, Homo sapiens
gcatttggcgggatctgtgtctctcgctggtgctggcacaggagcttgggatctgtctcctctttcgcctcctgcaccttgagagccctgggctactctgtcacagcccctgttgccctgcgatctgtaggtccttggggacgcatagttaaggtgccaggacatcctggaagctgggaaatgaccatggctggagaaggaaagaaggtgtgttttgcctgactcagtgactatagagagaaccaagttctgcaggcctgtcacctaagtctcagggcggggagaccttccttccccacgggtttgaggctatggctaagtggtgagccttggtgagacgcagaaaggatccatcccaggcacttggctagaggtaagtaaaaatagcctttgggccagaagacctgatagtttgggtactcgtctggacataagtccccatcttcccagaaatgtcgtcttttgtctgcaacaactggctggagaaatatttcagaaagatgtgtgcctggaacacccaaaggcatacctttcctttctccttggcataggccttgcagcactgaagaaagaccaggtttgcaacggagccttcaatactcttcatccctatggatctcaggggctcatagggtgacaggagaggagacaagctagcttgggaagagtctttgtccttcagcttctcctctactgaaacactatatacttggggccacagttcatagcaaaacacacatgctgtctttctttctctcacacccccatctcgggaacccaacaacttgatggcaggtagctctgggtatccttggtctggcattcacccactgggcatctaagctgtcctaaagctcttttcaatcacttctcactgtttccaggcccatgtgggtaggtgttccagccttcactctttcaggctgttcataaaggcacagtgtgggaaaatcccctactgtgatggccattg

SEQ ID NO: 76753 - DNA, 4226 bp, Homo sapiens
ttgttaactttgtcaaagatcaggttgttgtaggtttttggctttatttctaggttctctactttgtttcatttgtctatgtgtctgtttctataccagtaccatgctgtttttgttactgtactcttctagtatagtttgaagttaggtagagtgacacttccagcttttttttttttttcttaaggttggcttggctatttgggctcttttttggttccatatgaactttaaaagtttttatttttctaattctctgaagaatgtcagtagttcaatgggaatagcattgaatctatgaattacttagggccatatgcccatattcatgatactgattcttcctctccatgagcatggaatatttctccatctgttttgtgtccactctgatttctctgagcagttgtttgtggttctccttgaagaggtccttcactttctttcttagctgtattcctaggtatttttttctctttgtagcaaatgtgaatgaaagttcattcatgatttgtctccctgcttgcctgttgtttgtgcatgggaatgctagctacttttgcacattgattttatatcctgagattttgctactgttgcttatcaccttaagaagctttgggcctgagacaatgaggttttctagatgtaggatcaggtcatctgcaaacaaagataatttgacttcctctctttctattagaatactctttatttcttcctctggcctgattttcctggccaaggcttctgatactatattgaatggtagtggtgaaagagggcattcttttcttgtgccagttttcaggtggaacgtttctagcttttgcacattcagtatgatattggctgtgggtttgttgtatatggctcttattattttcaggtatgtttcttcacttcctagtttattgagaattttaaacctgaaagaatgctgaattttattggatgctttttctgcatttattgagataatcatgtggtttttgtatttagttctctttatgtgatgagtcacatttattgatttgcatatgttgaatcaaccttgcatcctggggacaaagccaactccattgttgcggatgaactttttaatgtgctgctggatttgttttgccagtattttattgaggatttttgcacagtgtttaccaaagacattggcatgatgtgttgttgttgttgttgttgttgtagtatctatgttaggttttggtatctggatgatgctggcctgatagaatgagttagagagaacttctttgtcttcaattttttttggatggttttaggagaaaaggtaccatctcctctttgtacctctgctcaaattcagcttgcttggtaggctagtttttactgcctcagtttcagaacacattattgatctattcagggttcagtcttgtggagggtttattttgcaaggaaattgtctatttcttctagattttctggtttatgtgcatacatatgtttatagtgttctctgattgttgttcatatttccatgggatcagtgatgatatctcccttattatttctaattgtgtttggttctcctttcttttcttatttatttgcctagctagtgttccatctagtttattaatttttttcataaaaacagctcctggatttgttgacttttttttttggaagagttttcagtgtctctatctccctcagctctactttgatcttggttatttcttgttttctgctacctttctggttagttttcacttggttttctagttcttttcatcaagatgttaggctgttaattttagatcttctagtttctcttttttttcttcttgtggcagagtctcactctgtcacccaggctggagtacagtggcatgatctccgctcactgcaacctccacttctcagttttaagtgatttctgctgtctcagcttcctgagtagctgggattacagatgtgcatcacaaaaaccagctaatttttgaattttttttgtagaggtggggttttgttgtgtggtccagactggtcttgaacatctggccttaagtgatttgcctaccccagcctcccaaagtgctggaactacaggcatgagccaccacacccagccctttctatctttttgatgtggacattagtgctataaatttccctcttttcttggtttccagtgattattttattctatcttggtgagtcatcagggaaataatcttaaatttacaatcaacatatagtttaaatccatataattgtgtgagaagaaccctttgttatttgaaggtgatgtttgaaagattttctaacggtgccttttagttagtcttaaatttctaattgtagttaaaaacatgccattgtcatttctgacattttaagtatatggtttagaagtggttagtatagttctattgttttgcagtaggttttagataatttgtgtcttacaaaagtaaaagtgaatactcattacttatgaaagaagttagttagcttgccttaggtagatagcaagagaagagtccctggaaagtccctggtcagtgcctcatccctgcataacatataaagaagcctggaaaaaatcaagctgcagacactaacaagggaactagcatatgttgttgtgcttggggacatgcccgtggctgcacagatagaaaaacctctggcccatttggataaaaacttgtagaaacctccagctcactcagataaaggaacaagaacgacctagcatagaaatgcctttgtttggccaggcacggtggatcatgcctgtaattccaacaatgtcggaggcagctgtgggcggatcatctgaggtcgggagtttgagaccagcatgaccaagatggacaaactctgtctttactaaaaatacaaaactagccaggcatggtgctgcatgcctataatcccagctacttgggaggctgaggcaggagaatcgctagaacccaggaggcggaggtttctgtgagccgagatcgcaccattgcactccaggctgggcaacaagagcaaaactgcaaaaaaaaataaaaataaataaaaaaagaaagtacatctcaaaaaaaagaaagacaagaaaaagaaaaaaaagaagcacttttgtctttgtacagtcagtgggctcccaggaaaatgttccttctctttttgttggcatgggcactgtgggatctggtgcattccggtcgacactctcgtttatttggactgtaagtctgacctctatgaataattacttcagaccctgagtgctcccgggccaagctccttggccaaactttcaccttagcttctgataagtcttgggccaagctaagcagcatctatcaatcatcccttcagctcctgattgatcccgggccaaaggctgggccaagctgagccacacgtttttcaagacagcctgtgaactaggcacatatccttcccttcccagtccataaaaaccctggacccagcctcgtagagggcaccactttcagacacctatctctgctggcaaagagctttcttctcttgcttcttaaactttcactccaacctcacctttgtgttcacgctccttaatctccttagaggtagaacaaagaactctggatgttatctcagactacgagagactgttacatcttggtgcactgctgagactacgacacttggtttctttgagtttgactaaatattttacatgagtgtaattatacagctttcctttttgactgtcttattttacttaacagaatgttttgaagatttgtccttattgtagtacttttcaagatttccttatttttaaggctgaatgctatcccagtgattgtacgtgccctgtttgctgaatctactcatccttaagggtacatttgcttccaggtaacatgtttgtgagtaatactacaatgtgcatatatctattccatgttctgctttgtctgtttgggatatttttcatacactgattcagtaccatgtgtattcccttgcttttgttgtctcatccgttgatgctacgtcccccaaattattgccacgaccagttgtaatgaagcttcacccttctgtattgtgctaggaattttacagctataggttttacattatagtcttcattcattttttaaaattgacacatgtaattgtgcatattttggggaaacaattatatatatgtgttgtataacaataaaaatcagagtacttctata

SEQ ID NO: 76754 - DNA, 796 bp, Homo sapiens
tagcccccatgactcaaattgtacttccttgcacatatttgatgttaacaagtatgttttaaaaattttaaataaccccatttgcaataaaatcatttgcaatgattttctcacagtcgaggcaggctgttggctcggttaggacagatgccctgatcatgtagtttcagagaccactggagggagctgcccatgatttacaattgctggcctcttctacgtggccacctcagccataagtgagagtatataggtgaactaagaggtggagccataaacatttctcttttactgtcttacaggtatttgtggtggttgatttttctagaggaaggttatttatataaagcttcactaatatccatttagttatgtggatagcaggtccatgaactgcaaagtgatatttctgaggtatctctaggaggaatgcactttcagtgccctaggataactccaaaaactcaccagtagttttctgttaaatgtcaggcaaccacagtaactttcatgacatccacaggaactacatttttcagtcccactatgcctgggcctttgagtggtacatgcattcccactaaatagctactccattacccagggaaatgaagtcaggttgagctactccaatcaaatttcattttttaggatgaatcccatcatctgaataactcaggactattaaagcctcaaaatgtttctctgtaagaacctcaggcaacaccaggacaaacccaaagagagtttaggtgaaacttagcttcgtatgtgcagcaaagagacgccaacagag

SEQ ID NO: 76755 - DNA, 348 bp, Homo sapiens
gcacatttgacctaatgaactgacaattcactgctaattttaggttccatttgacttaatcctaaaaatgagagcataagtagataacagcctgtacattgaagtagttccagaaatattggatttatctaaaattatgtttttcattatagtgtagttgccctgtaaatttttattgatggtagtgcataaaaaggcattaaaatttgagacttcctgattttagaaggtttatgccaagcaagtttgacacttttaagcttacaccaaatgggtgaattgtgatctaagaattgcttaagactatacttgggtgcagttttcattttttgaaggctgctttacgtg

SEQ ID NO: 76756 - DNA, 498 bp, Homo sapiens
cctagtatttcctcagctgagtgcatggggccagaccacactggggagggcagtcagcgtcactcagagcaccgggtcatctcatgcagaaacaccctcaaagaaatagcccaaattatgctgaccaaatatctgggcaccccgtgccccagacaagttgacacagaaaattaaccatcacaggttaactccatccaggagtggaattgctgggtcatagagaaggcataggaattcacagaaatcaccaaacggttttcaggcggttgtgccatgttaaactcccactggaaagagaggagagctgtgattgttccacgtcctcagcaacgtttagaataggcagtctttggccgggccgggcacagaggctcaaacctgtaaccccagcactttgggaggccatagtgggtggattacctgagatcaagagttcaagaccagcctggccaacatggttaaaccccgtctctattaaaaatgcaaaaattagccagg

SEQ ID NO: 76757 - DNA, 936 bp, Homo sapiens
agagcgtattatgaagtagaggcagcaactgggtgggtggatggacatgcatgaacaggaagcctggtaccatgccaggctagtacctcaattcaactgagtaatcaaggttcctacagattagtcattacaaactgttcaccaggacaaactgtgctttaaattgattgcatgcttatcttgtgttttacctgtaatttttcaacaagatttgtgtcatattgaccagagtatatcaatcttgaaaaagctgataaaaaagtgtatttttattaagatttataaaaataatatattgcatatcacgactgctcatacaactctgttgaagcattgccactgaggtaaatggagagaaaaattctattacaatactacatgctttactgcactaatattttcccgttgattttaagctgtattgaaaagcaaactggacccttcaggagtcatttgttgtagcatttgaaaaaagcattgattttaacatgggggcatataatcaagtttcagaaacattcacattgagatgagctttgaaaggttatttgtcagtgtttcatttgtccaacctctgaatattaaatttttaagtctttctcccttatcctctatctcatgtctaaagtaatttcctttagaattatgtcattattttaaaattgccaacttaccatgtttcttatttcatctttcacatacagaattaaaataactaataaggtgaagaaatatggagaattttttaattgcttaaattataatggttttgatgacaaaaataattatggaataattaagaattttaaatgacccaaggattaagtctccatgcatcttttgacattgtcgtcatcaacacaaagggaaagcaagtgtgaaagattgcacaatgggttttgtgacatggcctcaaaccaactgcaaagaatgaga

SEQ ID NO: 76758 - DNA, 2600 bp, Homo sapiens
ttaggtacgaggccgcggattactcggccgagggtggagcagcgcgcgcaagcgaggccaggggaaggtgggcgcaggactttagccggttgagaaggatcaagcaggcatttggagcacaggtgtctagaaacttttaaggggccggttcaagaaggaaaagttcccttctgctgtgaaactatttggcaagaggctggagggcccaatggctgcaaaatcgcaacccaacattcccaaagccaagagtctagatggcgtcaccaatgacagaaccgcatctcaagggcagtggggccgtgcctgggaggtggactggttttcactggcgagcgtcatcttcctactgctgttcgcccccttcatcgtctactacttcatcatggcttgtgaccagtacagctgcgccctgaccggccctgtggtggacatcgtcaccggacatgctcggctctcggacatctgggccaagactccacctataacgaggaaagccgcccagctctataccttgtgggtcaccttccaggtgcttctgtacacgtctctccctgacttctgccataagtttctacccggctacgtaggaggcatccaggagggggccgtgactcctgcaggggttgtgaacaagtatcagatcaacggcctgcaagcctggctcctcacgcacctgctctggtttgcaaacgctcatctcctgtcctggttctcgcccaccatcatcttcgacaactggatcccactgctgtggtgcgccaacatccttggctatgccgtctccaccttcgccatggtcaagggctacttcttccccaccagcgccagagactgcaaattcacaggcaatttcttttacaactacatgatgggcatcgagtttaaccctcggatcgggaagtggtttgacttcaagctgttcttcaatgggcgccccgggatcgtcgcctggaccctcatcaacctgtccttcgcagcgaagcagcgggagctccacagccatgtgaccaatgccatggtcctggtcaacgtcctgcaggccatctacgtgattgacttcttctggaacgaaacctggtacctgaagaccattgacatctgccatgaccacttcgggtggtacctgggctggggcgactgtgtctggctgccttatctttacacgctgcagggtctgtacttggtgtaccaccccgtgcagctgtccaccccgcacgccgtgggcgtcctgctgctgggcctggtgggctactacatcttccgggtggccaaccaccagaaggacctgttccgccgcacggatgggcgctgcctcatctggggcaggaagcccaaggtcatcgagtgctcctacacatccgccgacgggcagaggcaccacagcaagctgctggtgtcgggcttctggggcgtggcccgccacttcaactacgtcggcgacctgatgggcagcctggcctactgcctggcctgtggcggtggccacctgctgccctacttctacatcatctacatggccatcctgctgacccaccgctgcctccgggacgagcaccgctgcgccagcaagtacggccgggactgggagcgctacaccgccgcagtgccttaccgcctgctgcctggaatcttctaagggcacgccctagggagaagccctgtggggctgtcaagagcgtgttctgccaggtccatgggggctggcatcccagctccaactcgaggagcctcagtttcctcatctgtaaactggagagagcccagcacttggcaggtgtccagtacctaatcacgctctgttccttgcttttgccttcaagggaattccgagtgtccagcactgccgtattgccagcacagacggattttctctaatcagtgtccctggggcaggaggatgacccagtcacctttactagtcctttggagacaatttacctgtattaggagcccaggccacgctacactctgcccacactggtgagcaggaggtcttcccacgccctgtcattaggctgcatttactcttgctaaataaaagtgggagtggggcgtgcgcgttatccatgtattgcctttcagctctagatccccctcccctgcctgctctgcagtcgtgggtggggcccgtgcgccgtttctccttggtagcgtgcacggtgttgaactgggacactggggagaaaggggctttcatgtcgtttccttcctgctcctgctgcacagctgccaggagtgctctgcctggagtctgcagacctcagagaggtcccagcactggctgtggcctttcaggtgtaggcaggtgggctctgcttcccgattccctgtgagcgcccaccctctcgaaagaattttctgcttgccctgtgactgtgcagactctggctcgagcaacccggggaacttcaccctcaggggcctcccacaccttctccagcgaggaggtctcagtcccagcctcgggagggcacctccttttctgtgctttcttccctgaggcattcttcctcatccctagggtgttgtgtagaactctttttaaactctatgctccgagtagagttcatctttatattaaacttcccctgttcaaataa

SEQ ID NO: 76759 - DNA, 370 bp, Homo sapiens
gtggggagagggtccagctcacaggcgaggggccgctggggctccggggaggcggggcggaggcgtggatagtccccctcccccacgagccggcgtctgagggatgctctgtccccgcgctgtctggagcttccccgggcgaaggctgcctggctccggggtcggctcctggccccatgccgcgctccgcggcggctctttctcctgccccacctgttgttcgcctccctctttgtcagtgctgagccaggcacagcagctttgcgatgggactggcttgtccgccgtcctccctgacatgcggctgttgaagccctgagcactggaccttctgcctcttgcttgactcctactgtgggccttgagcgtc

SEQ ID NO: 76760 - DNA, 2639 bp, Homo sapiens
tatctcggcctactgtgtgactccgacccctggctagagggtaggcggcgtggagcagcgcgcgcaagcgaggccaggggaaggtgggcgcaggtgaggggccgaggtgtgcgcaggactttagccggttgagaaggatcaagcaggcatttggagcacaggtgtctagaaacttttaaggggccggttcaagaaggaaaagttcccttctgctgtgaaactatttggcaagaggctggagggcccaatggctgcaaaatcgcaacccaacattcccaaagccaagagtctagatggcgtcaccaatgacagaaccgcatctcaagggcagtggggccgtgcctgggaggtggactggttttcactggcgagcgtcatcttcctactgctgttcgcccccttcatcgtctactacttcatcatggcttgtgaccagtacagctgcgccctgaccggccctgtggtggacatcgtcaccggacatgctcggctctcggacatctgggccaagactccacctataacgaggaaagccgcccagctctataccttgtgggtcaccttccaggtgcttctgtacacgtctctccctgacttctgccataagtttctacccggctacgtaggaggcatccaggagggggccgtgactcctgcaggggttgtgaacaagtatcagatcaacggcctgcaagcctggctcctcacgcacctgctctggtttgcaaacgctcatctcctgtcctggttctcgcccaccatcatcttcgacaactggatcccactgctgtggtgcgccaacatccttggctatgccgtctccaccttcgccatggtcaagggctacttcttccccaccagcgccagagactgcaaattcacaggcaatttcttttacaactacatgatgggcatcgagtttaaccctcggatcgggaagtggtttgacttcaagctgttcttcaatgggcgccccgggatcgtcgcctggaccctcatcaacctgtccttcgcagcgaagcagcgggagctccacagccatgtgaccaatgccatggtcctggtcaacgtcctgcaggccatctacgtgattgacttcttctggaacgaaacctggtacctgaagaccattgacatctgccatgaccacttcgggtggtacctgggctggggcgactgtgtctggctgccttatctttacacgctgcagggtctgtacttggtgtaccaccccgtgcagctgtccaccccgcacgccgtgggcgtcctgctgctgggcctggtgggctactacatcttccgggtggccaaccaccagaaggacctgttccgccgcacggatgggcgctgcctcatctggggcaggaagcccaaggtcatcgagtgctcctacacatccgccgacgggcagaggcaccacagcaagctgctggtgtcgggcttctggggcgtggcccgccacttcaactacgtcggcgacctgatgggcagcctggcctactgcctggcctgtggcggtggccacctgctgccctacttctacatcatctacatggccatcctgctgacccaccgctgcctccgggacgagcaccgctgcgccagcaagtacggccgggactgggagcgctacaccgccgcagtgccttaccgcctgctgcctggaatcttctaagggcacgccctagggagaagccctgtggggctgtcaagagcgtgttctgccaggtccatgggggctggcatcccagctccaactcgaggagcctcagtttcctcatctgtaaactggagagagcccagcacttggcaggtgtccagtacctaatcacgctctgttccttgcttttgccttcaagggaattccgagtgtccagcactgccgtattgccagcacagacggattttctctaatcagtgtccctggggcaggaggatgacccagtcacctttactagtcctttggagacaatttacctgtattaggagcccaggccacgctacactctgcccacactggtgagcaggaggtcttcccacgccctgtcattaggctgcatttactcttgctaaataaaagtgggagtggggcgtgcgcgttatccatgtattgcctttcagctctagatccccctcccctgcctgctctgcagtcgtgggtggggcccgtgcgccgtttctccttggtagcgtgcacggtgttgaactgggacactggggagaaaggggctttcatgtcgtttccttcctgctcctgctgcacagctgccaggagtgctctgcctggagtctgcagacctcagagaggtcccagcactggctgtggcctttcaggtgtaggcaggtgggctctgcttcccgattccctgtgagcgcccaccctctcgaaagaattttctgcttgccctgtgactgtgcagactctggctcgagcaacccggggaacttcaccctcaggggcctcccacaccttctccagcgaggaggtctcagtcccagcctcgggagggcacctccttttctgtgctttcttccctgaggcattcttcctcatccctagggtgttgtgtagaactctttttaaactctatgctccgagtagagttcatctttatattaaacttcccctgttcaaataa

SEQ ID NO: 76761 - DNA, 2657 bp, Homo sapiens
atcatccgggggcgggcgcccctgccctgcgggtgacttcgacccctggctagagggtaggcggcgtgtggagcagcgcgcgcaagcgaggccaggggaaggtgggcgcaggtgaggggccgaggtgtgcgcaggactttagccggttgagaaggatcaagcaggcatttggagcacaggtgtctagaaacttttaaggggccggttcaagaaggaaaagttcccttctgctgtgaaactatttggcaagaggctggagggcccaatggctgcaaaatcgcaacccaacattcccaaagccaagagtctagatggcgtcaccaatgacagaaccgcatctcaagggcagtggggccgtgcctgggaggtggactggttttcactggcgagcgtcatcttcctactgctgttcgcccccttcatcgtctactacttcatcatggcttgtgaccagtacagctgcgccctgaccggccctgtggtggacatcgtcaccggacatgctcggctctcggacatctgggccaagactccacctataacgaggaaagccgcccagctctataccttgtgggtcaccttccaggtgcttctgtacacgtctctccctgacttctgccataagtttctacccggctacgtaggaggcatccaggagggggccgtgactcctgcaggggttgtgaacaagtatcagatcaacggcctgcaagcctggctcctcacgcacctgctctggtttgcaaacgctcatctcctgtcctggttctcgcccaccatcatcttcgacaactggatcccactgctgtggtgcgccaacatccttggctatgccgtctccaccttcgccatggtcaagggctacttcttccccaccagcgccagagactgcaaattcacaggcaatttcttttacaactacatgatgggcatcgagtttaaccctcggatcgggaagtggtttgacttcaagctgttcttcaatgggcgccccgggatcgtcgcctggaccctcatcaacctgtccttcgcagcgaagcagcgggagctccacagccatgtgaccaatgccatggtcctggtcaacgtcctgcaggccatctacgtgattgacttcttctggaacgaaacctggtacctgaagaccattgacatctgccatgaccacttcgggtggtacctgggctggggcgactgtgtctggctgccttatctttacacgctgcagggtctgtacttggtgtaccaccccgtgcagctgtccaccccgcacgccgtgggcgtcctgctgctgggcctggtgggctactacatcttccgggtggccaaccaccagaaggacctgttccgccgcacggatgggcgctgcctcatctggggcaggaagcccaaggtcatcgagtgctcctacacatccgccgacgggcagaggcaccacagcaagctgctggtgtcgggcttctggggcgtggcccgccacttcaactacgtcggcgacctgatgggcagcctggcctactgcctggcctgtggcggtggccacctgctgccctacttctacatcatctacatggccatcctgctgacccaccgctgcctccgggacgagcaccgctgcgccagcaagtacggccgggactgggagcgctacaccgccgcagtgccttaccgcctgctgcctggaatcttctaagggcacgccctagggagaagccctgtggggctgtcaagagcgtgttctgccaggtccatgggggctggcatcccagctccaactcgaggagcctcagtttcctcatctgtaaactggagagagcccagcacttggcaggtgtccagtacctaatcacgctctgttccttgcttttgccttcaagggaattccgagtgtccagcactgccgtattgccagcacagacggattttctctaatcagtgtccctggggcaggaggatgacccagtcacctttactagtcctttggagacaatttacctgtattaggagcccaggccacgctacactctgcccacactggtgagcaggaggtcttcccacgccctgtcattaggctgcatttactcttgctaaataaaagtgggagtggggcgtgcgcgttatccatgtattgcctttcagctctagatccccctcccctgcctgctctgcagtcgtgggtggggcccgtgcgccgtttctccttggtagcgtgcacggtgttgaactgggacactggggagaaaggggctttcatgtcgtttccttcctgctcctgctgcacagctgccaggagtgctctgcctggagtctgcagacctcagagaggtcccagcactggctgtggcctttcaggtgtaggcaggtgggctctgcttcccgattccctgtgagcgcccaccctctcgaaagaattttctgcttgccctgtgactgtgcagactctggctcgagcaacccggggaacttcaccctcaggggcctcccacaccttctccagcgaggaggtctcagtcccagcctcgggagggcacctccttttctgtgctttcttccctgaggcattcttcctcatccctagggtgttgtgtagaactctttttaaactctatgctccgagtagagttcatctttatattaaacttcccctgttcaaataa

SEQ ID NO: 76762 - DNA, 2634 bp, Homo sapiens
atcatccgggggcgggcgcccctgccctgcgggtgacttcgacccctggctagagggtaggcggcgtgtggagcagcgcgcgcaagcgaggccaggggaaggtgggcgcaggactttagccggttgagaaggatcaagcaggcatttggagcacaggtgtctagaaacttttaaggggccggttcaagaaggaaaagttcccttctgctgtgaaactatttggcaagaggctggagggcccaatggctgcaaaatcgcaacccaacattcccaaagccaagagtctagatggcgtcaccaatgacagaaccgcatctcaagggcagtggggccgtgcctgggaggtggactggttttcactggcgagcgtcatcttcctactgctgttcgcccccttcatcgtctactacttcatcatggcttgtgaccagtacagctgcgccctgaccggccctgtggtggacatcgtcaccggacatgctcggctctcggacatctgggccaagactccacctataacgaggaaagccgcccagctctataccttgtgggtcaccttccaggtgcttctgtacacgtctctccctgacttctgccataagtttctacccggctacgtaggaggcatccaggagggggccgtgactcctgcaggggttgtgaacaagtatcagatcaacggcctgcaagcctggctcctcacgcacctgctctggtttgcaaacgctcatctcctgtcctggttctcgcccaccatcatcttcgacaactggatcccactgctgtggtgcgccaacatccttggctatgccgtctccaccttcgccatggtcaagggctacttcttccccaccagcgccagagactgcaaattcacaggcaatttcttttacaactacatgatgggcatcgagtttaaccctcggatcgggaagtggtttgacttcaagctgttcttcaatgggcgccccgggatcgtcgcctggaccctcatcaacctgtccttcgcagcgaagcagcgggagctccacagccatgtgaccaatgccatggtcctggtcaacgtcctgcaggccatctacgtgattgacttcttctggaacgaaacctggtacctgaagaccattgacatctgccatgaccacttcgggtggtacctgggctggggcgactgtgtctggctgccttatctttacacgctgcagggtctgtacttggtgtaccaccccgtgcagctgtccaccccgcacgccgtgggcgtcctgctgctgggcctggtgggctactacatcttccgggtggccaaccaccagaaggacctgttccgccgcacggatgggcgctgcctcatctggggcaggaagcccaaggtcatcgagtgctcctacacatccgccgacgggcagaggcaccacagcaagctgctggtgtcgggcttctggggcgtggcccgccacttcaactacgtcggcgacctgatgggcagcctggcctactgcctggcctgtggcggtggccacctgctgccctacttctacatcatctacatggccatcctgctgacccaccgctgcctccgggacgagcaccgctgcgccagcaagtacggccgggactgggagcgctacaccgccgcagtgccttaccgcctgctgcctggaatcttctaagggcacgccctagggagaagccctgtggggctgtcaagagcgtgttctgccaggtccatgggggctggcatcccagctccaactcgaggagcctcagtttcctcatctgtaaactggagagagcccagcacttggcaggtgtccagtacctaatcacgctctgttccttgcttttgccttcaagggaattccgagtgtccagcactgccgtattgccagcacagacggattttctctaatcagtgtccctggggcaggaggatgacccagtcacctttactagtcctttggagacaatttacctgtattaggagcccaggccacgctacactctgcccacactggtgagcaggaggtcttcccacgccctgtcattaggctgcatttactcttgctaaataaaagtgggagtggggcgtgcgcgttatccatgtattgcctttcagctctagatccccctcccctgcctgctctgcagtcgtgggtggggcccgtgcgccgtttctccttggtagcgtgcacggtgttgaactgggacactggggagaaaggggctttcatgtcgtttccttcctgctcctgctgcacagctgccaggagtgctctgcctggagtctgcagacctcagagaggtcccagcactggctgtggcctttcaggtgtaggcaggtgggctctgcttcccgattccctgtgagcgcccaccctctcgaaagaattttctgcttgccctgtgactgtgcagactctggctcgagcaacccggggaacttcaccctcaggggcctcccacaccttctccagcgaggaggtctcagtcccagcctcgggagggcacctccttttctgtgctttcttccctgaggcattcttcctcatccctagggtgttgtgtagaactctttttaaactctatgctccgagtagagttcatctttatattaaacttcccctgttcaaataa

SEQ ID NO: 76763 - DNA, 2644 bp, Homo sapiens
cgaggaagctaaggctgcgttggggtgaggccctcacttcatccggcgactagcaccgcgtccggcagcgccagccctacactcgcccgcgccatggcctctgtctccgaggtgtgcgcaggactttagccggttgagaaggatcaagcaggcatttggagcacaggtgtctagaaacttttaaggggccggttcaagaaggaaaagttcccttctgctgtgaaactatttggcaagaggctggagggcccaatggctgcaaaatcgcaacccaacattcccaaagccaagagtctagatggcgtcaccaatgacagaaccgcatctcaagggcagtggggccgtgcctgggaggtggactggttttcactggcgagcgtcatcttcctactgctgttcgcccccttcatcgtctactacttcatcatggcttgtgaccagtacagctgcgccctgaccggccctgtggtggacatcgtcaccggacatgctcggctctcggacatctgggccaagactccacctataacgaggaaagccgcccagctctataccttgtgggtcaccttccaggtgcttctgtacacgtctctccctgacttctgccataagtttctacccggctacgtaggaggcatccaggagggggccgtgactcctgcaggggttgtgaacaagtatcagatcaacggcctgcaagcctggctcctcacgcacctgctctggtttgcaaacgctcatctcctgtcctggttctcgcccaccatcatcttcgacaactggatcccactgctgtggtgcgccaacatccttggctatgccgtctccaccttcgccatggtcaagggctacttcttccccaccagcgccagagactgcaaattcacaggcaatttcttttacaactacatgatgggcatcgagtttaaccctcggatcgggaagtggtttgacttcaagctgttcttcaatgggcgccccgggatcgtcgcctggaccctcatcaacctgtccttcgcagcgaagcagcgggagctccacagccatgtgaccaatgccatggtcctggtcaacgtcctgcaggccatctacgtgattgacttcttctggaacgaaacctggtacctgaagaccattgacatctgccatgaccacttcgggtggtacctgggctggggcgactgtgtctggctgccttatctttacacgctgcagggtctgtacttggtgtaccaccccgtgcagctgtccaccccgcacgccgtgggcgtcctgctgctgggcctggtgggctactacatcttccgggtggccaaccaccagaaggacctgttccgccgcacggatgggcgctgcctcatctggggcaggaagcccaaggtcatcgagtgctcctacacatccgccgacgggcagaggcaccacagcaagctgctggtgtcgggcttctggggcgtggcccgccacttcaactacgtcggcgacctgatgggcagcctggcctactgcctggcctgtggcggtggccacctgctgccctacttctacatcatctacatggccatcctgctgacccaccgctgcctccgggacgagcaccgctgcgccagcaagtacggccgggactgggagcgctacaccgccgcagtgccttaccgcctgctgcctggaatcttctaagggcacgccctagggagaagccctgtggggctgtcaagagcgtgttctgccaggtccatgggggctggcatcccagctccaactcgaggagcctcagtttcctcatctgtaaactggagagagcccagcacttggcaggtgtccagtacctaatcacgctctgttccttgcttttgccttcaagggaattccgagtgtccagcactgccgtattgccagcacagacggattttctctaatcagtgtccctggggcaggaggatgacccagtcacctttactagtcctttggagacaatttacctgtattaggagcccaggccacgctacactctgcccacactggtgagcaggaggtcttcccacgccctgtcattaggctgcatttactcttgctaaataaaagtgggagtggggcgtgcgcgttatccatgtattgcctttcagctctagatccccctcccctgcctgctctgcagtcgtgggtggggcccgtgcgccgtttctccttggtagcgtgcacggtgttgaactgggacactggggagaaaggggctttcatgtcgtttccttcctgctcctgctgcacagctgccaggagtgctctgcctggagtctgcagacctcagagaggtcccagcactggctgtggcctttcaggtgtaggcaggtgggctctgcttcccgattccctgtgagcgcccaccctctcgaaagaattttctgcttgccctgtgactgtgcagactctggctcgagcaacccggggaacttcaccctcaggggcctcccacaccttctccagcgaggaggtctcagtcccagcctcgggagggcacctccttttctgtgctttcttccctgaggcattcttcctcatccctagggtgttgtgtagaactctttttaaactctatgctccgagtagagttcatctttatattaaacttcccctgttcaaataa

SEQ ID NO: 76764 - DNA, 3247 bp, Homo sapiens
tatctcggcctactgtgtgactccgacccctggctagagggtaggcggcgtggagcagcgcgcgcaagcgaggccaggggaaggtgggcgcaggtgaggggccgaggtgtgcgcaggactttagccggttgagaaggatcaagcaggcatttggagcacaggtgtctagaaacttttaaggggccggttcaagaaggaaaagttcccttctgctgtgaaactatttggcaagaggctggagggcccaatggctgcaaaatcgcaacccaacattcccaaagccaagagtctagatggcgtcaccaatgacagaaccgcatctcaagggcagtggggccgtgcctgggaggtggactggttttcactggcgagcgtcatcttcctactgctgttcgcccccttcatcgtctactacttcatcatggcttgtgaccagtacagctgcgccctgaccggccctgtggtggacatcgtcaccggacatgctcggctctcggacatctgggccaagactccacctataacgaggaaagccgcccagctctataccttgtgggtcaccttccaggtgcttctgtacacgtctctccctgacttctgccataagtttctacccggctacgtaggaggcatccaggagggggccgtgactcctgcaggggttgtgaacaagtatcagatcaacggcctgcaagcctggctcctcacgcacctgctctggtttgcaaacgctcatctcctgtcctggttctcgcccaccatcatcttcgacaactggatcccactgctgtggtgcgccaacatccttggctatgccgtctccaccttcgccatggtcaagggctacttcttccccaccagcgccagagactgcaaattcacaggcaatttcttttacaactacatgatgggcatcgagtttaaccctcggatcgggaagtggtttgacttcaagctgttcttcaatgggcgccccgggatcgtcgcctggaccctcatcaacctgtccttcgcagcgaagcagcgggagctccacagccatgtgaccaatgccatggtcctggtcaacgtcctgcaggccatctacgtgattgacttcttctggaacgaaacctggtacctgaagaccattgacatctgccatgaccacttcgggtggtacctgggctggggcgactgtgtctggctgccttatctttacacgctgcagggtctgtacttggtgtaccaccccgtgcagctgtccaccccgcacgccgtgggcgtcctgctgctgggcctggtgggctactacatcttccgggtggccaaccaccagaaggacctgttccgccgcacggatgggcgctgcctcatctggggcaggaagcccaaggtcatcgagtgctcctacacatccgccgacgggcagaggcaccacagcaagctgctggtgtcgggcttctggggcgtggcccgccacttcaactacgtcggcgacctgatgggcagcctggcctactgcctggcctgtggcggtggccacctgctgccctacttctacatcatctacatggccatcctgctgacccaccgctgcctccgggacgagcaccgctgcgccagcaagtacggccgggactgggagcgctacaccgccgcagtgccttaccgcctgctgcctggaatcttctaagggcacgccctagggagaagccctgtggggctgtcaagagcgtgttctgccaggtccatgggggctggcatcccagctccaactcgaggagcctcagtttcctcatctgtaaactggagagagcccagcacttggcaggtgtccagtacctaatcacgctctgttccttgcttttgccttcaagggaattccgagtgtccagcactgccgtattgccagcacagacggattttctctaatcagtgtccctggggcaggaggatgacccagtcacctttactagtcctttggagacaatttacctgtattaggagcccaggccacgctacactctgcccacactggtgagcaggaggtcttcccacgccctgtcattaggctgcatttactcttgctaaataaaagtgggagtggggcgtgcgcgttatccatgtattgcctttcagctctagatccccctcccctgcctgctctgcagtcgtgggtggggcccgtgcgccgtttctccttggtagcgtgcacggtgttgaactgggacactggggagaaaggggctttcatgtcgtttccttcctgctcctgctgcacagctgccaggagtgctctgcctggagtctgcagacctcagagaggtcccagcactggctgtggcctttcaggtgtaggcaggtgggctctgcttcccgattccctgtgagcgcccaccctctcgaaagaattttctgcttgccctgtgactgtgcagactctggctcgagcaacccggggaacttcaccctcaggggcctcccacaccttctccagcgaggaggtctcagtcccagcctcgggagggcacctccttttctgtgctttcttccctgaggcattcttcctcatccctagggtgttgtgtagaactctttttaaactctatgctccgagtagagttcatctttatattaaacttcccctgttcaaataaaaaaaaaaaaaaaaaaaaaaaaaaaaaaaaaaaagggggggaaaaaaaaaaaaaaaaaaaacaaacaaaaacacaaaaaagaaagaagaaaacaaaacaaaaagaaaaacaaagacacagacaagaggaagggcgggggccgcgcaccacacccacgcgccgtgcagcaaccaacatacagaggccgcgcccaacacaaacgccaacgacgagcgcggggaccaccaagcagagagcacagcacactaatacgcactcagcgccggagccaagcccgcgacccaaaacaccacccaggagaggacgaaaacccaacccgccgcaacagagacaaaaatacgcaaaagacgaacaccccgcgggaggggccgaaacagtacaacgagcgcgacacacaaccagaaaaaagaggggccacgaaggggggggagagaactaagacacagcacaacgaacgcacgaggagggcggcggccaaaaccaagcaacgacccaggcccgagtggaggagcaaggcagctaagcgagaccgagaaggagagaaaaagagaagagaaagacacacagcgccgcgcgacgagacgagcagcacgcagccgcgccgaaga

SEQ ID NO: 76765 - DNA, 3036 bp, Homo sapiens
tatctcggcctactgtgtgactccgacccctggctagagggtaggcggcgtggagcagcgcgcgcaagcgaggccaggggaaggtgggcgcaggtgaggggccgaggtgtgcgcaggactttagccggttgagaaggatcaagcaggcatttggagcacaggtgtctagaaacttttaaggggccggttcaagaaggaaaagttcccttctgctgtgaaactatttggcaagaggctggagggcccaatggctgcaaaatcgcaacccaacattcccaaagccaagagtctagatggcgtcaccaatgacagaaccgcatctcaagggcagtggggccgtgcctgggaggtggactggttttcactggcgagcgtcatcttcctactgctgttcgcccccttcatcgtctactacttcatcatggcttgtgaccagtacagctgcgccctgaccggccctgtggtggacatcgtcaccggacatgctcggctctcggacatctgggccaagactccacctataacgaggaaagccgcccagctctataccttgtgggtcaccttccaggtgcttctgtacacgtctctccctgacttctgccataagtttctacccggctacgtaggaggcatccaggagggggccgtgactcctgcaggggttgtgaacaagtatcagatcaacggcctgcaagcctggctcctcacgcacctgctctggtttgcaaacgctcatctcctgtcctggttctcgcccaccatcatcttcgacaactggatcccactgctgtggtgcgccaacatccttggctatgccgtctccaccttcgccatggtcaagggctacttcttccccaccagcgccagagactgcaaattcacaggcaatttcttttacaactacatgatgggcatcgagtttaaccctcggatcgggaagtggtttgacttcaagctgttcttcaatgggcgccccgggatcgtcgcctggaccctcatcaacctgtccttcgcagcgaagcagcgggagctccacagccatgtgaccaatgccatggtcctggtcaacgtcctgcaggccatctacgtgattgacttcttctggaacgaaacctggtacctgaagaccattgacatctgccatgaccacttcgggtggtacctgggctggggcgactgtgtctggctgccttatctttacacgctgcagggtctgtacttggtgtaccaccccgtgcagctgtccaccccgcacgccgtgggcgtcctgctgctgggcctggtgggctactacatcttccgggtggccaaccaccagaaggacctgttccgccgcacggatgggcgctgcctcatctggggcaggaagcccaaggtcatcgagtgctcctacacatccgccgacgggcagaggcaccacagcaagctgctggtgtcgggcttctggggcgtggcccgccacttcaactacgtcggcgacctgatgggcagcctggcctactgcctggcctgtggcggtggccacctgctgccctacttctacatcatctacatggccatcctgctgacccaccgctgcctccgggacgagcaccgctgcgccagcaagtacggccgggactgggagcgctacaccgccgcagtgccttaccgcctgctgcctggaatcttctaagggcacgccctagggagaagccctgtggggctgtcaagagcgtgttctgccaggtccatgggggctggcatcccagctccaactcgaggagcctcagtttcctcatctgtaaactggagagagcccagcacttggcaggtgtccagtacctaatcacgctctgttccttgcttttgccttcaagggaattccgagtgtccagcactgccgtattgccagcacagacggattttctctaatcagtgtccctggggcaggaggatgacccagtcacctttactagtcctttggagacaatttacctgtattaggagcccaggccacgctacactctgcccacactggtgagcaggaggtcttcccacgccctgtcattaggctgcatttactcttgctaaataaaagtgggagtggggcgtgcgcgttatccatgtattgcctttcagctctagatccccctcccctgcctgctctgcagtcgtgggtggggcccgtgcgccgtttctccttggtagcgtgcacggtgttgaactgggacactggggagaaaggggctttcatgtcgtttccttcctgctcctgctgcacagctgccaggagtgctctgcctggagtctgcagacctcagagaggtcccagcactggctgtggcctttcaggtgtaggcaggtgggctctgcttcccgattccctgtgagcgcccaccctctcgaaagaattttctgcttgccctgtgactgtgcagactctggctcgagcaacccggggaacttcaccctcaggggcctcccacaccttctccagcgaggaggtctcagtcccagcctcgggagggcacctccttttctgtgctttcttccctgaggcattcttcctcatccctagggtgttgtgtagaactctttttaaactctatgctccgagtagagttcatctttatattaaacttcccctgttcaaataaaaaaaaaaaaaaaaaaaaaaaaaaaaaaaaaaaagggggggcgcgcgccctaaaaaagtattccccgcaggggggcgccaaatatttacgcttaccccacggtttctttggcacaagggggcgccccataaagggagagccagaataataaaagcaatgaggagctggggccggtggttatacacaacgctcgggagcgggggaacaacgcggtcataccaggcagcgatcccttgtgggacaaggagaccataaaaccctcggggggcggggacacacattgtgggggacaaccaaccctctagagaaatatttaagcgctcaaggggacaaatataaccacttccagcgtcgatacagcgtgttacacaaacgggcaattataccagccgtatga

SEQ ID NO: 76766 - DNA, 2959 bp, Homo sapiens
tatctcggcctactgtgtgactccgacccctggctagagggtaggcggcgtggagcagcgcgcgcaagcgaggccaggggaaggtgggcgcaggtgaggggccgaggtgtgcgcaggactttagccggttgagaaggatcaagcaggcatttggagcacaggtgtctagaaacttttaaggggccggttcaagaaggaaaagttcccttctgctgtgaaactatttggcaagaggctggagggcccaatggctgcaaaatcgcaacccaacattcccaaagccaagagtctagatggcgtcaccaatgacagaaccgcatctcaagggcagtggggccgtgcctgggaggtggactggttttcactggcgagcgtcatcttcctactgctgttcgcccccttcatcgtctactacttcatcatggcttgtgaccagtacagctgcgccctgaccggccctgtggtggacatcgtcaccggacatgctcggctctcggacatctgggccaagactccacctataacgaggaaagccgcccagctctataccttgtgggtcaccttccaggtgcttctgtacacgtctctccctgacttctgccataagtttctacccggctacgtaggaggcatccaggagggggccgtgactcctgcaggggttgtgaacaagtatcagatcaacggcctgcaagcctggctcctcacgcacctgctctggtttgcaaacgctcatctcctgtcctggttctcgcccaccatcatcttcgacaactggatcccactgctgtggtgcgccaacatccttggctatgccgtctccaccttcgccatggtcaagggctacttcttccccaccagcgccagagactgcaaattcacaggcaatttcttttacaactacatgatgggcatcgagtttaaccctcggatcgggaagtggtttgacttcaagctgttcttcaatgggcgccccgggatcgtcgcctggaccctcatcaacctgtccttcgcagcgaagcagcgggagctccacagccatgtgaccaatgccatggtcctggtcaacgtcctgcaggccatctacgtgattgacttcttctggaacgaaacctggtacctgaagaccattgacatctgccatgaccacttcgggtggtacctgggctggggcgactgtgtctggctgccttatctttacacgctgcagggtctgtacttggtgtaccaccccgtgcagctgtccaccccgcacgccgtgggcgtcctgctgctgggcctggtgggctactacatcttccgggtggccaaccaccagaaggacctgttccgccgcacggatgggcgctgcctcatctggggcaggaagcccaaggtcatcgagtgctcctacacatccgccgacgggcagaggcaccacagcaagctgctggtgtcgggcttctggggcgtggcccgccacttcaactacgtcggcgacctgatgggcagcctggcctactgcctggcctgtggcggtggccacctgctgccctacttctacatcatctacatggccatcctgctgacccaccgctgcctccgggacgagcaccgctgcgccagcaagtacggccgggactgggagcgctacaccgccgcagtgccttaccgcctgctgcctggaatcttctaagggcacgccctagggagaagccctgtggggctgtcaagagcgtgttctgccaggtccatgggggctggcatcccagctccaactcgaggagcctcagtttcctcatctgtaaactggagagagcccagcacttggcaggtgtccagtacctaatcacgctctgttccttgcttttgccttcaagggaattccgagtgtccagcactgccgtattgccagcacagacggattttctctaatcagtgtccctggggcaggaggatgacccagtcacctttactagtcctttggagacaatttacctgtattaggagcccaggccacgctacactctgcccacactggtgagcaggaggtcttcccacgccctgtcattaggctgcatttactcttgctaaataaaagtgggagtggggcgtgcgcgttatccatgtattgcctttcagctctagatccccctcccctgcctgctctgcagtcgtgggtggggcccgtgcgccgtttctccttggtagcgtgcacggtgttgaactgggacactggggagaaaggggctttcatgtcgtttccttcctgctcctgctgcacagctgccaggagtgctctgcctggagtctgcagacctcagagaggtcccagcactggctgtggcctttcaggtgtaggcaggtgggctctgcttcccgattccctgtgagcgcccaccctctcgaaagaattttctgcttgccctgtgactgtgcagactctggctcgagcaacccggggaacttcaccctcaggggcctcccacaccttctccagcgaggaggtctcagtcccagcctcgggagggcacctccttttctgtgctttcttccctgaggcattcttcctcatccctagggtgttgtgtagaactctttttaaactctatgctccgagtagagttcatctttatattaaacttcccctgttcaaataaaaaaaaaaaaaaaaaaaaaaaaaaaaaaaaaaaaaaaaaaaaaaaaaaaaaaaaaaaaaaaaaaaggggggggggccaaaaaatcccccggggggggcccattgggcacaccacatttgttgtgcacacaaggggggcccccaaaagaaggggcgcgacataaaacgcgcgagcgcggggcgcgcagttaaaaacaactggtgggcgagtgggaacactcggcggccagcggagggaactgcgggaggaggccaccatatgctgggggggggacacattgtgcggacacacaccaccgcgagatatcgacccccggggga

SEQ ID NO: 76767 - DNA, 2773 bp, Homo sapiens
tatctcggcctactgtgtgactccgacccctggctagagggtaggcggcgtggagcagcgcgcgcaagcgaggccaggggaaggtgggcgcaggtgaggggccgaggtgtgcgcaggactttagccggttgagaaggatcaagcaggcatttggagcacaggtgtctagaaacttttaaggggccggttcaagaaggaaaagttcccttctgctgtgaaactatttggcaagaggctggagggcccaatggctgcaaaatcgcaacccaacattcccaaagccaagagtctagatggcgtcaccaatgacagaaccgcatctcaagggcagtggggccgtgcctgggaggtggactggttttcactggcgagcgtcatcttcctactgctgttcgcccccttcatcgtctactacttcatcatggcttgtgaccagtacagctgcgccctgaccggccctgtggtggacatcgtcaccggacatgctcggctctcggacatctgggccaagactccacctataacgaggaaagccgcccagctctataccttgtgggtcaccttccaggtgcttctgtacacgtctctccctgacttctgccataagtttctacccggctacgtaggaggcatccaggagggggccgtgactcctgcaggggttgtgaacaagtatcagatcaacggcctgcaagcctggctcctcacgcacctgctctggtttgcaaacgctcatctcctgtcctggttctcgcccaccatcatcttcgacaactggatcccactgctgtggtgcgccaacatccttggctatgccgtctccaccttcgccatggtcaagggctacttcttccccaccagcgccagagactgcaaattcacaggcaatttcttttacaactacatgatgggcatcgagtttaaccctcggatcgggaagtggtttgacttcaagctgttcttcaatgggcgccccgggatcgtcgcctggaccctcatcaacctgtccttcgcagcgaagcagcgggagctccacagccatgtgaccaatgccatggtcctggtcaacgtcctgcaggccatctacgtgattgacttcttctggaacgaaacctggtacctgaagaccattgacatctgccatgaccacttcgggtggtacctgggctggggcgactgtgtctggctgccttatctttacacgctgcagaagagaacacggaggcaaggcgtgtgtcagaggcagagctggggtttgaccccaggccgctgggcccccgagcccacactcctgtcctctccctgggcaaagcaccgcttgaccccttccccctcgccccccagggtctgtacttggtgtaccaccccgtgcagctgtccaccccgcacgccgtgggcgtcctgctgctgggcctggtgggctactacatcttccgggtggccaaccaccagaaggacctgttccgccgcacggatgggcgctgcctcatctggggcaggaagcccaaggtcatcgagtgctcctacacatccgccgacgggcagaggcaccacagcaagctgctggtgtcgggcttctggggcgtggcccgccacttcaactacgtcggcgacctgatgggcagcctggcctactgcctggcctgtggcggtggccacctgctgccctacttctacatcatctacatggccatcctgctgacccaccgctgcctccgggacgagcaccgctgcgccagcaagtacggccgggactgggagcgctacaccgccgcagtgccttaccgcctgctgcctggaatcttctaagggcacgccctagggagaagccctgtggggctgtcaagagcgtgttctgccaggtccatgggggctggcatcccagctccaactcgaggagcctcagtttcctcatctgtaaactggagagagcccagcacttggcaggtgtccagtacctaatcacgctctgttccttgcttttgccttcaagggaattccgagtgtccagcactgccgtattgccagcacagacggattttctctaatcagtgtccctggggcaggaggatgacccagtcacctttactagtcctttggagacaatttacctgtattaggagcccaggccacgctacactctgcccacactggtgagcaggaggtcttcccacgccctgtcattaggctgcatttactcttgctaaataaaagtgggagtggggcgtgcgcgttatccatgtattgcctttcagctctagatccccctcccctgcctgctctgcagtcgtgggtggggcccgtgcgccgtttctccttggtagcgtgcacggtgttgaactgggacactggggagaaaggggctttcatgtcgtttccttcctgctcctgctgcacagctgccaggagtgctctgcctggagtctgcagacctcagagaggtcccagcactggctgtggcctttcaggtgtaggcaggtgggctctgcttcccgattccctgtgagcgcccaccctctcgaaagaattttctgcttgccctgtgactgtgcagactctggctcgagcaacccggggaacttcaccctcaggggcctcccacaccttctccagcgaggaggtctcagtcccagcctcgggagggcacctccttttctgtgctttcttccctgaggcattcttcctcatccctagggtgttgtgtagaactctttttaaactctatgctccgagtagagttcatctttatattaaacttcccctgttcaaataa

SEQ ID NO: 76768 - DNA, 2585 bp, Homo sapiens
tatctcggcctactgtgtgactccgacccctggctagagggtaggcggcgtggagcagcgcgcgcaagcgaggccaggggaaggtgggcgcaggtgaggggccgaggtgtgcgcaggactttagccggttgagaaggatcaagcaggcatttggagcacaggtgtctagaaacttttaaggggccggttcaagaaggaaaagttcccttctgctgtgaaactatttggcaagaggctggagggcccaatggctgcaaaatcgcaacccaacattcccaaagccaagagtctagatggcgtcaccaatgacagaaccgcatctcaagggcagtggggccgtgcctgggaggtggactggttttcactggcgagcgtcatcttcctactgctgttcgcccccttcatcgtctactacttcatcatggcttgtgaccagtacagctgcgccctgaccggccctgtggtggacatcgtcaccggacatgctcggctctcggacatctgggccaagactccacctataacgaggaaagccgcccagctctataccttgtgggtcaccttccaggtgcttctgtacacgtctctccctgacttctgccataagtttctacccggctacgtaggaggcatccaggagggggccgtgactcctgcaggggttgtgaacaagtatcagatcaacggcctgcaagcctggctcctcacgcacctgctctggtttgcaaacgctcatctcctgtcctggttctcgcccaccatcatcttcgacaactggatcccactgctgtggtgcgccaacatccttggctatgccgtctccaccttcgccatggtcaagggctacttcttccccaccagcgccagagactgcaaattcacaggcaatttcttttacaactacatgatgggcatcgagtttaaccctcggatcgggaagtggtttgacttcaagctgttcttcaatgggcgccccgggatcgtcgcctggaccctcatcaacctgtccttcgcagcgaagcagcgggagctccacagccatgtgaccaatgccatggtcctggtcaacgtcctgcaggccatctacgtgattgacttcttctggaacgaaacctggtacctgaagaccattgacatctgccatgaccacttcgggtggtacctgggctggggcgactgtgtctggctgccttatctttacacgctgcagggtctgtacttggtgtaccaccccgtgcagctgtccaccccgcacgccgtgggcgtcctgctgctgggcctggtgggctactacatcttccgggtggccaaccaccagaaggacctgttccgccgcacggatgggcgctgcctcatctggggcaggaagcccaaggtcatcgagtgctcctacacatccgccgacgggcagaggcaccacagcaagctgctggtgtcgggcttctggggcgtggcccgccacttcaactacgtcggcgacctgatgggcagcctggcctactgcctggcctgtggcggtggccacctgctgccctacttctacatcatctacatggccatcctgctgacccaccgctgcctccgggacgagcaccgctgcgccagcaagtacggccgggactgggagcgctacaccgccgcagtgccttaccgcctgctgcctggaatcttctaagggcacgccctagggagaagccctgtggggctgtcaagagcgtgttctgccaggtccatgggggctggcatcccagctccaactcgaggagcctcagtttcctcatctgtaaactggagagagcccagcacttggcaggtgtccagtacctaatcacgctctgttccttgcttttgccttcaagggaattccgagtgtccagcactgccgtattgccagcacagacggattttctctaatcagtgtccctggggcaggaggatgacccagtcacctttactagtcctttggagacaatttacctgtattaggagcccaggccacgctacactctgcccacactggtgagcaggaggtcttcccacgccctgtcattaggctgcatttactcttgctaaatccccctcccctgcctgctctgcagtcgtgggtggggcccgtgcgccgtttctccttggtagcgtgcacggtgttgaactgggacactggggagaaaggggctttcatgtcgtttccttcctgctcctgctgcacagctgccaggagtgctctgcctggagtctgcagacctcagagaggtcccagcactggctgtggcctttcaggtgtaggcaggtgggctctgcttcccgattccctgtgagcgcccaccctctcgaaagaattttctgcttgccctgtgactgtgcagactctggctcgagcaacccggggaacttcaccctcaggggcctcccacaccttctccagcgaggaggtctcagtcccagcctcgggagggcacctccttttctgtgctttcttccctgaggcattcttcctcatccctagggtgttgtgtagaactctttttaaactctatgctccgagtagagttcatctttatattaaacttcccctgttcaaataa

SEQ ID NO: 76769 - DNA, 2388 bp, Homo sapiens
tatctcggcctactgtgtgactccgacccctggctagagggtaggcggcgtggagcagcgcgcgcaagcgaggccaggggaaggtgggcgcaggtgaggggccgaggtgtgcgcaggactttagccggttgagaaggatcaagcaggcatttggagcacaggtgtctagaaacttttaaggggccggttcaagaaggaaaagttcccttctgctgtgaaactatttggcaagaggctggagggcccaatggctgcaaaatcgcaacccaacattcccaaagccaagagtctagatggcgtcaccaatgacagaaccgcatctcaagggcagtggggccgtgcctgggaggtggactggttttcactggcgagcgtcatcttcctactgctgttcgcccccttcatcgtctactacttcatcatggcttgtgaccagtacagctgcgccctgaccggccctgtggtggacatcgtcaccggacatgctcggctctcggacatctgggccaagactccacctataacgaggaaagccgcccagctctataccttgtgggtcaccttccaggtgcttctgtacacgtctctccctgacttctgccataagtttctacccggctacgtaggaggcatccaggagggggccgtgactcctgcaggggttgtgaacaagtatcagatcaacggcctgcaagcctggctcctcacgcacctgctctggtttgcaaacgctcatctcctgtcctggttctcgcccaccatcatcttcgacaactggatcccactgctgtggtgcgccaacatccttggctatgccgtctccaccttcgccatggtcaagggctacttcttccccaccagcgccagagactgcaaattcacaggcaatttcttttacaactacatgatgggcatcgagtttaaccctcggatcgggaagtggtttgacttcaagctgttcttcaatgggcgccccgggatcgtcgcctggaccctcatcaacctgtccttcgcagcgaagcagcgggagctccacagccatgtgaccaatgccatggtcctggtcaacgtcctgcaggccatctacgtgattgacttcttctggaacgaaacctggtacctgaagaccattgacatctgccatgaccacttcgggtggtacctgggctggggcgactgtgtctggctgccttatctttacacgctgcagggtctgtacttggtgtaccaccccgtgcagctgtccaccccgcacgccgtgggcgtcctgctgctgggcctggtgggctactacatcttccgggtggccaaccaccagaaggacctgttccgccgcacggatgggcgctgcctcatctggggcaggaagcccaaggtcatcgagtgctcctacacatccgccgacgggcagaggcaccacagcaagctgctggtgtcgggcttctggggcgtggcccgccacttcaactacgtcggcgacctgatgggcagcctggcctactgcctggcctgtggcggtggccacctgctgccctacttctacatcatctacatggccatcctgctgacccaccgctgcctccgggacgagcaccgctgcgccagcaaggaattccgagtgtccagcactgccgtattgccagcacagacggattttctctaatcagtgtccctggggcaggaggatgacccagtcacctttactagtcctttggagacaatttacctgtattaggagcccaggccacgctacactctgcccacactggtgagcaggaggtcttcccacgccctgtcattaggctgcatttactcttgctaaataaaagtgggagtggggcgtgcgcgttatccatgtattgcctttcagctctagatccccctcccctgcctgctctgcagtcgtgggtggggcccgtgcgccgtttctccttggtagcgtgcacggtgttgaactgggacactggggagaaaggggctttcatgtcgtttccttcctgctcctgctgcacagctgccaggagtgctctgcctggagtctgcagacctcagagaggtcccagcactggctgtggcctttcaggtgtaggcaggtgggctctgcttcccgattccctgtgagcgcccaccctctcgaaagaattttctgcttgccctgtgactgtgcagactctggctcgagcaacccggggaacttcaccctcaggggcctcccacaccttctccagcgaggaggtctcagtcccagcctcgggagggcacctccttttctgtgctttcttccctgaggcattcttcctcatccctagggtgttgtgtagaactctttttaaactctatgctccgagtagagttcatctttatattaaacttcccctgttcaaataa

SEQ ID NO: 76770 - DNA, 2543 bp, Homo sapiens
tatctcggcctactgtgtgactccgacccctggctagagggtaggcggcgtggagcagcgcgcgcaagcgaggccaggggaaggtgggcgcaggtgaggggccgaggtgtgcgcaggactttagccggttgagaaggatcaagcaggcatttggagcacaggtgtctagaaacttttaaggggccggttcaagaaggaaaagttcccttctgctgtgaaactatttggcaagaggctggagggcccaatggctgcaaaatcgcaacccaacattcccaaagccaagagtctagatggcgtcaccaatgacagaaccgcatctcaagggcagtggggccgtgcctgctgcgccctgaccggccctgtggtggacatcgtcaccggacatgctcggctctcggacatctgggccaagactccacctataacgaggaaagccgcccagctctataccttgtgggtcaccttccaggtgcttctgtacacgtctctccctgacttctgccataagtttctacccggctacgtaggaggcatccaggagggggccgtgactcctgcaggggttgtgaacaagtatcagatcaacggcctgcaagcctggctcctcacgcacctgctctggtttgcaaacgctcatctcctgtcctggttctcgcccaccatcatcttcgacaactggatcccactgctgtggtgcgccaacatccttggctatgccgtctccaccttcgccatggtcaagggctacttcttccccaccagcgccagagactgcaaattcacaggcaatttcttttacaactacatgatgggcatcgagtttaaccctcggatcgggaagtggtttgacttcaagctgttcttcaatgggcgccccgggatcgtcgcctggaccctcatcaacctgtccttcgcagcgaagcagcgggagctccacagccatgtgaccaatgccatggtcctggtcaacgtcctgcaggccatctacgtgattgacttcttctggaacgaaacctggtacctgaagaccattgacatctgccatgaccacttcgggtggtacctgggctggggcgactgtgtctggctgccttatctttacacgctgcagggtctgtacttggtgtaccaccccgtgcagctgtccaccccgcacgccgtgggcgtcctgctgctgggcctggtgggctactacatcttccgggtggccaaccaccagaaggacctgttccgccgcacggatgggcgctgcctcatctggggcaggaagcccaaggtcatcgagtgctcctacacatccgccgacgggcagaggcaccacagcaagctgctggtgtcgggcttctggggcgtggcccgccacttcaactacgtcggcgacctgatgggcagcctggcctactgcctggcctgtggcggtggccacctgctgccctacttctacatcatctacatggccatcctgctgacccaccgctgcctccgggacgagcaccgctgcgccagcaagtacggccgggactgggagcgctacaccgccgcagtgccttaccgcctgctgcctggaatcttctaagggcacgccctagggagaagccctgtggggctgtcaagagcgtgttctgccaggtccatgggggctggcatcccagctccaactcgaggagcctcagtttcctcatctgtaaactggagagagcccagcacttggcaggtgtccagtacctaatcacgctctgttccttgcttttgccttcaagggaattccgagtgtccagcactgccgtattgccagcacagacggattttctctaatcagtgtccctggggcaggaggatgacccagtcacctttactagtcctttggagacaatttacctgtattaggagcccaggccacgctacactctgcccacactggtgagcaggaggtcttcccacgccctgtcattaggctgcatttactcttgctaaataaaagtgggagtggggcgtgcgcgttatccatgtattgcctttcagctctagatccccctcccctgcctgctctgcagtcgtgggtggggcccgtgcgccgtttctccttggtagcgtgcacggtgttgaactgggacactggggagaaaggggctttcatgtcgtttccttcctgctcctgctgcacagctgccaggagtgctctgcctggagtctgcagacctcagagaggtcccagcactggctgtggcctttcaggtgtaggcaggtgggctctgcttcccgattccctgtgagcgcccaccctctcgaaagaattttctgcttgccctgtgactgtgcagactctggctcgagcaacccggggaacttcaccctcaggggcctcccacaccttctccagcgaggaggtctcagtcccagcctcgggagggcacctccttttctgtgctttcttccctgaggcattcttcctcatccctagggtgttgtgtagaactctttttaaactctatgctccgagtagagttcatctttatattaaacttcccctgttcaaataa

SEQ ID NO: 76771 - DNA, 2693 bp, Homo sapiens
atcatccgggggcgggcgcccctgccctgcgggtgacttcgacccctggctagagggtaggcggcgtgtggagcagcgcgcgcaagcgaggccaggggaaggtgggcgcaggtgaggggccgaggtgtgcgcaggactttagccggttgagaaggatcaagcaggcatttggagcacaggtgtctagaaacttttaaggggccggttcaagaaggaaaagttcccttctgctgtgaaactatttggcaagaggctggagggcccaatggctgcaaaatcgcaacccaacattcccaaagccaagagtctagatggcgtcaccaatgacagaaccgcatctcaagggcagtggggccgtgcctgggaggtggactggttttcactggcgagcgtcatcttcctactgctgttcgcccccttcatcgtctactacttcatcatggcttgtgaccagtacagctgcgccctgaccggccctgtggtggacatcgtcaccggacatgctcggctctcggacatctgggccaagactccacctataacgaggaaagccgcccagctctataccttgtgggtcaccttccaggtcagcagcccctgccctggggttgggacacagcaggtgcttctgtacacgtctctccctgacttctgccataagtttctacccggctacgtaggaggcatccaggagggggccgtgactcctgcaggggttgtgaacaagtatcagatcaacggcctgcaagcctggctcctcacgcacctgctctggtttgcaaacgctcatctcctgtcctggttctcgcccaccatcatcttcgacaactggatcccactgctgtggtgcgccaacatccttggctatgccgtctccaccttcgccatggtcaagggctacttcttccccaccagcgccagagactgcaaattcacaggcaatttcttttacaactacatgatgggcatcgagtttaaccctcggatcgggaagtggtttgacttcaagctgttcttcaatgggcgccccgggatcgtcgcctggaccctcatcaacctgtccttcgcagcgaagcagcgggagctccacagccatgtgaccaatgccatggtcctggtcaacgtcctgcaggccatctacgtgattgacttcttctggaacgaaacctggtacctgaagaccattgacatctgccatgaccacttcgggtggtacctgggctggggcgactgtgtctggctgccttatctttacacgctgcagggtctgtacttggtgtaccaccccgtgcagctgtccaccccgcacgccgtgggcgtcctgctgctgggcctggtgggctactacatcttccgggtggccaaccaccagaaggacctgttccgccgcacggatgggcgctgcctcatctggggcaggaagcccaaggtcatcgagtgctcctacacatccgccgacgggcagaggcaccacagcaagctgctggtgtcgggcttctggggcgtggcccgccacttcaactacgtcggcgacctgatgggcagcctggcctactgcctggcctgtggcggtggccacctgctgccctacttctacatcatctacatggccatcctgctgacccaccgctgcctccgggacgagcaccgctgcgccagcaagtacggccgggactgggagcgctacaccgccgcagtgccttaccgcctgctgcctggaatcttctaagggcacgccctagggagaagccctgtggggctgtcaagagcgtgttctgccaggtccatgggggctggcatcccagctccaactcgaggagcctcagtttcctcatctgtaaactggagagagcccagcacttggcaggtgtccagtacctaatcacgctctgttccttgcttttgccttcaagggaattccgagtgtccagcactgccgtattgccagcacagacggattttctctaatcagtgtccctggggcaggaggatgacccagtcacctttactagtcctttggagacaatttacctgtattaggagcccaggccacgctacactctgcccacactggtgagcaggaggtcttcccacgccctgtcattaggctgcatttactcttgctaaataaaagtgggagtggggcgtgcgcgttatccatgtattgcctttcagctctagatccccctcccctgcctgctctgcagtcgtgggtggggcccgtgcgccgtttctccttggtagcgtgcacggtgttgaactgggacactggggagaaaggggctttcatgtcgtttccttcctgctcctgctgcacagctgccaggagtgctctgcctggagtctgcagacctcagagaggtcccagcactggctgtggcctttcaggtgtaggcaggtgggctctgcttcccgattccctgtgagcgcccaccctctcgaaagaattttctgcttgccctgtgactgtgcagactctggctcgagcaacccggggaacttcaccctcaggggcctcccacaccttctccagcgaggaggtctcagtcccagcctcgggagggcacctccttttctgtgctttcttccctgaggcattcttcctcatccctagggtgttgtgtagaactctttttaaactctatgctccgagtagagttcatctttatattaaacttcccctgttcaaataa

SEQ ID NO: 76772 - DNA, 2310 bp, Homo sapiens
  misc_feature (2234)..(2234): n is a, c, g, or t
tatctcggcctactgtgtgactccgacccctggctagagggtaggcggcgtggagcagcgcgcgcaagcgaggccaggggaaggtgggcgcaggtgaggggccgaggtgtgcgcaggactttagccggttgagaaggatcaagcaggcatttggagcacaggtgtctagaaacttttaaggggccggttcaagaaggaaaagttcccttctgctgtgaaactatttggcaagaggctggagggcccaatggctgcaaaatcgcaacccaacattcccaaagccaagagtctagatggcgtcaccaatgacagaaccgcatctcaagggcagtggggccgtgcctgggaggtggactggttttcactggcgagcgtcatcttcctactgctgttcgcccccttcatcgtctactacttcatcatggcttgtgaccagtacagctgcgccctgaccggccctgtggtggacatcgtcaccggacatgctcggctctcggacatctgggccaagactccacctataacgaggaaagccgcccagctctataccttgtgggtcaccttccaggtgcttctgtacacgtctctccctgacttctgccataagtttctacccggctacgtaggaggcatccaggagggggccgtgactcctgcaggggttgtgaacaagtatcagatcaacggcctgcaagcctggctcctcacgcacctgctctggtttgcaaacgctcatctcctgtcctggttctcgcccaccatcatcttcgacaactggatcccactgctgtggtgcgccaacatccttggctatgccgtctccaccttcgccatggtcaagggctacttcttccccaccagcgccagagactgcaaattcacaggcaatttcttttacaactacatgatgggcatcgagtttaaccctcggatcgggaagtggtttgacttcaagctgttcttcaatgggcgccccgggatcgtcgcctggaccctcatcaacctgtccttcgcagcgaagcagcgggagctccacagccatgtgaccaatgccatggtcctggtcaacgtcctgcaggccatctacgtgattgacttcttctggaacgaaacctggtacctgaagaccattgacatctgccatgaccacttcgggtggtacctgggctggggcgactgtgtctggctgccttatctttacacgctgcagggtctgtacttggtgtaccaccccgtgcagctgtccaccccgcacgccgtgggcgtcctgctgctgggcctggtgggctactacatcttccgggtggccaaccaccagaaggacctgttccgccgcacggatgggcgctgcctcatctggggcaggaagcccaaggtcatcgagtgctcctacacatccgccgacgggcagaggcaccacagcaagctgctggtgtcgggcttctggggcgtggcccgccacttcaactacgtcggcgacctgatgggcagcctggcctactgcctggcctgtggcggtggccacctgctgccctacttctacatcatctacatggccatcctgctgacccaccgctgcctccgggacgagcaccgctgcgccagcaagtacggccgggactgggagcgctacaccgccgcagtgccttaccgcctgctgcctggaatcttctaagggcacgccctagggagaagccctgtggggctgtcaagagcgtgttctgccaggtccatgggggctggcatcccagctccaactcgaggagcctcagtttcctcatctgtaaactggagagagcccagcacttggcaggtgtccagtacctaatcacgctctgttccttgcttttgccttcaagggaattccgagtgtccagcactgccgtattgccagcacagacggattttctctaatcagtgtccctggggcaggaggatgacccagtcacctttactagtcctttggagacaatttacctgtattaggagcccaggccacgctacactctgcccacactggtgagcaggaggtcttcccacgccctgtcattaggctgcatttactcttgctaaataaaagtgggagtggggcgtgcgcgttatccatgtattgcctttcagctctagaatgccccttccttgccttgtttgaaaacgggggggggggcccgccctcctttcttcctggtaggaggaacggcgtttatttggaaaccgcggggaaaagggggttntagtcgtttctttcttttcctttttacaaaaggaagggaagtcttccctggggtggcgacccccaaaagggccgca

SEQ ID NO: 76773 - DNA, 2534 bp, Homo sapiens
tatctcggcctactgtgtgactccgacccctggctagagggtaggcggcgtggagcagcgcgcgcaagcgaggccaggggaaggtgggcgcaggtgaggggccgaggtgtgcgcaggactttagccggttgagaaggatcaagcaggcatttggagcacaggtgtctagaaacttttaaggggccggttcaagaaggaaaagttcccttctgctgtgaaactatttggcaagaggctggagggcccaatggctgcaaaatcgcaacccaacattcccaaagccaagagtctagatggcgtcaccaatgacagaaccgcatctcaagggcagtggggccgtgcctgggaggtggactggttttcactggcgagcgtcatcttcctactgctgttcgcccccttcatcgtctactacttcatcatggcttgtgaccagtacagctgcgccctgaccggccctgtggtggacatcgtcaccggacatgctcggctctcggacatctgggccaagactccacctataacgaggaaagccgcccagctctataccttgtgggtcaccttccaggtgcttctgtacacgtctctccctgacttctgccataagtttctacccggctacgtaggaggcatccaggagggggccgtgactcctgcaggggttgtgaacaagtatcagatcaacggcctgcaagcctggctcctcacgcacctgctctggtttgcaaacgctcatctctacttcttccccaccagcgccagagactgcaaattcacaggcaatttcttttacaactacatgatgggcatcgagtttaaccctcggatcgggaagtggtttgacttcaagctgttcttcaatgggcgccccgggatcgtcgcctggaccctcatcaacctgtccttcgcagcgaagcagcgggagctccacagccatgtgaccaatgccatggtcctggtcaacgtcctgcaggccatctacgtgattgacttcttctggaacgaaacctggtacctgaagaccattgacatctgccatgaccacttcgggtggtacctgggctggggcgactgtgtctggctgccttatctttacacgctgcagggtctgtacttggtgtaccaccccgtgcagctgtccaccccgcacgccgtgggcgtcctgctgctgggcctggtgggctactacatcttccgggtggccaaccaccagaaggacctgttccgccgcacggatgggcgctgcctcatctggggcaggaagcccaaggtcatcgagtgctcctacacatccgccgacgggcagaggcaccacagcaagctgctggtgtcgggcttctggggcgtggcccgccacttcaactacgtcggcgacctgatgggcagcctggcctactgcctggcctgtggcggtggccacctgctgccctacttctacatcatctacatggccatcctgctgacccaccgctgcctccgggacgagcaccgctgcgccagcaagtacggccgggactgggagcgctacaccgccgcagtgccttaccgcctgctgcctggaatcttctaagggcacgccctagggagaagccctgtggggctgtcaagagcgtgttctgccaggtccatgggggctggcatcccagctccaactcgaggagcctcagtttcctcatctgtaaactggagagagcccagcacttggcaggtgtccagtacctaatcacgctctgttccttgcttttgccttcaagggaattccgagtgtccagcactgccgtattgccagcacagacggattttctctaatcagtgtccctggggcaggaggatgacccagtcacctttactagtcctttggagacaatttacctgtattaggagcccaggccacgctacactctgcccacactggtgagcaggaggtcttcccacgccctgtcattaggctgcatttactcttgctaaataaaagtgggagtggggcgtgcgcgttatccatgtattgcctttcagctctagatccccctcccctgcctgctctgcagtcgtgggtggggcccgtgcgccgtttctccttggtagcgtgcacggtgttgaactgggacactggggagaaaggggctttcatgtcgtttccttcctgctcctgctgcacagctgccaggagtgctctgcctggagtctgcagacctcagagaggtcccagcactggctgtggcctttcaggtgtaggcaggtgggctctgcttcccgattccctgtgagcgcccaccctctcgaaagaattttctgcttgccctgtgactgtgcagactctggctcgagcaacccggggaacttcaccctcaggggcctcccacaccttctccagcgaggaggtctcagtcccagcctcgggagggcacctccttttctgtgctttcttccctgaggcattcttcctcatccctagggtgttgtgtagaactctttttaaactctatgctccgagtagagttcatctttatattaaacttcccctgttcaaataa

SEQ ID NO: 76774 - DNA, 1935 bp, Homo sapiens
ctaggtagaaggccgggtgttgacatcggccgaggctgtcctggttctcgcccaccatcatcttcgacaactggatcccactgctgtggtgcgccaacatccttggctatgccgtctccaccttcgccatggtcaagggctacttcttccccaccagcgccagagactgcaaattcacaggcaatttcttttacaactacatgatgggcatcgagtttaaccctcggatcgggaagtggtttgacttcaagctgttcttcaatgggcgccccgggatcgtcgcctggaccctcatcaacctgtccttcgcagcgaagcagcgggagctccacagccatgtgaccaatgccatggtcctggtcaacgtcctgcaggccatctacgtgattgacttcttctggaacgaaacctggtacctgaagaccattgacatctgccatgaccacttcgggtggtacctgggctggggcgactgtgtctggctgccttatctttacacgctgcagggtctgtacttggtgtaccaccccgtgcagctgtccaccccgcacgccgtgggcgtcctgctgctgggcctggtgggctactacatcttccgggtggccaaccaccagaaggacctgttccgccgcacggatgggcgctgcctcatctggggcaggaagcccaaggtcatcgagtgctcctacacatccgccgacgggcagaggcaccacagcaagctgctggtgtcgggcttctggggcgtggcccgccacttcaactacgtcggcgacctgatgggcagcctggcctactgcctggcctgtggcggtggccacctgctgccctacttctacatcatctacatggccatcctgctgacccaccgctgcctccgggacgagcaccgctgcgccagcaagtacggccgggactgggagcgctacaccgccgcagtgccttaccgcctgctgcctggaatcttctaagggcacgccctagggagaagccctgtggggctgtcaagagcgtgttctgccaggtccatgggggctggcatcccagctccaactcgaggagcctcagtttcctcatctgtaaactggagagagcccagcacttggcaggtgtccagtacctaatcacgctctgttccttgcttttgccttcaagggaattccgagtgtccagcactgccgtattgccagcacagacggattttctctaatcagtgtccctggggcaggaggatgacccagtcacctttactagtcctttggagacaatttacctgtattaggagcccaggccacgctacactctgcccacactggtgagcaggaggtcttcccacgccctgtcattaggctgcatttactcttgctaaataaaagtgggagtggggcgtgcgcgttatccatgtattgcctttcagctctagatccccctcccctgcctgctctgcagtcgtgggtggggcccgtgcgccgtttctccttggtagcgtgcacggtgttgaactgggacactggggagaaaggggctttcatgtcgtttccttcctgctcctgctgcacagctgccaggagtgctctgcctggagtctgcagacctcagagaggtcccagcactggctgtggcctttcaggtgtaggcaggtgggctctgcttcccgattccctgtgagcgcccaccctctcgaaagaattttctgcttgccctgtgactgtgcagactctggctcgagcaacccggggaacttcaccctcaggggcctcccacaccttctccagcgaggaggtctcagtcccagcctcgggagggcacctccttttctgtgctttcttccctgaggcattcttcctcatccctagggtgttgtgtagaactctttttaaactctatgctccgagtagagttcatctttatattaaacttcccctgttcaaataa

SEQ ID NO: 76775 - DNA, 1816 bp, Homo sapiens
aggatccttaattaaattaatctcctcccccccccccccgccagagactgcaaattcacaggcaatttcttttacaactacatgatgggcatcgagtttaaccctcggatcgggaagtggtttgacttcaagctgttcttcaatgggcgccccgggatcgtcgcctggaccctcatcaacctgtccttcgcagcgaagcagcgggagctccacagccatgtgaccaatgccatggtcctggtcaacgtcctgcaggccatctacgtgattgacttcttctggaacgaaacctggtacctgaagaccattgacatctgccatgaccacttcgggtggtacctgggctggggcgactgtgtctggctgccttatctttacacgctgcagggtctgtacttggtgtaccaccccgtgcagctgtccaccccgcacgccgtgggcgtcctgctgctgggcctggtgggctactacatcttccgggtggccaaccaccagaaggacctgttccgccgcacggatgggcgctgcctcatctggggcaggaagcccaaggtcatcgagtgctcctacacatccgccgacgggcagaggcaccacagcaagctgctggtgtcgggcttctggggcgtggcccgccacttcaactacgtcggcgacctgatgggcagcctggcctactgcctggcctgtggcggtggccacctgctgccctacttctacatcatctacatggccatcctgctgacccaccgctgcctccgggacgagcaccgctgcgccagcaagtacggccgggactgggagcgctacaccgccgcagtgccttaccgcctgctgcctggaatcttctaagggcacgccctagggagaagccctgtggggctgtcaagagcgtgttctgccaggtccatgggggctggcatcccagctccaactcgaggagcctcagtttcctcatctgtaaactggagagagcccagcacttggcaggtgtccagtacctaatcacgctctgttccttgcttttgccttcaagggaattccgagtgtccagcactgccgtattgccagcacagacggattttctctaatcagtgtccctggggcaggaggatgacccagtcacctttactagtcctttggagacaatttacctgtattaggagcccaggccacgctacactctgcccacactggtgagcaggaggtcttcccacgccctgtcattaggctgcatttactcttgctaaataaaagtgggagtggggcgtgcgcgttatccatgtattgcctttcagctctagatccccctcccctgcctgctctgcagtcgtgggtggggcccgtgcgccgtttctccttggtagcgtgcacggtgttgaactgggacactggggagaaaggggctttcatgtcgtttccttcctgctcctgctgcacagctgccaggagtgctctgcctggagtctgcagacctcagagaggtcccagcactggctgtggcctttcaggtgtaggcaggtgggctctgcttcccgattccctgtgagcgcccaccctctcgaaagaattttctgcttgccctgtgactgtgcagactctggctcgagcaacccggggaacttcaccctcaggggcctcccacaccttctccagcgaggaggtctcagtcccagcctcgggagggcacctccttttctgtgctttcttccctgaggcattcttcctcatccctagggtgttgtgtagaactctttttaaactctatgctccgagtagagttcatctttatattaaacttcccctgttcaaataa

SEQ ID NO: 76776 - DNA, 2368 bp, Homo sapiens
tatctcggcctactgtgtgactccgacccctggctagagggtaggcggcgtggagcagcgcgcgcaagcgaggccaggggaaggtgggcgcaggtgaggggccgaggtgtgcgcaggactttagccggttgagaaggatcaagcaggcatttggagcacaggtgtctagaaacttttaaggggccggttcaagaaggaaaagttcccttctgctgtgaaactatttggcaagaggctggagggcccaatggctgcaaaatcgcaacccaacattcccaaagccaagagtctagatggcgtcaccaatgacagaaccgcatctcaagggcagtggggccgtgcctgggaggtggactggttttcactggcgagcgtcatcttcctactgctgttcgcccccttcatcgtctactacttcatcatggcttgtgaccagtacagctgcgccctgaccggccctgtggtggacatcgtcaccggacatgctcggctctcggacatctgggccaagactccacctataacgaggaaagccgcccagctctataccttgtgggtcaccttccaggtgcttctgtacacgtctctccctgacttctgccataagtttctacccggctacgtaggaggcatccaggagggggccgtgactcctgcaggggttgtgaacaagtatcagatcaacggcctgcaagcctggctcctcacgcacctgctctggtttgcaaacgctcatctcctgtcctggttctcgcccaccatcatcttcgacaactggatcccactgctgtggtgcgccaacatccttggctatgccgtctccaccttcgccatggtcaagggctacttcttccccaccagcgccagagactgcaaattcacaggcaatttcttttacaactacatgatgggcatcgagtttaaccctcggatcgggaagtggtttgacttcaagctgttcttcaatgggcgccccgggatcgtcgcctggaccctcatcaacctgtccttcgcagcgaagcagcgggagctccacagccatgtgaccaatgccatggtcctggtcaacgtcctgcaggccatctacgtgattgacttcttctggaacgaaacctggtacctgaagaccattgacatctgccatgaccacttcgggtggtacctgggctggggcgactgtgtctggctgccttatctttacacgctgcagggtctgtacttggtgtaccaccccgtgcagctgtccaccccgcacgccgtgggcgtcctgctgctgggcctggtgggctactacatcttccgggtggccaaccaccagaaggacctgttccgccgcacggatgggcgctgcctcatctggggcaggaagcccaaggtcatcgagtgctcctacacatccgccgacgggcagaggcaccacagcaagctgctggtgtcgggcttctggggcgtggcccgccacttcaactacgtcggcgacctgatgggcagcctggcctactgcctggcctgtggcggtggccacctgctgccctacttctacatcatctacatggccatcctgctgacccaccgctgcctccgggacgagcaccgctgcgccagcaagtacggccgggactgggagcgctacaccgccgcagtgccttaccgcctgctgcctggaatcttctaagggcacgccctagggagaagccctgtggggctgtcaagagcgtgttctgccaggtccatgggggctggcatcccagctccaactcgaggagcctcagtttcctcatctgtaaactggagagagcccagcacttggcaggtgtccagtacctaatcacgctctgttccttgcttttgccttcaagggaattccgagtgtccagcactgccgtattgccagcacagacggattttctctaatcagtgtccctggggcaggaggatgacccagtcacctttactagtcctttggagacaatttacctgctcctgctgcacagctgccaggagtgctctgcctggagtctgcagacctcagagaggtcccagcactggctgtggcctttcaggtgtaggcaggtgggctctgcttcccgattccctgtgagcgcccaccctctcgaaagaattttctgcttgccctgtgactgtgcagactctggctcgagcaacccggggaacttcaccctcaggggcctcccacaccttctccagcgaggaggtctcagtcccagcctcgggagggcacctccttttctgtgctttcttccctgaggcattcttcctcatccctagggtgttgtgtagaactctttttaaactctatgctccgagtagagttcatctttatattaaacttcccctgttcaaataa

SEQ ID NO: 76777 - DNA, 1208 bp, Homo sapiens
tatctcggcctactgtgtgactccgacccctggctagagggtaggcggcgtggagcagcgcgcgcaagcgaggccaggggaaggtgggcgcaggtgaggggccgaggtgtgcgcaggactttagccggttgagaaggatcaagcaggcatttggagcacaggtgtctagaaacttttaaggggccggttcaagaaggaaaagttcccttctgctgtgaaactatttggcaagaggctggagggcccaatggctgcaaaatcgcaacccaacattcccaaagccaagagtctagatggcgtcaccaatgacagaaccgcatctcaagggcagtggggccgtgcctgggaggtggactggttttcactggcgagcgtcatcttcctactgctgttcgcccccttcatcgtctactacttcatcatggcttgtgaccagtacagctgcgccctgaccggccctgtggtggacatcgtcaccggacatgctcggctctcggacatctgggccaagactccacctataacgaggaaagccgcccagctctataccttgtgggtcaccttccaggtgcttctgtacacgtctctccctgacttctgccataagtttctacccggctacgtaggaggcatccaggagggggccgtgactcctgcaggggttgtgaacaagtatcagatcaacggcctgcaagcctggctcctcacgcacctgctctggtttgcaaacgctcatctcctgtcctggttctcgcccaccatcatcttcgacaactggatcccactgctgtggtgcgccaacatccttggctatgccgtctccaccttcgccatggtcaagggctacttcttccccaccagcgccagagactgcaaattcacaggcaatttcttttacaactacatgatgggcatcgagtttaaccctcggatcgggaagtggtttgacttcaagctgttcttcaatgggcgccccgggatcgtcgcctggaccctcatcaacctgtccttcgcagcgaagcagcgggagctccacagccatgtgaccaatgccatggtcctggtcaacgtcctgcaggtgcctgtcatggctggagagggtgaaacgccgatgccggcaggctctgggggaacccgcaagccagagcgtattcccatgaccttaatctactgcttgtaaaagagagtcagctgccctccccaggtgt

SEQ ID NO: 76778 - DNA, 415 bp, Homo sapiens
tatctcggcctactgtgtgactccgacccctggctagagggtaggcggcgtggagcagcgcgcgcaagcgaggccaggggaaggtgggcgcaggtgaggggccgaggtgtgcgcaggactttagccggttgagaaggatcaagcaggcatttggagcacaggtgtctagaaacttttaaggggccggttcaagaaggaaaagttcccttctgctgtgaaactatttggcaagaggctggagggcccaatggctgcaaaatcgcaacccaacattcccaaagccaagagtctagatggcgtcaccgtatgcagatgattatgtcttcggcactggtaccgtttctgctaggtggatgagagtggcctcgcgcggttggatcgacgacgtgcgtcaggcgttatctcagtcgctatc

SEQ ID NO: 76779 - DNA, 388 bp, Homo sapiens
cctgccccacctgttgttcgcctccctctttgtcagtgctgagccaggcacagcagctttgcgatgggactggcttgtccgccgtcctccctgacatgcggctgttgaagccctgagcactggaccttctgcctcttgcttgactcctactgtgggccttgagcgtctgccctctcctgaaatgtcagctgcctgcggtcttattcatttttgtgttccttgcaggactttagccggttgagaaggatcaagcaggcatttggagcacaggtgtctagaaacttttaaggggccggttcaagaaggaaaagttcccttctgctgtgaaactatttggcaagaggctggaggtaagtgtatctcagtgccctggatcgtgggcgcaggc

SEQ ID NO: 76780 - DNA, 805 bp, Homo sapiens
tcaccctcaggggcctcccacaccttctccagcgaggaggtctcagtcccagcctcgggagggcacctccttttctgtgctttcttccctgaggcattcttcctcatccctagggtgttgtgtagaactctttttaaactctatgctccgagtagagttcatctttatattaaacttcccctgttcaaataaagtggctgtgtggtttctgactggtgaatgggcctgactcgtgaatgggcctgactgcaggtctgactggtatacgtgggctctgtttctggtatgagaagggatgtctgagagagatgcttgggtctcggcgtcaaagcattgggtgcccgtgggtgcgtggcgccaccctgcccctctccctcccatgtcagccctttgctggggctgtttttgggttgaatgtggagagtattccattcccccccaaggagatgaaaccaggcttggccacctgcccccggcaagtgaatggagaagccagaaagagtgccaggtttgtcttgcacctggagaaacaagagtttcacacaggcagcccagtgcccatgccagggcagggggccaagctcagagtggcttcattgcttcacatgagaactggtcccacagccaggccgcctcccagacagcctggagggtatcggaactgtgacccgcccaggctgactgctgagccctagtgttcgtgcactggtgccccaccactacctgtttgaggatatgggcctgaggggtcccgtgcatctgtgctggacacacaccacaagagtgattcaaatgccggggagac

SEQ ID NO: 76781 - DNA, 1273 bp, Homo sapiens
acacaagctccctgctctcaggagaatctggcacagcaccatcaccaactcagagggagggaagcaaccttgagtcagctcccaggcagtaatgagtgttcaagggagatataactctaaggaaaaggattgaggtcaaggaattagaagaaacagatggaagaatcatttgaaccatatccaggtcttttgaaaatgatgagacagaagagaaagcgaaaattgcttcagacagttttgctgagaaatttgtctcagataaattttggagtaaggtcagagacctaagataagaaaacccctaggcagaggtgggaaaaaatagaaaaaagaaaacgaaaagagcaaatacattcttccttcctatcttccacttgccagagtagctttactaagatgctgcctgatcatttctctccagacacttttgccaatgatattaatactataaaggagcatttctggacttgattcattaatgattagaaagctcgtaacagattagatgaccaggctacagtctcacctgccaggcagtgcagctgcagatcttggctgaccatcatgtcagcacctactatgtgccagtcactgtgccaggagttggaaatatgaggaagaccgtaattctcataatgagaatacaaggaagaccatctctcaagaaaggaacatcataaaacatgtttactgtcaagtccttgtcattatcaaaaatatctccagattgatgtcattctgagaaaagtgatttcatactgaaaaaaattctacaaaaatagtaaaactcttcttctcaattttcagaacttggatggggttgggggcaggtgctttcatctattttcatcttgtcctggtagaaattatttgcttgattaacattttggtggagaagttcagtctctaaggctacagatgagaagatcagttactggatgggatcctaacttcaatgtcaaatccaagagcctgaaaataaaggatggaaagaaagggaaacaaagaaaagttatcagacaatgtgaagacattttatggagaggaagaaagagtgagtgagcacaggaaaaatcacaaagcagtatatgaagaaaagaaagagataacagttattagtaagtaaagagataattaagagataatcctttcagtggcatgaacaccatagtttgtgacatcactggtcattaatgatttgtgagaagcagtgtctcaactatgtttctgttacattaattatacccaaaataaaatatttgcacacctattg

SEQ ID NO: 76782 - DNA, 440 bp, Homo sapiens
tgctgagaaatttgtctcagataaattttggagtaaggtcagagacctaagataagaaaacccctaggcagaggtgggaaaaaatagaaaaaagaaaacgaaaagagcaaatacattcttccttcctatcttccacttgccagagtagctttactaagatgctgcctgatcatttctctccagacacttttgccaatgatattaatactataaaggagcatttctggacttgattcattaatgattagaaagctcgtaacagattagatgaccaggctacagtctcacctgccaggcagtgcagctgcagatcttggctgaccatcatgtcaggtgagaaagagactaatacaaaataattgcttttataaattgcaagttaatcttctgctgattgatattcctgagtagaattactaacatagatttggggaagaaaa

SEQ ID NO: 76783 - DNA, 793 bp, Homo sapiens
aaattagtgtcaaaatacaaatatgattatttcaaagacttgtaaaaactactcactccaattttttttggtaatgcattcatatcttaaagtggtattagtcagtggcttgccaaacaaatattttaataagttattataatccactgggcttttctggatagatcttccagtcctgaagatttttcagttttgtagaattcctactgcagtttttatttcttggaaatggactttcaaaggctttaatcatattttctcttttcctctcccgttaaatatctaaaagcagctggaatgcaaaacatttgtatctgtcagatagacatgagtgcattttacctgacaaccacggattatcttagagttttaaacactgttacagagaaaagaaaatttatttgcataggtcacataatatttagatcctctccgtagcacctccatagatagtagatcctgcagtactttaagcattagagttacacatcaaaattaagctagtttcaaatctcaaaggaattcataagctgagatttaagtcttgggtacccctccccttactttccacataggtacttagttctcacacctgcacttaccagcatccagaatatatttcttaaggcctactcttgttaggtactctgtgaaaaagggttttaggccaggcacggtggctcacacctgtaatcccagcacttgggaagcccaggcgggcggatcacttgaggtcaggaatttgagactagcctcactaacatggtgaaacccccatctacactaaaaatac

SEQ ID NO: 76784 - DNA, 786 bp, Homo sapiens
aggcggatgcggatgcggatgcggatgcgaaggtggcggccgaggtggcggccgaggtggcggctgcggcggccgccgcggatgcagatgcggatgagaccctcggtgactgtgaggggaacccagattttcagatggcctccctgtacgtgggcgacctgcaccctgaggtgaccgaggcaatgctgtacgagaagttcagtccagctgggcccatcctctccatccgcatctgcagggacaagatcacccgccgctcattgggctacgcgtatgtcaactaccagcaaccggtggacgccaagcgggccctggagaccctgaactttgatgtcataaagggcaggccagtgcgcatcatgtggtcccagagggacccgtcgctccgcaagagcggggtgggcaacgtcttcatcaagaacctgggcaagaccatcgacaacaaggcgctgtacaacatcttctcggcgttcggcaacatcctctcctgcaaagtggcctgtgacgaaaaggggcccaagggctacgggttcgtgcacttccaaaagcaggaatctgcggagcgggccatcgatgtgatgaatggcatgttcctgaactaccgcaaaattttcgtcgggagattcaagtcgcataaagaacgagaggccgaaaggggagcctgggccaggcagtccactagtgctgacgtcaaggatttcgaggaagacaccgacgaggaggccaccttgcgatgaagacatcccaggagctagccagccagcagagccaaaccttggctcacac

SEQ ID NO: 76785 - DNA, 775 bp, Homo sapiens
cagcttcccaagttgctgggattacaggcacataccacaatggctggctaattttttattttttaatttgttgtagagacaacaaataaacatggtcttgccatgttgcccaggctggtctcgaactcctgagctcaaacaatccgcctgcctcggcctcccaaagtgctgggattatagatgtcagccaccgcactggctcaagattgcatgctccttgtaagaatctaaatgcctgaggtggaacagtttcaacacacccctgcttccatgtctgtggaaaaattgtcttccatgaaaccaattcctagtaccaaaaaggttgggaaccactgatgtttaggcacctgccgtgaggcagctaccacaatgggagatggtgaaggtgtagaaatgaatgatacttgttccctgcttgcaggaacctgccagtttactagggctggcagaagtgtcagtaataattaacagcaaagtgtgatgagtcttgtgatggagagatagaatagagctttgggaacccagaggaggaccccacctagacttcgggggtgatggccagagcaggcttcccagaggaagaaagctgaaagtaccataggccactagagagaagataaataccagccagagaacagcatgtgtaaaatcctataagctagtgaagattaatacaaagaagtgtggcatggctggagtgtagtaggccatagatgtggggtccagtaaaaatatatggtgatcctagaattcttccttagtcagaaaattaaaa

SEQ ID NO: 76786 - DNA, 616 bp, Homo sapiens
agcggtaaatctaagaaatctaaaaaatatgctgagtgaaagaaaccacgtgttaaagagtgtatactgtgactctatgtagatgaaattctaggacaggtgaaaataatcaataatcatggaaaaacagtcattgtctgtgtatagaggtgggtggggaaaatgtagagtgaagggccataagggaactttttgcagtgaaaaaaaaatgttccacatgttgactgtggtggtggtcacacagatgtacatatttgtcaaaatttactaaccagtacacttaaaatgggtatattatatagaaattatagcttaatggccaggtgcggtggctcacgcctgtaatcccagcactttgggaggccaaggcgggcagatcacaaggtcaggagattgagagcatcctggctaacacagtgaaacctcgtttctactaaaaatacaaaaaattagctgggcgtggtggcatgctactgtaatcccagctactcaggaggctgaggcaggagaatcgcttgaacccaggagtgggaggttgcagtgagccaagatcatgccactactctccagcctgggcgacagagtgagattccatctcaaaaaaaaaaaaaaaaaa

SEQ ID NO: 76787 - DNA, 391 bp, Homo sapiens
ccaggaggcctggatccttccccagcaaccgtgtggaggtttttacttcctctgatccaggggacacatgtaatctttttctacaactccctgaggctggtttttcccaccctacaaatcagtaagcataaatttttgcagagaagcctggagccatgggtcctaagcattcaggcagccaaaaaaattaaattttcaaccggagccgggtaaggacacatggtctcaaacgtttcctgcccaattggagccgctttcctcctcttgcacacttgctccccctactgcctgacgctggaagtgcaggcctggctccgaggcaagcttgaacgccccagctcggtcctgggatggccagggtgaaagccagcagagcagagaggttgccaaa

SEQ ID NO: 76788 - DNA, 163 bp, Homo sapiens
ttttacaaccaacaactttccttctggcattgatttacctagcagataactttacagatttctcctcctccatctgctacagcacgttctttggccacctcttccttacatttcatacaacttgcattcagcaatgttttttttttttttttttgagacaggg

SEQ ID NO: 76789 - DNA, 1054 bp, Homo sapiens
aggcgggaggattgcttgagtccaggagtttaaggttgcagtgagctatgattgcaccattgcacttcaggctgggccacagagcaagaccctgtctcagaaaacagaaagaaagaaagtcaaagaaataaagtcaaagacaagaaggtgatacagagaagacagaaaaggaggaggagagagactgacaggtacacaaatcagagaagtcccagagataacaaaaacacaaccacagagatagggagacgtaagccggagaaagacccagagattcgcatagaaagcaacgtggagactcagaagcaagcacagcatcaaggaatgatcaataaaaagaaaaaaaaatatttcctgaggacttccaagtacaaggccctgcaatctcaggccacttctgtcccatctctgccttcagagggggggacaggtagtccagacaattagaatacagagggggctgtgttctgacggggccacgcaggcattgaggaaacgcagcaggcccctcccctagctggggcggggatgtctgtgtgccatcatctcattccatctggtcattcctttgcccattcatccatccattcattcaagtcaccccatgcacattttccaagactgcctgtgacctggccctgtgccgggcagagctgaggatgccaaggtgaattcctcctgtgcctggccccggccccagtctgctggaagaaccagacacagacaatcacactgcggggaaacacgtgctccatcggaaaagtccagagcagggggtgggcagagaggcccagcgtgcaccagagcctcgctcaggtcagcgccaggcctgcctggagcagccaactgtgggagaagaaggagttggtgaaaggtgggtcccacctgggccgtccacagaagggctgaggggtagggggtgaggggttgaagatcaggccctgccgccatgccacacggctgtcctctgtccctgctcctgggggagctgaaactgcatggaaggtcccccaggggtgccccgtctaataaactcgatgaagaggaaaaaagc

SEQ ID NO: 76790 - DNA, 278 bp, Homo sapiens
ctttaaatgtttggtagaatttaccagtgatgccatctcggcctgggattttctttgcaggtaggtttttttttttattactaatttaatctattcgctgtgttacaaatctattcagatttactgtttcttcttgggccagttttattcatctaacagtattttctaatttcccttttgatacattttctattaaagatactttcattttcaatcaaaataaaattaacaatcatattgtgttgtttaaaacattatactggaatatatcaattgtc

SEQ ID NO: 76791 - DNA, 426 bp, Homo sapiens
tccactgcatggctagaccacagtttattcacgcattcatcggctgatgaacatttgggttatgtctactttttgactgttaggaataatgctgttatgaatgctcatgtgcgagttttgtgtagacacatgttttccttcccctaaggtacctaggaatggagtttctgggtcatatggtcactctctgtttaacactctgaaaaacggacaaaccgtttccctaagtggttgccccgttttcctttccgccagtgtgtgcaggctccagggccgccccatcctcactggccccagctcctttgtgaagaaggctcctgcagctgctgcatgccacctccactagcatcctatggtccagaaggtggtcttgtggccacccatagctgcaaaggaggctggaaaatagtctttattccaggcagc

SEQ ID NO: 76792 - DNA, 531 bp, Homo sapiens
ctgccggagtgggagcggtcactgctgggggctgcgcagcacgcttgcgtcttttgcatgccgcgttgccactactctgcctgttctggaaggcctgggaccctcccttggagggggcacaggtgggctttgagtaatgagacctggtacttgcatcatccattcatcaagtcagcacccggggatgccaggttctgttaggggcgaggggacgtacagcagtagaggagacagctgagatccctgctcagggggattgaggggggctggcatcccagccggggagacagatgaaaaccaagtaaatcagcagaaaagataatttcactcatgataggagctgtgaggggttagagccaaatagaaatacagcgtgagccacgtgtgaggttttcagtttaaattttctaatagccacttaacagtcaaaggaaacaggtggaattaattttaatcttatttaacccaaatatatgcaaagtattatcacttcaacatgtaatcagtataaacggcatcaatatttttgca

SEQ ID NO: 76793 - DNA, 330 bp, Homo sapiens
  misc_feature (71)..(71): n is a, c, g, or t
  misc_feature (129)..(129): n is a, c, g, or t
  misc_feature (149)..(149): n is a, c, g, or t
  misc_feature (156)..(156): n is a, c, g, or t
gggccagccagtggcctccatgggcacctaggactcgccaggccaatgcatgacctcacagcagctcaagncgggtacggccgtgcccttgtccacggagctcaggtggaaggagctggggcacagtgnctgggctgggacagtgcatnccacctnccgtggtgggacaggtacagcgtgccaggaagccttggtcaccgccacagcctgctcctcatggtgagtgcccgcgccaggagcgtcaggagtgagggtatgtgggggctggttaggaagagggccactgctcattacgaaaactttcccttctctgcaggaattgtaaccgtg

SEQ ID NO: 76794 - DNA, 197 bp, Homo sapiens
agacataatttgggtggggacacagccaagccatatcgctgctgcttcagaggacccacattacagcagacagaaagctcgcatgatcaagaaaagctgaaatatacaaactactcattaggattatagagctatagtaatgaagctccatagtgtggcattggcactaaagacttctcgatttaagcaagagtgta

SEQ ID NO: 76795 - DNA, 358 bp, Homo sapiens
caaagtgctgggattacaggtgtgagccagtgagcctgttactgatattttatatgccttatctcatttaaccctttcagagttgggtttccctatcttgatcttacagacaagaatccacctcaaaaaatcagataagtagcctgctcaaggccatgtaacagctgagattcaaatccaggacagtgagatttcaaactccaagttctttccataccaagctgccccctcccacaagaactgagcgccaaacatcttagctgcataaacatgcaaataaaaagacctgcaaatcatctgacatgagatttaaactaatatagcatatatattcaaatatatggccagtactcatctt

SEQ ID NO: 76796 - DNA, 691 bp, Homo sapiens
aagatcagtatgcaaaaatcagttgattggttgtattgtcatataataacaataatcaattgaaaataaagattcaaatgccatcaaaagtgtgaactttgtaggggaaatagttttaaaagtacaggagaaaaactggctgagagaaattaagatctaagtaaaagaagaaatacaccattttcatggatcagaagacaattttgttaggatgacaattctccccacattgatctatagactcaacataatcctagtcaaaattcaagtgagcatttttatagaaatttgaaagcttattctaaatttttgttgggaaaccgtcctccatgtgtcctcttgtactgcttgctacacatcttacttagaaggctaagaaaccaagccctgatcatttcttatcacgtttgtttcttacagttgtgtttgcagagagcaactttgaggtatgagataatgtttcactctgggacaaagaacaggctttcttacagcttgatataaaacagatgaattccccaagtccagtgtacctcttctgcaatgcaaccaattgcatgtacaggcatccatctgggcccatgtcacatcaccctatgggtcttggggatggggagcaagggaaactgatgtggatgataatgctcataatgcttaccatgccatgggtaatagagttctttgccataga

SEQ ID NO: 76797 - DNA, 231 bp, Homo sapiens
ttttggtgttttctttttctttttttttattattattttttaacccgaataaaggggatctctgtagagcggtgcagggcttgcagtgcggacttggagaaagtttacttcaactcccttcttggacaaccctctgccctagcaatattaaaaccatgttgggccaaggagatatgagaccgttcaaaataatcaaaattaaatttgtcgtaagcccagccttgagtgctt

SEQ ID NO: 76798 - DNA, 760 bp, Homo sapiens
tgtgtagtcaaaaaggtgagagcatttcttttcccgcattccaggcaagaatccaaagatttactccggttggacaacttaagtggcagctaacccttgaatcaatccccattcaaggccaggtattttccaaagctgcaatcactatgacctattgggattcaaagctccttcctaagaatgcccattccttggttacatcatcaaaggaccagacagttgaggcctaccattggcaccacgaggcctatgggtacttcttgcccatccagacaaggtggcaggacaatgaccagtatggccacgtcaacaacgccgtgtactacagctacttcgacacgattatcagcctctacctcatcaggtcgctcaagttctgcagctccagcccctctctttgactctctgacatgcccttggttgggagttcatgtagggaattccgggaagaggttcccccagttttcctctgctagtgcacctcttttgttgagccatgtgaatatcagacccttccagaggagaacagcaaactgacacgtgagtgaaaaacgcgccgccctgttgctcctgcagtctcaggtgttcatatgtcttggtcctttgcactaaattgtcagcaaatgtgtaggctttgaatctcaaataagcacctacacaatagaccacataatgttcagcccctgtgcaacttgagcagacattaacatcaaccctcgaggcctttttgtgggaaaagcagctgcttccgccacagagg

SEQ ID NO: 76799 - DNA, 787 bp, Homo sapiens
ctgccaacagatgggaaacacccctgaccttcttaatgatattggtccccagcaccttcttagtggccatggtgcatgctgtcttctgggcctgcctggggaacttgatacactggtggatcttccagtctcaattaatgtccattcctgtatatccacctccctccacctctttattttttcctctatcctctgccaggacaaccagacatttcgactttgcttaaagtaggccatctctagattctcagagcaaccctagcagtgagttgctcatcccgtgagtccttatttaatcccatgttctgaaaaagcacacccatgtcaatgcattctaagttacctgcccttactttctggcccacatcctcaatgtacaattgcagaggttctgccctacctcctggtggtacatgatagctaatttttatagcctctttgggtatattctctttcctgctttattaggcccagcaagcccccagctgggttaagctaggatttaacctccaggtattgccctgatcaccagaaggagaggcgggacaactcctcaagggtttgcctgatttctagcagggagaggcctttgcaatatcatcttgcatgggaggagtgctgacacttaatagggaggaattaaacttctgctagcactaaggcttcagggaagtgtgcagagccacttcctcagagtcatccatccagaggtcctcatccatgcttctaggccccaggtctatgtaaccatggccttgatcttagtatgacagaaatggcttgctgg

SEQ ID NO: 76800 - DNA, 382 bp, Homo sapiens
cctgtcacttcaaggaaaacaactgacagtttgttgccaatgataaaattcaaactttcaagtgaaaattaaaattttagaaagcttgtgttacctgctgtgctattgtcagcttcccagtacttaaaagattttcctgatgagatgatgggtggtgatttttatgaatgtgagtttttgctattatatgatgaattgtgtcaagatttgtaatatctgtataactcagtgagccaatattttcaaagggaccagtgttacaaaattatgggtgaaagatcttttcaaaaagcaagtaacagaatacaaagagttcatatatatgagattccatatttcgactaacccttaagaaactcctacttgtcaagttttggtgtag

SEQ ID NO: 76801 - DNA, 383 bp, Homo sapiens
  misc_feature (32)..(32): n is a, c, g, or t
  misc_feature (56)..(56): n is a, c, g, or t
  misc_feature (78)..(78): n is a, c, g, or t
  misc_feature (114)..(114): n is a, c, g, or t
attgcagtggggccattggagaaagaacagancgctggccgggcgcaagtgtcacncctgtaatcccagcacactggnagtccgaggcaggtggatcgtgaggtcaggagttcncgatcagcctggccaacatagtgaaaccccgtctctactaaaaatacaaaaattagctgggtgtagtggtgcgtgcctgcagtcccagttacttgggaagctgaggcaggagaatcacttgaacccaggaggcggaggttgtggtgagctgagatcatgccactgcactccaacctgggcaatagagcaagactgtctcaaaagaaaaaaaaaaacgaaagagtgctcagtgtgcacgctgctgcccctgcccatggtttgggagtggc

SEQ ID NO: 76802 - DNA, 424 bp, Homo sapiens
ttagtgtggtcaattttgtttctcttttttagatataatttacataccatacaatttacccttttaaagtaaatatattcagcagttttttgtatattcacaagatgtataaccaccaccactatctacagaaaattttcattacccaaaaagaaactccatacccaagagtggttacttcccctttcctggcaaccactaatctaatttctgtccctatggatttgcctgttctgaacatttcacataaagggcatcatatatgtggctgtgtctgacttctctcactatgttttcgagatacagctaggcgcggtggctcacacctgtaatcccaacactttgggactctgaggtgggaggatcacctgaggtcaggagttcgagaacagcctggccaacatggcaaaacctcgtctctact

SEQ ID NO: 76803 - DNA, 1574 bp, Homo sapiens
  misc_feature (2)..(2): n is a, c, g, or t
  misc_feature (4)..(4): n is a, c, g, or t
  misc_feature (6)..(8): n is a, c, g, or t
  misc_feature (1572)..(1572): n is a, c, g, or t
  misc_feature (1574)..(1574): n is a, c, g, or t
tncntnnnggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctcttcaccatccttcccttctttctccttcatcgctggtgctccaaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttcattcttnan

SEQ ID NO: 76804 - DNA, 1523 bp, Homo sapiens
  misc_feature (2)..(2): n is a, c, g, or t
  misc_feature (4)..(4): n is a, c, g, or t
  misc_feature (6)..(8): n is a, c, g, or t
  misc_feature (1521)..(1521): n is a, c, g, or t
  misc_feature (1523)..(1523): n is a, c, g, or t
tncntnnnggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggtatcgccagacacctgcatgctgtgattaggtactcagtggccatcatcctcttcaccatccttcccttctttctccttcatcgctggtgctccaaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttcattcttnan

SEQ ID NO: 76805 - DNA, 1469 bp, Homo sapiens
  misc_feature (2)..(2): n is a, c, g, or t
  misc_feature (4)..(4): n is a, c, g, or t
  misc_feature (6)..(8): n is a, c, g, or t
  misc_feature (1467)..(1467): n is a, c, g, or t
  misc_feature (1469)..(1469): n is a, c, g, or t
tncntnnnggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactgatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttcattcttnan

SEQ ID NO: 76806 - DNA, 342 bp, Homo sapiens
cttgaaacttataaccatagtggggaatattggcttgtcacacaggaagagaagcagagtggcagattggttatgaagagagtaagtttaggctcaaacaacttgggtttgaattttacttttgtcactaacgagccatgcagctagggcaagttatttaacttttttgggggcctggtttgttcatctggagatattaatattttctaccttgtagggttattgtgagaattgaatgaaaatgaatgccataatgtatgtgaagcgcttagtacagaacctggcacacagtaagtgctcaaatggagcccattatttttatcagacaagaagtaacctcag

SEQ ID NO: 76807 - DNA, 942 bp, Homo sapiens
atgagcgggacaaaccagtcgagtgtctccgagttcctcctcctgggactctccaggcagccccagcagcagcatctcctctttgtgttcttcctcagcatgtacctggccactgtcctggggaacctgctcatcatcctgtccgtaagcatagactcctgcctgcacacccccatgtacttcttcctcagcaacctgtcttttgtggacatctgcttctccttcaccaccgtccccaagatgctggccaatcacatactcgagactcagaccatctccttctgtggctgtctcacacagatgtatttcgttttcatgttcgtggacatggacaatttcctcctagctgtgatggcctatgaccactttgtcgccgtgtgccaccccttacattacacagcaaagatgacccatcagctctgtgccctgctggttgctggattatgggtggttgccaacctgaatgtccttctgcacaccctgctgatggctccactctcattctgtgcagacaatgccatcactcacttcttctgcgatgtgactcccctactgaaactctcctgctcagacacacacctcaatgaggtcataatccttagtgagggtgccctggtcatgatcaccccatttctttgcatcctggcttcttatatgcacatcacctgcactgtcctgaaggtcccatccacaaagggaaggtggaaagccttctccacctgtggttctcacctggctgtggttctcctcttctacagcaccatcattgctgtgtattttaaccctctgtcctcccactcagctgagaaagacactatggctactgtgttgtatacagtagtgactcccatgctaaaccctttcatctacagcctgaggaacaggtacttgaaaggggctctgaaaaaagtagttggcagggtggtgttttctgtctgatga

SEQ ID NO: 76808 - DNA, 256 bp, Homo sapiens
aacctgtaaaatatcaagtaatgggcagctttagtgaaattattgggtagtataagttaaccaaatataatatttttaatactattgaactttatcttttatgtctctgttttttaaagttttgtcatttagtatgagaatgttgcattttgaggagcatatagtatacagaaaagaacaccatattagaaatcaagaaaactggaatccaagtacatttatgttattaacaagctgtatgacctcgaacttgtct

SEQ ID NO: 76809 - DNA, 775 bp, Homo sapiens
ctcagcctcccaagtagctgggattacgggcgcctgccattatgcccagctaatttttgtatttttagtagagatggggtttcaccatgttggccaggctggtctcgaactcctgacctcaggtgatccacccacctcagccttccaaagtgctgggattacaggcatgagccaccgtgcctgcctttcattgcctcttgaaaagagcttgtcttgtttatactgtagaaattccttgagctcataggcattgctcagggtcagatgacagttctgagactcactgagttgctggaacgaggggagaggctgccacggcccgacaaatgtccctgtgaggtctatcatctcatgaagaactgctgggagacagaggcgtcctttcgcccaaccttcgagaacctcatacccattctgaagacagtccatgagaagtaccaaggccaggccccttcagtgttcagcgtgtgctgaggcacaatggcagccctgcctgggaggactggaccaggcagtggctgcagagggagcctcctgctccctgctccaggatgaaaccaagagggggatgtcagcctcacccacaccgtgtgccttactcctgtctagagaccccacctctgtgaacttatttttctttcttggccgtgagcctaaccatgatcttgagggacccaacatttgtaggggcactaatccagcccttaaatcccccagcttccaaacttgaggcccaccatctccaccatctggtaataaactcatgttttctctg

SEQ ID NO: 76810 - DNA, 858 bp, Homo sapiens
ctcagcctcccaagtagctgggattacgggcgcctgccattatgcccagctaatttttgtatttttagtagagatggggtttcaccatgttggccaggctggtctcgaactcctgacctcaggtgatccacccacctcagccttccaaagtgctgggattacaggcatgagccaccgtgcctgcctttcattgcctcttgaaaagagcttgtcttgtttatactgtagaaattccttgagctcataggcattgctcagggtcagatgacagttctgagactcactgagttgctggaacgaggggagaggctgccacggcccgacaaatgtccctgtgaggtgagacttcctttgtctttccctgaccccactatcctgctgtggagagggcagcccccaccagccctggtttttccttctaggtctatcatctcatgaagaactgctgggagacagaggcgtcctttcgcccaaccttcgagaacctcatacccattctgaagacagtccatgagaagtaccaaggccaggccccttcagtgttcagcgtgtgctgaggcacaatggcagccctgcctgggaggactggaccaggcagtggctgcagagggagcctcctgctccctgctccaggatgaaaccaagagggggatgtcagcctcacccacaccgtgtgccttactcctgtctagagaccccacctctgtgaacttatttttctttcttggccgtgagcctaaccatgatcttgagggacccaacatttgtaggggcactaatccagcccttaaatcccccagcttccaaacttgaggcccaccatctccaccatctggtaataaactcatgttttctctg

SEQ ID NO: 76811 - DNA, 4245 bp, Homo sapiens
acaagcagtagctacccgcgggagcggggaggggtccgggttcgagcttgtgttcccccggaagggtgagtctggacgcgggcgcggaaggagcgcggccggaggtcctcaggaagaagccgcggggactggctgcgcttgacaggctgcacttggatgggagcacctggtgcctcgggactgctccgatgcccgggtctgtgctgaatgtgtaatatgcggaactatattgaaacattacaaccatcttttgatggcaacaccctgaggacctcccttttccagatggggaaactgaggcccagaattgctaagtggcttgcttgagttgacacagggagctccaggactcaccctcagctgagccacctgccgggagcatgcctctgcgccactgggggatggccaggggcagtaagcccgttggggatggagcccagcccatggctgccatgggaggcctgaaggtgcttctgcactgggctggtccaggcggcggggagccctgggtcactttcagtgagtcatcgctgacagctgaggaagtctgcatccacattgcacataaagttggtatcactcctccttgcttcaatctctttgccctcttcgatgctcaggcccaagtctggttgcccccaaaccacatcctagagatccccagagatgcaagcctgatgctatatttccgcataaggttttatttccggaactggcatggcatgaatcctcgggaaccggctgtgtaccgttgtgggcccccaggaaccgaggcatcctcagatcagacagcacaggggatgcaactcctggacccagcctcatttgagtacctctttgagcagggcaagcatgagtttgtgaatgacgtggcatcactgtgggagctgtcgaccgaggaggagatccaccactttaagaatgagagcctgggcatggcctttctgcacctctgtcacctcgctctccgccatggcatccccctggaggaggtggccaagaagaccagcttcaaggactgcatcccgcgctccttccgccggcatatccggcagcacagcgccctgacccggctgcgccttcggaacgtcttccgcaggttcctgcgggacttccagccgggccgactctcccagcagatggtcatggtcaaatacctagccacactcgagcggctggcaccccgcttcggcacagagcgtgtgcccgtgtgccacctgaggctgctggcccaggccgagggggagccctgctacatccgggacagtggggtggcccctacagaccctggccctgagtctgctgctgggcccccaacccacgaggtgctggtgacaggcactggtggcatccagtggtggccagtagaggaggaggtgaacaaggaggagggttctagtggcagcagtggcaggaacccccaagccagcctgtttgggaagaaggccaaggctcacaaggcagtcggccagccggcagacaggccgcgggagccactgtgggcctacttctgtgacttccgggacatcacccacgtggtgctgaaagagcactgtgtcagcatccaccggcaggacaacaagtgcctggagctgagcttgccttcccgggctgcggcgctgtccttcgtgtcgctggtggacggctatttccgcctgacggccgactccagccactacctgtgccacgaggtggctcccccacggctggtgatgagcatccgggatgggatccacggacccctgctggagccatttgtgcaggccaagctgcggcccgaggacggcctgtacctcattcactggagcaccagccacccctaccgcctgatcctcacagtggcccagcgtagccaggcaccagacggcatgcagagcttgcggctccgaaagttccccattgagcagcaggacggggccttcgtgctggagggctggggccggtccttccccagcgttcgggaacttggggctgccttgcagggctgcttgctgagggccggggatgactgcttctctctgcgtcgctgttgcctgccccaaccaggagaaacctccaatctcatcatcatgcggggggctcgggccagccccaggacactcaacctcagccagctcagcttccaccgggttgaccagaaggagatcacccagctgtcccacttgggccagggcacaaggaccaacgtgtatgagggccgcctgcgagtggagggcagcggggaccctgaggagggcaagatggatgacgaggaccccctcgtgcctggcagggaccgtgggcaggagctacgagtggtgctcaaagtgctggaccctagtcaccatgacatcgccctggccttctacgagacagccagcctcatgagccaggtctcccacacgcacctggccttcgtgcatggcgtctgtgtgcgcggccctgaaaatatcatggtgacagagtacgtggagcacggacccctggatgtgtggctgcggagggagcggggccatgtgcccatggcttggaagatggtggtggcccagcagctggccagcgccctcagctacctggagaacaagaacctggttcatggtaatgtgtgtggccggaacatcctgctggcccggctggggttggcagagggcaccagccccttcatcaagctgagtgatcctggcgtgggcctgggcgccctctccagggaggagcgggtggagaggatcccctggctggcccccgaatgcctaccaggtggggccaacagcctaagcaccgccatggacaagtgggggtttggcgccaccctcctggagatctgctttgacggagaggcccctctgcagagccgcagtccctccgagaaggagcatttctaccagaggcagcaccggctgcccgagccctcctgcccacagctggccacactcaccagccagtgtctgacctatgagccaacccagaggccatcattccgcaccatcctgcgtgacctcacccggctgcagccccacaatcttgctgacgtcttgactgtgaacccggactcaccggcgtcggaccctacggttttccacaagcgctatttgaaaaagatccgagatctgggcgagggtcacttcggcaaggtcagcttgtactgctacgatccgaccaacgacggcactggcgagatggtggcggtgaaagccctcaaggcagactgcggcccccagcaccgctcgggctggaagcaggagattgacattctgcgcacgctctaccacgagcacatcatcaagtacaagggctgctgcgaggaccaaggcgagaagtcgctgcagctggtcatggagtacgtgcccctgggcagcctccgagactacctgccccggcacagcatcgggctggcccagctgctgctcttcgcccagcagatctgcgagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtatgccccagagtgcctgaaggagtataagttctactatgcgtcagatgtctggtccttcggggtgaccctgtatgagctgctgacgcactgtgactccagccagagcccccccacgaaattccttgagctcataggcattgctcagggtcagatgacagttctgagactcactgagttgctggaacgaggggagaggctgccacggcccgacaaatgtccctgtgaggtctatcatctcatgaagaactgctgggagacagaggcgtcctttcgcccaaccttcgagaacctcatacccattctgaagacagtccatgagaagtaccaaggccaggccccttcagtgttcagcgtgtgctgaggcacaatggcagccctgcctgggaggactggaccaggcagtggctgcagagggagcctcctgctccctgctccaggatgaaaccaagagggggatgtcagcctcacccacaccgtgtgccttactcctgtctagagaccccacctctgtgaacttatttttctttcttggccgtgagcctaaccatgatcttgagggacccaacatttgtaggggcactaatccagcccttaaatcccccagcttccaaacttgaggcccaccatctccaccatctggtaataaactcatgttttctctg

SEQ ID NO: 76812 - DNA, 529 bp, Homo sapiens
  misc_feature (53)..(53): n is a, c, g, or t
  misc_feature (63)..(63): n is a, c, g, or t
gcatggccgggcttttcgaagcaagcaagcttataaccaggtttcccaaaggnactggccttngggcaggcgtttgtgtgccggccctgaaaagtctatcatctcatgaagaactgctgggagacagaggcgtcctttcgcccaaccttcgagaacctcatacccattctgaagacagtccatgagaagtaccaaggccaggccccttcagtgttcagcgtgtgctgaggcacaatggcagccctgcctgggaggactggaccaggcagtggctgcagagggagcctcctgctccctgctccaggatgaaaccaagagggggatgtcagcctcacccacaccgtgtgccttactcctgtctagagaccccacctctgtgaacttatttttctttcttggccgtgagcctaaccatgatcttgagggacccaacatttgtaggggcactaatccagcccttaaatcccccagcttccaaacttgaggcccaccatctccaccatctggtaataaactcatgttttctctg

SEQ ID NO: 76813 - DNA, 343 bp, Homo sapiens
acaagcagtagctacccgcgggagcggggaggggtccgggttcgagcttgtgttcccccggaagggtgagtctggacgcgggcgcggaaggagcgcggccggaggtcctcaggaagaagccgcggggactggctgcgcttgacaggctgcacttggatgggagcacctggtgcctcgggactgctccgatgcccgggtctgtgctgaatgtgtaatatgcggaactatattgaaacattacaaccatcttttgatggcaacaccctgaggacctcccttttccagcttccaaacttgaggcccaccatctccaccatctggtaataaactcatgttttctctg

SEQ ID NO: 76814 - DNA, 4640 bp, Homo sapiens
acaagcagtagctacccgcgggagcggggaggggtccgggttcgagcttgtgttcccccggaagggtgagtctggacgcgggcgcggaaggagcgcggccggaggtcctcaggaagaagccgcggggactggctgcgcttgacaggctgcacttggatgggagcacctggtgcctcgggactgctccgatgcccgggtctgtgctgaatgtgtaatatgcggaactatattgaaacattacaaccatcttttgatggcaacaccctgaggacctcccttttccagatggggaaactgaggcccagaattgctaagtggcttgcttgagttgacacagggagctccaggactcaccctcagctgagccacctgccgggagcatgcctctgcgccactgggggatggccaggggcagtaagcccgttggggatggagcccagcccatggctgccatgggaggcctgaaggtgcttctgcactgggctggtccaggcggcggggagccctgggtcactttcagtgagtcatcgctgacagctgaggaagtctgcatccacattgcacataaagttggtatcactcctccttgcttcaatctctttgccctcttcgatgctcaggcccaagtctggttgcccccaaaccacatcctagagatccccagagatgcaagcctgatgctatatttccgcataaggttttatttccggaactggcatggcatgaatcctcgggaaccggctgtgtaccgttgtgggcccccaggaaccgaggcatcctcagatcagacagcacaggggatgcaactcctggacccagcctcatttgagtacctctttgagcagggcaagcatgagtttgtgaatgacgtggcatcactgtgggagctgtcgaccgaggaggagatccaccactttaagaatgagagcctgggcatggcctttctgcacctctgtcacctcgctctccgccatggcatccccctggaggaggtggccaagaagaccagcttcaaggactgcatcccgcgctccttccgccggcatatccggcagcacagcgccctgacccggctgcgccttcggaacgtcttccgcaggttcctgcgggacttccagccgggccgactctcccagcagatggtcatggtcaaatacctagccacactcgagcggctggcaccccgcttcggcacagagcgtgtgcccgtgtgccacctgaggctgctggcccaggccgagggggagccctgctacatccgggacagtggggtggcccctacagaccctggccctgagtctgctgctgggcccccaacccacgaggtgctggtgacaggcactggtggcatccagtggtggccagtagaggaggaggtgaacaaggaggagggttctagtggcagcagtggcaggaacccccaagccagcctgtttgggaagaaggccaaggctcacaaggcagtcggccagccggcagacaggccgcgggagccactgtgggcctacttctgtgacttccgggacatcacccacgtggtgctgaaagagcactgtgtcagcatccaccggcaggacaacaagtgcctggagctgagcttgccttcccgggctgcggcgctgtccttcgtgtcgctggtggacggctatttccgcctgacggccgactccagccactacctgtgccacgaggtggctcccccacggctggtgatgagcatccgggatgggatccacggacccctgctggagccatttgtgcaggccaagctgcggcccgaggacggcctgtacctcattcactggagcaccagccacccctaccgcctgatcctcacagtggcccagcgtagccaggcaccagacggcatgcagagcttgcggctccgaaagttccccattgagcagcaggacggggccttcgtgctggagggctggggccggtccttccccagcgttcgggaacttggggctgccttgcagggctgcttgctgagggccggggatgactgcttctctctgcgtcgctgttgcctgccccaaccaggagaaacctccaatctcatcatcatgcggggggctcgggccagccccaggacactcaacctcagccagctcagcttccaccgggttgaccagaaggagatcacccagctgtcccacttgggccagggcacaaggaccaacgtgtatgagggccgcctgcgagtggagggcagcggggaccctgaggagggcaagatggatgacgaggaccccctcgtgcctggcagggaccgtgggcaggagctacgagtggtgctcaaagtgctggaccctagtcaccatgacatcgccctggccttctacgagacagccagcctcatgagccaggtctcccacacgcacctggccttcgtgcatggcgtctgtgtgcgcggccctgaaaatatcatggtgacagagtacgtggagcacggacccctggatgtgtggctgcggagggagcggggccatgtgcccatggcttggaagatggtggtggcccagcagctggccagcgccctcagctacctggagaacaagaacctggttcatggtaatgtgtgtggccggaacatcctgctggcccggctggggttggcagagggcaccagccccttcatcaagctgagtgatcctggcgtgggcctgggcgccctctccagggaggagcgggtggagaggatcccctggctggcccccgaatgcctaccaggtggggccaacagcctaagcaccgccatggacaagtgggggtttggcgccaccctcctggagatctgctttgacggagaggcccctctgcagagccgcagtccctccgagaaggagcatttctaccagaggcagcaccggctgcccgagccctcctgcccacagctggccacactcaccagccagtgtctgacctatgagccaacccagaggccatcattccgcaccatcctgcgtgacctcacccggctgcagccccacaatcttgctgacgtcttgactgtgaacccggactcaccggcgtcggaccctacggttttccacaagcgctatttgaaaaagatccgagatctgggcgagggtcacttcggcaaggtcagcttgtactgctacgatccgaccaacgacggcactggcgagatggtggcggtgaaagccctcaaggcagactgcggcccccagcaccgctcgggctggaagcaggagattgacattctgcgcacgctctaccacgagcacatcatcaagtacaagggctgctgcgaggaccaaggtgggcgggacccggcgagtcctagagacttgagggggcgtggttagagcgtgggtgtggccttgtgggcggggccagtctggcctagccaattagagactctcaaccccaggctgcagtacgcggttcttggcatctgggtgagcgtggctgggctgcctccttcccatctggggggtgctacctgctggggccaggatggacgggagccaccagcagctccctcaagtgagaatggggttctggatgggtccatcccacctgagaactgggtctagtgtgcgcgggtcttggccttccctcccgaccttggaggggctctgctgggctcaaggtaggcggtccccggcccgccctctatcgtcccccaccggggccgcccctctccgcggcaggcgagaagtcgctgcagctggtcatggagtacgtgcccctgggcagcctccgagactacctgccccggcacagcatcgggctggcccagctgctgctcttcgcccagcagatctgcgagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtatgccccagagtgcctgaaggagtataagttctactatgcgtcagatgtctggtccttcggggtgaccctgtatgagctgctgacgcactgtgactccagccagagcccccccacgaaattccttgagctcataggcattgctcagggtcagatgacagttctgagactcactgagttgctggaacgaggggagaggctgccacggcccgacaaatgtccctgtgaggtctatcatctcatgaagaactgctgggagacagaggcgtcctttcgcccaaccttcgagaacctcatacccattctgaagacagtccatgagaagtaccaaggccaggccccttcagtgttcagcgtgtgctgaggcacaatggcagccctgcctgggaggactggaccaggcagtggctgcagagggagcctcctgctccctgctccaggatgaaaccaagagggggatgtcagcctcacccacaccgtgtgccttactcctgtctagagaccccacctctgtgaacttatttttctttcttggccgtgagcctaaccatgatcttgagggacccaacatttgtaggggcactaatccagcccttaaatcccccagcttccaaacttgaggcccaccatctccaccatctggtaataaactcatgttttctctg

SEQ ID NO: 76815 - DNA, 4357 bp, Homo sapiens
acaagcagtagctacccgcgggagcggggaggggtccgggttcgagcttgtgttcccccggaagggtgagtctggacgcgggcgcggaaggagcgcggccggaggtcctcaggaagaagccgcggggactggctgcgcttgacaggctgcacttggatgggagcacctggtgcctcgggactgctccgatgcccgggtctgtgctgaatgtgtaatatgcggaactatattgaaacattacaaccatcttttgatggcaacaccctgaggacctcccttttccagatggggaaactgaggcccagaattgctaagtggcttgcttgagttgacacagggagctccaggactcaccctcagctgagccacctgccgggagcatgcctctgcgccactgggggatggccaggggcagtaagcccgttggggatggagcccagcccatggctgccatgggaggcctgaaggtgcttctgcactgggctggtccaggcggcggggagccctgggtcactttcagtgagtcatcgctgacagctgaggaagtctgcatccacattgcacataaagttggtatcactcctccttgcttcaatctctttgccctcttcgatgctcaggcccaagtctggttgcccccaaaccacatcctagagatccccagagatgcaagcctgatgctatatttccgcataaggttttatttccggaactggcatggcatgaatcctcgggaaccggctgtgtaccgttgtgggcccccaggaaccgaggcatcctcagatcagacagcacaggggatgcaactcctggacccagcctcatttgagtacctctttgagcagggcaagcatgagtttgtgaatgacgtggcatcactgtgggagctgtcgaccgaggaggagatccaccactttaagaatgagagcctgggcatggcctttctgcacctctgtcacctcgctctccgccatggcatccccctggaggaggtggccaagaagaccagcttcaaggactgcatcccgcgctccttccgccggcatatccggcagcacagcgccctgacccggctgcgccttcggaacgtcttccgcaggttcctgcgggacttccagccgggccgactctcccagcagatggtcatggtcaaatacctagccacactcgagcggctggcaccccgcttcggcacagagcgtgtgcccgtgtgccacctgaggctgctggcccaggccgagggggagccctgctacatccgggacagtggggtggcccctacagaccctggccctgagtctgctgctgggcccccaacccacgaggtgctggtgacaggcactggtggcatccagtggtggccagtagaggaggaggtgaacaaggaggagggttctagtggcagcagtggcaggaacccccaagccagcctgtttgggaagaaggccaaggctcacaaggcagtcggccagccggcagacaggccgcgggagccactgtgggcctacttctgtgacttccgggacatcacccacgtggtgctgaaagagcactgtgtcagcatccaccggcaggacaacaagtgcctggagctgagcttgccttcccgggctgcggcgctgtccttcgtgtcgctggtggacggctatttccgcctgacggccgactccagccactacctgtgccacgaggtggctcccccacggctggtgatgagcatccgggatgggatccacggacccctgctggagccatttgtgcaggccaagctgcggcccgaggacggcctgtacctcattcactggagcaccagccacccctaccgcctgatcctcacagtggcccagcgtagccaggcaccagacggcatgcagagcttgcggctccgaaagttccccattgagcagcaggacggggccttcgtgctggagggctggggccggtccttccccagcgttcgggaacttggggctgccttgcagggctgcttgctgagggccggggatgactgcttctctctgcgtcgctgttgcctgccccaaccaggagaaacctccaatctcatcatcatgcggggggctcgggccagccccaggacactcaacctcagccagctcagcttccaccgggttgaccagaaggagatcacccagctgtcccacttgggccagggcacaaggaccaacgtgtatgagggccgcctgcgagtggagggcagcggggaccctgaggagggcaagatggatgacgaggaccccctcgtgcctggcagggaccgtgggcaggagctacgagtggtgctcaaagtgctggaccctagtcaccatgacatcgccctggccttctacgagacagccagcctcatgagccaggtctcccacacgcacctggccttcgtgcatggcgtctgtgtgcgcggccctgaaagtagctcaaaactccttgtataggctaggtgtggtggctcacacctatcccagcactttgggaggcagaggtgggaggatcgcttaaacccaggagttcaagaccagcctggatatcatggtgacagagtacgtggagcacggacccctggatgtgtggctgcggagggagcggggccatgtgcccatggcttggaagatggtggtggcccagcagctggccagcgccctcagctacctggagaacaagaacctggttcatggtaatgtgtgtggccggaacatcctgctggcccggctggggttggcagagggcaccagccccttcatcaagctgagtgatcctggcgtgggcctgggcgccctctccagggaggagcgggtggagaggatcccctggctggcccccgaatgcctaccaggtggggccaacagcctaagcaccgccatggacaagtgggggtttggcgccaccctcctggagatctgctttgacggagaggcccctctgcagagccgcagtccctccgagaaggagcatttctaccagaggcagcaccggctgcccgagccctcctgcccacagctggccacactcaccagccagtgtctgacctatgagccaacccagaggccatcattccgcaccatcctgcgtgacctcacccggctgcagccccacaatcttgctgacgtcttgactgtgaacccggactcaccggcgtcggaccctacggttttccacaagcgctatttgaaaaagatccgagatctgggcgagggtcacttcggcaaggtcagcttgtactgctacgatccgaccaacgacggcactggcgagatggtggcggtgaaagccctcaaggcagactgcggcccccagcaccgctcgggctggaagcaggagattgacattctgcgcacgctctaccacgagcacatcatcaagtacaagggctgctgcgaggaccaaggcgagaagtcgctgcagctggtcatggagtacgtgcccctgggcagcctccgagactacctgccccggcacagcatcgggctggcccagctgctgctcttcgcccagcagatctgcgagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtatgccccagagtgcctgaaggagtataagttctactatgcgtcagatgtctggtccttcggggtgaccctgtatgagctgctgacgcactgtgactccagccagagcccccccacgaaattccttgagctcataggcattgctcagggtcagatgacagttctgagactcactgagttgctggaacgaggggagaggctgccacggcccgacaaatgtccctgtgaggtctatcatctcatgaagaactgctgggagacagaggcgtcctttcgcccaaccttcgagaacctcatacccattctgaagacagtccatgagaagtaccaaggccaggccccttcagtgttcagcgtgtgctgaggcacaatggcagccctgcctgggaggactggaccaggcagtggctgcagagggagcctcctgctccctgctccaggatgaaaccaagagggggatgtcagcctcacccacaccgtgtgccttactcctgtctagagaccccacctctgtgaacttatttttctttcttggccgtgagcctaaccatgatcttgagggacccaacatttgtaggggcactaatccagcccttaaatcccccagcttccaaacttgaggcccaccatctccaccatctggtaataaactcatgttttctctg

SEQ ID NO: 76816 - DNA, 4009 bp, Homo sapiens
tgtctatcgatgcaccttcatcatacctcgggtggtgaaggtggcaagagaatttatttccaggcttggaaatgtacccagccctttggccagaaaccagcagtgcaattggctccatcctagctgcaagggaggctgggaaatgtagtcctcctgtgaggccacagcatgggcaacatacgcactgtcctctgcccaggggcaacgtgagactgaagctgcaggtgggggagggggcctcagagggagtgtgaaggcagacattgggtctggggggtctttggggctgacggtagcaaatgacgtgactcctgacctcgtttctcacctgatccaggtatcactcctccttgcttcaatctctttgccctcttcgatgctcaggcccaagtctggttgcccccaaaccacatcctagagatccccagagatgcaagcctgatgctatatttccgcataaggttttatttccggaactggcatggcatgaatcctcgggaaccggctgtgtaccgttgtgggcccccaggaaccgaggcatcctcagatcagacagcacaggggatgcaactcctggacccagcctcatttgagtacctctttgagcagggcaagcatgagtttgtgaatgacgtggcatcactgtgggagctgtcgaccgaggaggagatccaccactttaagaatgagagcctgggcatggcctttctgcacctctgtcacctcgctctccgccatggcatccccctggaggaggtggccaagaagaccagcttcaaggactgcatcccgcgctccttccgccggcatatccggcagcacagcgccctgacccggctgcgccttcggaacgtcttccgcaggttcctgcgggacttccagccgggccgactctcccagcagatggtcatggtcaaatacctagccacactcgagcggctggcaccccgcttcggcacagagcgtgtgcccgtgtgccacctgaggctgctggcccaggccgagggggagccctgctacatccgggacagtggggtggcccctacagaccctggccctgagtctgctgctgggcccccaacccacgaggtgctggtgacaggcactggtggcatccagtggtggccagtagaggaggaggtgaacaaggaggagggttctagtggcagcagtggcaggaacccccaagccagcctgtttgggaagaaggccaaggctcacaaggcagtcggccagccggcagacaggccgcgggagccactgtgggcctacttctgtgacttccgggacatcacccacgtggtgctgaaagagcactgtgtcagcatccaccggcaggacaacaagtgcctggagctgagcttgccttcccgggctgcggcgctgtccttcgtgtcgctggtggacggctatttccgcctgacggccgactccagccactacctgtgccacgaggtggctcccccacggctggtgatgagcatccgggatgggatccacggacccctgctggagccatttgtgcaggccaagctgcggcccgaggacggcctgtacctcattcactggagcaccagccacccctaccgcctgatcctcacagtggcccagcgtagccaggcaccagacggcatgcagagcttgcggctccgaaagttccccattgagcagcaggacggggccttcgtgctggagggctggggccggtccttccccagcgttcgggaacttggggctgccttgcagggctgcttgctgagggccggggatgactgcttctctctgcgtcgctgttgcctgccccaaccaggagaaacctccaatctcatcatcatgcggggggctcgggccagccccaggacactcaacctcagccagctcagcttccaccgggttgaccagaaggagatcacccagctgtcccacttgggccagggcacaaggaccaacgtgtatgagggccgcctgcgagtggagggcagcggggaccctgaggagggcaagatggatgacgaggaccccctcgtgcctggcagggaccgtgggcaggagctacgagtggtgctcaaagtgctggaccctagtcaccatgacatcgccctggccttctacgagacagccagcctcatgagccaggtctcccacacgcacctggccttcgtgcatggcgtctgtgtgcgcggccctgaaaatatcatggtgacagagtacgtggagcacggacccctggatgtgtggctgcggagggagcggggccatgtgcccatggcttggaagatggtggtggcccagcagctggccagcgccctcagctacctggagaacaagaacctggttcatggtaatgtgtgtggccggaacatcctgctggcccggctggggttggcagagggcaccagccccttcatcaagctgagtgatcctggcgtgggcctgggcgccctctccagggaggagcgggtggagaggatcccctggctggcccccgaatgcctaccaggtggggccaacagcctaagcaccgccatggacaagtgggggtttggcgccaccctcctggagatctgctttgacggagaggcccctctgcagagccgcagtccctccgagaaggagcatttctaccagaggcagcaccggctgcccgagccctcctgcccacagctggccacactcaccagccagtgtctgacctatgagccaacccagaggccatcattccgcaccatcctgcgtgacctcacccggctgcagccccacaatcttgctgacgtcttgactgtgaacccggactcaccggcgtcggaccctacggttttccacaagcgctatttgaaaaagatccgagatctgggcgagggtcacttcggcaaggtcagcttgtactgctacgatccgaccaacgacggcactggcgagatggtggcggtgaaagccctcaaggcagactgcggcccccagcaccgctcgggctggaagcaggagattgacattctgcgcacgctctaccacgagcacatcatcaagtacaagggctgctgcgaggaccaaggcgagaagtcgctgcagctggtcatggagtacgtgcccctgggcagcctccgagactacctgccccggcacagcatcgggctggcccagctgctgctcttcgcccagcagatctgcgagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtatgccccagagtgcctgaaggagtataagttctactatgcgtcagatgtctggtccttcggggtgaccctgtatgagctgctgacgcactgtgactccagccagagcccccccacgaaattccttgagctcataggcattgctcagggtcagatgacagttctgagactcactgagttgctggaacgaggggagaggctgccacggcccgacaaatgtccctgtgaggtctatcatctcatgaagaactgctgggagacagaggcgtcctttcgcccaaccttcgagaacctcatacccattctgaagacagtccatgagaagtaccaaggccaggccccttcagtgttcagcgtgtgctgaggcacaatggcagccctgcctgggaggactggaccaggcagtggctgcagagggagcctcctgctccctgctccaggatgaaaccaagagggggatgtcagcctcacccacaccgtgtgccttactcctgtctagagaccccacctctgtgaacttatttttctttcttggccgtgagcctaaccatgatcttgagggacccaacatttgtaggggcactaatccagcccttaaatcccccagcttccaaacttgaggcccaccatctccaccatctggtaataaactcatgttttctctg

SEQ ID NO: 76817 - DNA, 3849 bp, Homo sapiens
tgtctatcgatgcaccttcatcatacctcgggtggtgaaggtggcaagagaatttatttccaggcttggaaatgtacccagccctttggccagaaaccagcagtgcaattggctccatcctagctgcaagggaggctgggaaatgtagtcctcctgtgaggccacagcatgggcaacatacgcactgtcctctgcccaggggcaacgtgagactgaagctgcaggcccaagtctggttgcccccaaaccacatcctagagatccccagagatgcaagcctgatgctatatttccgcataaggttttatttccggaactggcatggcatgaatcctcgggaaccggctgtgtaccgttgtgggcccccaggaaccgaggcatcctcagatcagacagcacaggggatgcaactcctggacccagcctcatttgagtacctctttgagcagggcaagcatgagtttgtgaatgacgtggcatcactgtgggagctgtcgaccgaggaggagatccaccactttaagaatgagagcctgggcatggcctttctgcacctctgtcacctcgctctccgccatggcatccccctggaggaggtggccaagaagaccagcttcaaggactgcatcccgcgctccttccgccggcatatccggcagcacagcgccctgacccggctgcgccttcggaacgtcttccgcaggttcctgcgggacttccagccgggccgactctcccagcagatggtcatggtcaaatacctagccacactcgagcggctggcaccccgcttcggcacagagcgtgtgcccgtgtgccacctgaggctgctggcccaggccgagggggagccctgctacatccgggacagtggggtggcccctacagaccctggccctgagtctgctgctgggcccccaacccacgaggtgctggtgacaggcactggtggcatccagtggtggccagtagaggaggaggtgaacaaggaggagggttctagtggcagcagtggcaggaacccccaagccagcctgtttgggaagaaggccaaggctcacaaggcagtcggccagccggcagacaggccgcgggagccactgtgggcctacttctgtgacttccgggacatcacccacgtggtgctgaaagagcactgtgtcagcatccaccggcaggacaacaagtgcctggagctgagcttgccttcccgggctgcggcgctgtccttcgtgtcgctggtggacggctatttccgcctgacggccgactccagccactacctgtgccacgaggtggctcccccacggctggtgatgagcatccgggatgggatccacggacccctgctggagccatttgtgcaggccaagctgcggcccgaggacggcctgtacctcattcactggagcaccagccacccctaccgcctgatcctcacagtggcccagcgtagccaggcaccagacggcatgcagagcttgcggctccgaaagttccccattgagcagcaggacggggccttcgtgctggagggctggggccggtccttccccagcgttcgggaacttggggctgccttgcagggctgcttgctgagggccggggatgactgcttctctctgcgtcgctgttgcctgccccaaccaggagaaacctccaatctcatcatcatgcggggggctcgggccagccccaggacactcaacctcagccagctcagcttccaccgggttgaccagaaggagatcacccagctgtcccacttgggccagggcacaaggaccaacgtgtatgagggccgcctgcgagtggagggcagcggggaccctgaggagggcaagatggatgacgaggaccccctcgtgcctggcagggaccgtgggcaggagctacgagtggtgctcaaagtgctggaccctagtcaccatgacatcgccctggccttctacgagacagccagcctcatgagccaggtctcccacacgcacctggccttcgtgcatggcgtctgtgtgcgcggccctgaaaatatcatggtgacagagtacgtggagcacggacccctggatgtgtggctgcggagggagcggggccatgtgcccatggcttggaagatggtggtggcccagcagctggccagcgccctcagctacctggagaacaagaacctggttcatggtaatgtgtgtggccggaacatcctgctggcccggctggggttggcagagggcaccagccccttcatcaagctgagtgatcctggcgtgggcctgggcgccctctccagggaggagcgggtggagaggatcccctggctggcccccgaatgcctaccaggtggggccaacagcctaagcaccgccatggacaagtgggggtttggcgccaccctcctggagatctgctttgacggagaggcccctctgcagagccgcagtccctccgagaaggagcatttctaccagaggcagcaccggctgcccgagccctcctgcccacagctggccacactcaccagccagtgtctgacctatgagccaacccagaggccatcattccgcaccatcctgcgtgacctcacccggctgcagccccacaatcttgctgacgtcttgactgtgaacccggactcaccggcgtcggaccctacggttttccacaagcgctatttgaaaaagatccgagatctgggcgagggtcacttcggcaaggtcagcttgtactgctacgatccgaccaacgacggcactggcgagatggtggcggtgaaagccctcaaggcagactgcggcccccagcaccgctcgggctggaagcaggagattgacattctgcgcacgctctaccacgagcacatcatcaagtacaagggctgctgcgaggaccaaggcgagaagtcgctgcagctggtcatggagtacgtgcccctgggcagcctccgagactacctgccccggcacagcatcgggctggcccagctgctgctcttcgcccagcagatctgcgagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtatgccccagagtgcctgaaggagtataagttctactatgcgtcagatgtctggtccttcggggtgaccctgtatgagctgctgacgcactgtgactccagccagagcccccccacgaaattccttgagctcataggcattgctcagggtcagatgacagttctgagactcactgagttgctggaacgaggggagaggctgccacggcccgacaaatgtccctgtgaggtctatcatctcatgaagaactgctgggagacagaggcgtcctttcgcccaaccttcgagaacctcatacccattctgaagacagtccatgagaagtaccaaggccaggccccttcagtgttcagcgtgtgctgaggcacaatggcagccctgcctgggaggactggaccaggcagtggctgcagagggagcctcctgctccctgctccaggatgaaaccaagagggggatgtcagcctcacccacaccgtgtgccttactcctgtctagagaccccacctctgtgaacttatttttctttcttggccgtgagcctaaccatgatcttgagggacccaacatttgtaggggcactaatccagcccttaaatcccccagcttccaaacttgaggcccaccatctccaccatctggtaataaactcatgttttctctg

SEQ ID NO: 76818 - DNA, 5069 bp, Homo sapiens
acaagcagtagctacccgcgggagcggggaggggtccgggttcgagcttgtgttcccccggaagggtgagtctggacgcgggcgcggaaggagcgcggccggaggtcctcaggaagaagccgcggggactggctgcgcttgacaggctgcacttggatgggagcacctggtgcctcgggactgctccgatgcccgggtctgtgctgaatgtgtaatatgcggaactatattgaaacattacaaccatcttttgatggcaacaccctgaggacctcccttttccagatggggaaactgaggcccagaattgctaagtggcttgcttgagttgacacagggagctccaggactcaccctcagctgagccacctgccgggagcatgcctctgcgccactgggggatggccaggggcagtaagcccgttggggatggagcccagcccatggctgccatgggaggcctgaaggtgcttctgcactgggctggtccaggcggcggggagccctgggtcactttcagtgagtcatcgctgacagctgaggaagtctgcatccacattgcacataaagttggtatcactcctccttgcttcaatctctttgccctcttcgatgctcaggcccaagtctggttgcccccaaaccacatcctagagatccccagagatgcaagcctgatgctatatttccgcataaggttttatttccggaactggcatggcatgaatcctcgggaaccggctgtgtaccgttgtgggcccccaggaaccgaggcatcctcagatcagacagcacaggggatgcaactcctggacccagcctcatttgagtacctctttgagcagggcaagcatgagtttgtgaatgacgtggcatcactgtgggagctgtcgaccgaggaggagatccaccactttaagaatgagagcctgggcatggcctttctgcacctctgtcacctcgctctccgccatggcatccccctggaggaggtggccaagaagaccagcttcaaggactgcatcccgcgctccttccgccggcatatccggcagcacagcgccctgacccggctgcgccttcggaacgtcttccgcaggttcctgcgggacttccagccgggccgactctcccagcagatggtcatggtcaaatacctagccacactcgagcggctggcaccccgcttcggcacagagcgtgtgcccgtgtgccacctgaggctgctggcccaggccgagggggagccctgctacatccgggacagtggggtggcccctacagaccctggccctgagtctgctgctgggcccccaacccacgaggtgctggtgacaggcactggtggcatccagtggtggccagtagaggaggaggtgaacaaggaggagggttctagtggcagcagtggcaggaacccccaagccagcctgtttgggaagaaggccaaggctcacaaggcagtcggccagccggcagacaggccgcgggagccactgtgggcctacttctgtgacttccgggacatcacccacgtggtgctgaaagagcactgtgtcagcatccaccggcaggacaacaagtgcctggagctgagcttgccttcccgggctgcggcgctgtccttcgtgtcgctggtggacggctatttccgcctgacggccgactccagccactacctgtgccacgaggtggctcccccacggctggtgatgagcatccgggatgggatccacggacccctgctggagccatttgtgcaggccaagctgcggcccgaggacggcctgtacctcattcactggagcaccagccacccctaccgcctgatcctcacagtggcccagcgtagccaggcaccagacggcatgcagagcttgcggctccgaaagttccccattgagcagcaggacggggccttcgtgctggagggctggggccggtccttccccagcgttcgggaacttggggctgccttgcagggctgcttgctgagggccggggatgactgcttctctctgcgtcgctgttgcctgccccaaccaggagaaacctccaatctcatcatcatgcggggggctcgggccagccccaggacactcaacctcagccagctcagcttccaccgggttgaccagaaggagatcacccagctgtcccacttgggccagggcacaaggaccaacgtgtatgagggccgcctgcgagtggagggcagcggggaccctgaggagggcaagatggatgacgaggaccccctcgtgcctggcagggaccgtgggcaggagctacgagtggtgctcaaagtgctggaccctagtcaccatgacatcgccctggccttctacgagacagccagcctcatgagccaggtctcccacacgcacctggccttcgtgcatggcgtctgtgtgcgcggccctgaaaatatcatggtgacagagtacgtggagcacggacccctggatgtgtggctgcggagggagcggggccatgtgcccatggcttggaagatggtggtggcccagcagctggccagcgccctcagctacctggagaacaagaacctggttcatggtaatgtgtgtggccggaacatcctgctggcccggctggggttggcagagggcaccagccccttcatcaagctgagtgatcctggcgtgggcctgggcgccctctccagggaggagcgggtggagaggatcccctggctggcccccgaatgcctaccaggtggggccaacagcctaagcaccgccatggacaagtgggggtttggcgccaccctcctggagatctgctttgacggagaggcccctctgcagagccgcagtccctccgagaaggagcatttctaccagaggcagcaccggctgcccgagccctcctgcccacagctggccacactcaccagccagtgtctgacctatgagccaacccagaggccatcattccgcaccatcctgcgtgacctcacccggctgcagccccacaatcttgctgacgtcttgactgtgaacccggactcaccggcgtcggaccctacggttttccacaagcgctatttgaaaaagatccgagatctgggcgagggtcacttcggcaaggtcagcttgtactgctacgatccgaccaacgacggcactggcgagatggtggcggtgaaagccctcaaggcagactgcggcccccagcaccgctcgggctggaagcaggagattgacattctgcgcacgctctaccacgagcacatcatcaagtacaagggctgctgcgaggaccaaggtgggcgggacccggcgagtcctagagacttgagggggcgtggttagagcgtgggtgtggccttgtgggcggggccagtctggcctagccaattagagactctcaaccccaggctgcagtacgcggttcttggcatctgggtgagcgtggctgggctgcctccttcccatctggggggtgctacctgctggggccaggatggacgggagccaccagcagctccctcaagtgagaatggggttctggatgggtccatcccacctgagaactgggtctagtgtgcgcgggtcttggccttccctcccgaccttggaggggctctgctgggctcaaggtaggcggtccccggcccgccctctatcgtcccccaccggggccgcccctctccgcggcaggcgagaagtcgctgcagctggtcatggagtacgtgcccctgggcagcctccgagactacctgccccggcacagcatcgggctggcccagctgctgctcttcgcccagcagatctgcgaggttggtcggccccgcccctgcttctggagcttgccccttcctcttcagcttgggctggcctgagcgatccggtgcagtctgctctcacgctccgcccctgctcgtttgcccaggctgtcttgtccttgcactgacctccgaactgtttggcttgcttggccacaccccctcctcccaagggaccacgcacagccggctcggcccctcccaactcgccctcctgcccagctttgctcgtctagccccgtccctgctttctggctcagcctccttttgcttggtgccacgtgccatccggccctctccagcggccgggtagccaccggcctgacctgactgtcccccagccctcctggctgctcaggtcctgccgccgcccccggccgaaccccgccccactgaaactcacgagccctgccccgtccccagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtatgccccagagtgcctgaaggagtataagttctactatgcgtcagatgtctggtccttcggggtgaccctgtatgagctgctgacgcactgtgactccagccagagcccccccacgaaattccttgagctcataggcattgctcagggtcagatgacagttctgagactcactgagttgctggaacgaggggagaggctgccacggcccgacaaatgtccctgtgaggtctatcatctcatgaagaactgctgggagacagaggcgtcctttcgcccaaccttcgagaacctcatacccattctgaagacagtccatgagaagtaccaaggccaggccccttcagtgttcagcgtgtgctgaggcacaatggcagccctgcctgggaggactggaccaggcagtggctgcagagggagcctcctgctccctgctccaggatgaaaccaagagggggatgtcagcctcacccacaccgtgtgccttactcctgtctagagaccccacctctgtgaacttatttttctttcttggccgtgagcctaaccatgatcttgagggacccaacatttgtaggggcactaatccagcccttaaatcccccagcttccaaacttgaggcccaccatctccaccatctggtaataaactcatgttttctctg

SEQ ID NO: 76819 - DNA, 3375 bp, Homo sapiens
acaagcagtagctacccgcgggagcggggaggggtccgggttcgagcttgtgttcccccggaagggtgagtctggacgcgggcgcggaaggagcgcggccggaggtcctcaggaagaagccgcggggactggctgcgcttgacaggctgcacttggatgggagcacctggtgcctcgggactgctccgatgcccgggtctgtgctgaatgtgtaatatgcggaactatattgaaacattacaaccatcttttgatggcaacaccctgaggacctcccttttccagatggggaaactgaggcccagaattgctaagtggcttgcttgagttgacacagggagctccaggactcaccctcagctgagccacctgccgggagcatgcctctgcgccactgggggatggccaggggcagtaagcccgttggggatggagcccagcccatggctgccatgggaggcctgaaggtgcttctgcactgggctggtccaggcggcggggagccctgggtcactttcagtgagtcatcgctgacagctgaggaagtctgcatccacattgcacataaagttggtatcactcctccttgcttcaatctctttgccctcttcgatgctcaggcccaagtctggttgcccccaaaccacatcctagagatccccagagatgcaagcctgatgctatatttccgcataaggttttatttccggaactggcatggcatgaatcctcgggaaccggctgtgtaccgttgtgggcccccaggaaccgaggcatcctcagatcagacagcacaggggatgcaactcctggacccagcctcatttgagtacctctttgagcagggcaagcatgagtttgtgaatgacgtggcatcactgtgggagctgtcgaccgaggaggagatccaccactttaagaatgagagcctgggcatggcctttctgcacctctgtcacctcgctctccgccatggcatccccctggaggaggtggccaagaagaccagcttcaaggactgcatcccgcgctccttccgccggcatatccggcagcacagcgccctgacccggctgcgccttcggaacgtcttccgcaggttcctgcgggacttccagccgggccgactctcccagcagatggtcatggtcaaatacctagccacactcgagcggctggcaccccgcttcggcacagagcgtgtgcccgtgtgccacctgaggctgctggcccaggccgagggggagccctgctacatccgggacagtggggtggcccctacagaccctggccctgagtctgctgctgggcccccaacccacgaggtgctggtgacaggcactggtggcatccagtggtggccagtagaggaggaggtgaacaaggaggagggttctagtggcagcagtggcaggaacccccaagccagcctgtttgggaagaaggccaaggctcacaaggcagtcggccagccggcagacaggccgcgggagccactgtgggcctacttctgtgacttccgggacatcacccacgtggtgctgaaagagcactgtgtcagcatccaccggcaggacaacaagtgcctggagctgagcttgccttcccgggctgcggcgctgtccttcgtgtcgctggtggacggctatttccgcctgacggccgactccagccactacctgtgccacgaggtggctcccccacggctggtgatgagcatccgggatgggatccacggacccctgctggagccatttgtgcaggccaagctgcggcccgaggacggcctgtacctcattcactggagcaccagccacccctaccgcctgatcctcacagtggcccagcgtagccaggcaccagacggcatgcagagcttgcggctccgaaagttccccattgagcagcaggacggggccttcgtgctggagggctggggccggtccttccccagcgttcgggaacttggggctgccttgcagggctgcttgctgagggccggggatgactgcttctctctgcgtcgctgttgcctgccccaaccaggagaaacctccaatctcatcatcatgcggggggctcgggccagccccaggacactcaacctcagccagctcagcttccaccatcttgctgacgtcttgactgtgaacccggactcaccggcgtcggaccctacggttttccacaagcgctatttgaaaaagatccgagatctgggcgagggtcacttcggcaaggtcagcttgtactgctacgatccgaccaacgacggcactggcgagatggtggcggtgaaagccctcaaggcagactgcggcccccagcaccgctcgggctggaagcaggagattgacattctgcgcacgctctaccacgagcacatcatcaagtacaagggctgctgcgaggaccaaggcgagaagtcgctgcagctggtcatggagtacgtgcccctgggcagcctccgagactacctgccccggcacagcatcgggctggcccagctgctgctcttcgcccagcagatctgcgagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtatgccccagagtgcctgaaggagtataagttctactatgcgtcagatgtctggtccttcggggtgaccctgtatgagctgctgacgcactgtgactccagccagagcccccccacgaaattccttgagctcataggcattgctcagggtcagatgacagttctgagactcactgagttgctggaacgaggggagaggctgccacggcccgacaaatgtccctgtgaggtctatcatctcatgaagaactgctgggagacagaggcgtcctttcgcccaaccttcgagaacctcatacccattctgaagacagtccatgagaagtaccaaggccaggccccttcagtgttcagcgtgtgctgaggcacaatggcagccctgcctgggaggactggaccaggcagtggctgcagagggagcctcctgctccctgctccaggatgaaaccaagagggggatgtcagcctcacccacaccgtgtgccttactcctgtctagagaccccacctctgtgaacttatttttctttcttggccgtgagcctaaccatgatcttgagggacccaacatttgtaggggcactaatccagcccttaaatcccccagcttccaaacttgaggcccaccatctccaccatctggtaataaactcatgttttctctg

SEQ ID NO: 76820 - DNA, 4250 bp, Homo sapiens
acaagcagtagctacccgcgggagcggggaggggtccgggttcgagcttgtgttcccccggaagggtgagtctggacgcgggcgcggaaggagcgcggccggaggtcctcaggaagaagccgcggggactggctgcgcttgacaggctgcacttggatgggagcacctggtgcctcgggactgctccgatgcccgggtctgtgctgaatgtgtaatatgcggaactatattgaaacattacaaccatcttttgatggcaacaccctgaggacctcccttttccagatggggaaactgaggcccagaattgctaagtggcttgcttgagttgacacagggagctccaggactcaccctcagctgagccacctgccgggagcatgcctctgcgccactgggggatggccaggggcagtaagcccgttggggatggagcccagcccatggctgccatgggaggcctgaaggtgcttctgcactgggctggtccaggcggcggggagccctgggtcactttcagtgagtcatcgctgacagctgaggaagtctgcatccacattgcacataaagttggtatcactcctccttgcttcaatctctttgccctcttcgatgctcaggcccaagtctggttgcccccaaaccacatcctagagatccccagagatgcaagcctgatgctatatttccgcataaggttttatttccggaactggcatggcatgaatcctcgggaaccggctgtgtaccgttgtgggcccccaggaaccgaggcatcctcagatcagacagcacaggggatgcaactcctggacccagcctcatttgagtacctctttgagcagggcaagcatgagtttgtgaatgacgtggcatcactgtgggagctgtcgaccgaggaggagatccaccactttaagaatgagagcctgggcatggcctttctgcacctctgtcacctcgctctccgccatggcatccccctggaggaggtggccaagaagaccagcttcaaggactgcatcccgcgctccttccgccggcatatccggcagcacagcgccctgacccggctgcgccttcggaacgtcttccgcaggttcctgcgggacttccagccgggccgactctcccagcagatggtcatggtcaaatacctagccacactcgagcggctggcaccccgcttcggcacagagcgtgtgcccgtgtgccacctgaggctgctggcccaggccgagggggagccctgctacatccgggacagtggggtggcccctacagaccctggccctgagtctgctgctgggcccccaacccacgaggtgctggtgacaggcactggtggcatccagtggtggccagtagaggaggaggtgaacaaggaggagggttctagtggcagcagtggcaggaacccccaagccagcctgtttgggaagaaggccaaggctcacaaggcagtcggccagccggcagacaggccgcgggagccactgtgggcctacttctgtgacttccgggacatcacccacgtggtgctgaaagagcactgtgtcagcatccaccggcaggacaacaagtgcctggagctgagcttgccttcccgggctgcggcgctgtccttcgtgtcgctggtggacggctatttccgcctgacggccgactccagccactacctgtgccacgaggtggctcccccacggctggtgatgagcatccgggatgggatccacggacccctgctggagccatttgtgcaggccaagctgcggcccgaggacggcctgtacctcattcactggagcaccagccacccctaccgcctgatcctcacagtggcccagcgtagccaggcaccagacggcatgcagagcttgcggctccgaaagttccccattgagcagcaggacggggccttcgtgctggagggctggggccggtccttccccagcgttcgggaacttggggctgccttgcagggctgcttgctgagggccggggatgactgcttctctctgcgtcgctgttgcctgccccaaccaggagaaacctccaatctcatcatcatgcggggggctcgggccagccccaggacactcaacctcagccagctcagcttccaccgggttgaccagaaggagatcacccagctgtcccacttgggccagggcacaaggaccaacgtgtatgagggccgcctgcgagtggagggcagcggggaccctgaggagggcaagatggatgacgaggaccccctcgtgcctggcagggaccgtgggcaggagctacgagtggtgctcaaagtgctggaccctagtcaccatgacatcgccctggccttctacgagacagccagcctcatgagccaggtctcccacacgcacctggccttcgtgcatggcgtctgtgtgcgcggccctgaaaatatcatggtgacagagtacgtggagcacggacccctggatgtgtggctgcggagggagcggggccatgtgcccatggcttggaagatggtggtggcccagcagctggccagcgccctcagctacctggagaacaagaacctggttcatggtaatgtgtgtggccggaacatcctgctggcccggctggggttggcagagggcaccagccccttcatcaagctgagtgatcctggcgtgggcctgggcgccctctccagggaggagcgggtggagaggatcccctggctggcccccgaatgcctaccaggtggggccaacagcctaagcaccgccatggacaagtgggggtttggcgccaccctcctggagatctgctttgacggagaggcccctctgcagagccgcagtccctccgagaaggagcatttctaccagaggcagcaccggctgcccgagccctcctgcccacagctggccacactcaccagccagtgtctgacctatgagccaacccagaggccatcattccgcaccatcctgcgtgacctcacccggctgcagccccacaatcttgctgacgtcttgactgtgaacccggactcaccggcgtcggaccctacggttttccacaagcgctatttgaaaaagatccgagatctgggcgagggtcacttcggcaaggtcagcttgtactgctacgatccgaccaacgacggcactggcgagatggtggcggtgaaagccctcaaggcagactgcggcccccagcaccgctcgggctggaagcaggagattgacattctgcgcacgctctaccacgagcacatcatcaagtacaagggctgctgcgaggaccaaggcgagaagtcgctgcagctggtcatggagtacgtgcccctgggcagcctccgagactacctgccccggcacagcatcgggctggcccagctgctgctcttcgcccagcagatctgcgagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtatgccccagagtgcctgaaggagtataagttctactatgcgtcagatgtctggtccttcggggtgaccctgtatgagctgctgacgcactgtgactccagccagagcccccccacgaaattccttgagctcataggcattgctcagggtcagatgacagttctgagactcactgagttgctggaacgaggggagaggctgccacggcccgacaaatgtccctgtgaggtctatcatctcatgaagaactgctgggagacagaggcgtcctttcgcccaaccttcgagaacctcatacccattctgaagacagtccatgagaagtaccaaggccaggccccttcagtgttcagcgtgtgctgaggcacaatggcagccctgcctgggaggactggaccaggcagtggctgcagagggagcctcctgctccctgctccaggatgaaaccaagagggggatgtcagcctcacccacaccgtgtgccttactcctgtctagagaccccacctctgtgaacttatttttctttcttggccgtgagcctaaccatgatcttgagggacccaacatttgtaggggcactaatccagcccttaaatcccccagcttccaaacttgaggccccacgccaattaataccaaccgaggttctccggtagaataacctac

SEQ ID NO: 76821 - DNA, 4265 bp, Homo sapiens
  misc_feature (4262)..(4262): n is a, c, g, or t
acaagcagtagctacccgcgggagcggggaggggtccgggttcgagcttgtgttcccccggaagggtgagtctggacgcgggcgcggaaggagcgcggccggaggtcctcaggaagaagccgcggggactggctgcgcttgacaggctgcacttggatgggagcacctggtgcctcgggactgctccgatgcccgggtctgtgctgaatgtgtaatatgcggaactatattgaaacattacaaccatcttttgatggcaacaccctgaggacctcccttttccagatggggaaactgaggcccagaattgctaagtggcttgcttgagttgacacagggagctccaggactcaccctcagctgagccacctgccgggagcatgcctctgcgccactgggggatggccaggggcagtaagcccgttggggatggagcccagcccatggctgccatgggaggcctgaaggtgcttctgcactgggctggtccaggcggcggggagccctgggtcactttcagtgagtcatcgctgacagctgaggaagtctgcatccacattgcacataaagttggtatcactcctccttgcttcaatctctttgccctcttcgatgctcaggcccaagtctggttgcccccaaaccacatcctagagatccccagagatgcaagcctgatgctatatttccgcataaggttttatttccggaactggcatggcatgaatcctcgggaaccggctgtgtaccgttgtgggcccccaggaaccgaggcatcctcagatcagacagcacaggggatgcaactcctggacccagcctcatttgagtacctctttgagcagggcaagcatgagtttgtgaatgacgtggcatcactgtgggagctgtcgaccgaggaggagatccaccactttaagaatgagagcctgggcatggcctttctgcacctctgtcacctcgctctccgccatggcatccccctggaggaggtggccaagaagaccagcttcaaggactgcatcccgcgctccttccgccggcatatccggcagcacagcgccctgacccggctgcgccttcggaacgtcttccgcaggttcctgcgggacttccagccgggccgactctcccagcagatggtcatggtcaaatacctagccacactcgagcggctggcaccccgcttcggcacagagcgtgtgcccgtgtgccacctgaggctgctggcccaggccgagggggagccctgctacatccgggacagtggggtggcccctacagaccctggccctgagtctgctgctgggcccccaacccacgaggtgctggtgacaggcactggtggcatccagtggtggccagtagaggaggaggtgaacaaggaggagggttctagtggcagcagtggcaggaacccccaagccagcctgtttgggaagaaggccaaggctcacaaggcagtcggccagccggcagacaggccgcgggagccactgtgggcctacttctgtgacttccgggacatcacccacgtggtgctgaaagagcactgtgtcagcatccaccggcaggacaacaagtgcctggagctgagcttgccttcccgggctgcggcgctgtccttcgtgtcgctggtggacggctatttccgcctgacggccgactccagccactacctgtgccacgaggtggctcccccacggctggtgatgagcatccgggatgggatccacggacccctgctggagccatttgtgcaggccaagctgcggcccgaggacggcctgtacctcattcactggagcaccagccacccctaccgcctgatcctcacagtggcccagcgtagccaggcaccagacggcatgcagagcttgcggctccgaaagttccccattgagcagcaggacggggccttcgtgctggagggctggggccggtccttccccagcgttcgggaacttggggctgccttgcagggctgcttgctgagggccggggatgactgcttctctctgcgtcgctgttgcctgccccaaccaggagaaacctccaatctcatcatcatgcggggggctcgggccagccccaggacactcaacctcagccagctcagcttccaccgggttgaccagaaggagatcacccagctgtcccacttgggccagggcacaaggaccaacgtgtatgagggccgcctgcgagtggagggcagcggggaccctgaggagggcaagatggatgacgaggaccccctcgtgcctggcagggaccgtgggcaggagctacgagtggtgctcaaagtgctggaccctagtcaccatgacatcgccctggccttctacgagacagccagcctcatgagccaggtctcccacacgcacctggccttcgtgcatggcgtctgtgtgcgcggccctgaaaatatcatggtgacagagtacgtggagcacggacccctggatgtgtggctgcggagggagcggggccatgtgcccatggcttggaagatggtggtggcccagcagctggccagcgccctcagctacctggagaacaagaacctggttcatggtaatgtgtgtggccggaacatcctgctggcccggctggggttggcagagggcaccagccccttcatcaagctgagtgatcctggcgtgggcctgggcgccctctccagggaggagcgggtggagaggatcccctggctggcccccgaatgcctaccaggtggggccaacagcctaagcaccgccatggacaagtgggggtttggcgccaccctcctggagatctgctttgacggagaggcccctctgcagagccgcagtccctccgagaaggagcatttctaccagaggcagcaccggctgcccgagccctcctgcccacagctggccacactcaccagccagtgtctgacctatgagccaacccagaggccatcattccgcaccatcctgcgtgacctcacccggctgcagccccacaatcttgctgacgtcttgactgtgaacccggactcaccggcgtcggaccctacggttttccacaagcgctatttgaaaaagatccgagatctgggcgagggtcacttcggcaaggtcagcttgtactgctacgatccgaccaacgacggcactggcgagatggtggcggtgaaagccctcaaggcagactgcggcccccagcaccgctcgggctggaagcaggagattgacattctgcgcacgctctaccacgagcacatcatcaagtacaagggctgctgcgaggaccaaggcgagaagtcgctgcagctggtcatggagtacgtgcccctgggcagcctccgagactacctgccccggcacagcatcgggctggcccagctgctgctcttcgcccagcagatctgcgagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtatgccccagagtgcctgaaggagtataagttctactatgcgtcagatgtctggtccttcggggtgaccctgtatgagctgctgacgcactgtgactccagccagagcccccccacgaaattccttgagctcataggcattgctcagggtcagatgacagttctgagactcactgagttgctggaacgaggggagaggctgccacggcccgacaaatgtccctgtgaggtctatcatctcatgaagaactgctgggagacagaggcgtcctttcgcccaaccttcgagaacctcatacccattctgaagacagtccatgagaagtaccaaggccaggccccttcagtgttcagcgtgtgctgaggcacaatggcagccctgcctgggaggactggaccaggcagtggctgcagagggagcctcctgctccctgctccaggatgaaaccaagagggggatgtcagcctcacccacaccgtgtgccttactcctgtctagagaccccacctctgtgaacttatttttctttcttggccgtgagcctaaccatgatcttgagggacccaacatttgtaggggcactaatccagcccttaaatcccccagcttccaaacttgaggcccaccatctccaccatctggtaataaactcatgttttctctgaaaaaaaaaaataatantca

SEQ ID NO: 76822 - DNA, 4328 bp, Homo sapiens
acaagcagtagctacccgcgggagcggggaggggtccgggttcgagcttgtgttcccccggaagggtgagtctggacgcgggcgcggaaggagcgcggccggaggtcctcaggaagaagccgcggggactggctgcgcttgacaggctgcacttggatgggagcacctggtgcctcgggactgctccgatgcccgggtctgtgctgaatgtgtaatatgcggaactatattgaaacattacaaccatcttttgatggcaacaccctgaggacctcccttttccagatggggaaactgaggcccagaattgctaagtggcttgcttgagttgacacagggagctccaggactcaccctcagctgagccacctgccgggagcatgcctctgcgccactgggggatggccaggggcagtaagcccgttggggatggagcccagcccatggctgccatgggaggcctgaaggtgcttctgcactgggctggtccaggcggcggggagccctgggtcactttcagtgagtcatcgctgacagctgaggaagtctgcatccacattgcacataaagttggtatcactcctccttgcttcaatctctttgccctcttcgatgctcaggcccaagtctggttgcccccaaaccacatcctagagatccccagagatgcaagcctgatgctatatttccgcataaggttttatttccggaactggcatggcatgaatcctcgggaaccggctgtgtaccgttgtgggcccccaggaaccgaggcatcctcagatcagacagcacaggggatgcaactcctggacccagcctcatttgagtacctctttgagcagggcaagcatgagtttgtgaatgacgtggcatcactgtgggagctgtcgaccgaggaggagatccaccactttaagaatgagagcctgggcatggcctttctgcacctctgtcacctcgctctccgccatggcatccccctggaggaggtggccaagaagaccagcttcaaggactgcatcccgcgctccttccgccggcatatccggcagcacagcgccctgacccggctgcgccttcggaacgtcttccgcaggttcctgcgggacttccagccgggccgactctcccagcagatggtcatggtcaaatacctagccacactcgagcggctggcaccccgcttcggcacagagcgtgtgcccgtgtgccacctgaggctgctggcccaggccgagggggagccctgctacatccgggacagtggggtggcccctacagaccctggccctgagtctgctgctgggcccccaacccacgaggtgctggtgacaggcactggtggcatccagtggtggccagtagaggaggaggtgaacaaggaggagggttctagtggcagcagtggcaggaacccccaagccagcctgtttgggaagaaggccaaggctcacaaggcagtcggccagccggcagacaggccgcgggagccactgtgggcctacttctgtgacttccgggacatcacccacgtggtgctgaaagagcactgtgtcagcatccaccggcaggacaacaagtgcctggagctgagcttgccttcccgggctgcggcgctgtccttcgtgtcgctggtggacggctatttccgcctgacggccgactccagccactacctgtgccacgaggtggctcccccacggctggtgatgagcatccgggatgggatccacggacccctgctggagccatttgtgcaggccaagctgcggcccgaggacggcctgtacctcattcactggagcaccagccacccctaccgcctgatcctcacagtggcccagcgtagccaggcaccagacggcatgcagagcttgcggctccgaaagttccccattgagcagcaggacggggccttcgtgctggagggctggggccggtccttccccagcgttcgggaacttggggctgccttgcagggctgcttgctgagggccggggatgactgcttctctctgcgtcgctgttgcctgccccaaccaggagaaacctccaatctcatcatcatgcggggggctcgggccagccccaggacactcaacctcagccagctcagcttccaccgggttgaccagaaggagatcacccagctgtcccacttgggccagggcacaaggaccaacgtgtatgagggccgcctgcgagtggagggcagcggggaccctgaggagggcaagatggatgacgaggaccccctcgtgcctggcagggaccgtgggcaggagctacgagtggtgctcaaagtgctggaccctagtcaccatgacatcgccctggccttctacgagacagccagcctcatgagccaggtctcccacacgcacctggccttcgtgcatggcgtctgtgtgcgcggccctgaaaatatcatggtgacagagtacgtggagcacggacccctggatgtgtggctgcggagggagcggggccatgtgcccatggcttggaagatggtggtggcccagcagctggccagcgccctcagctacctggagaacaagaacctggttcatggtaatgtgtgtggccggaacatcctgctggcccggctggggttggcagagggcaccagccccttcatcaagctgagtgatcctggcgtgggcctgggcgccctctccagggaggagcgggtggagaggatcccctggctggcccccgaatgcctaccaggtggggccaacagcctaagcaccgccatggacaagtgggggtttggcgccaccctcctggagatctgctttgacggagaggcccctctgcagagccgcagtccctccgagaaggagcatttctaccagaggcagcaccggctgcccgagccctcctgcccacagctggccacactcaccagccagtgtctgacctatgagccaacccagaggccatcattccgcaccatcctgcgtgacctcacccggctgcagccccacaatcttgctgacgtcttgactgtgaacccggactcaccggcgtcggaccctacggttttccacaagcgctatttgaaaaagatccgagatctgggcgagggtcacttcggcaaggtcagcttgtactgctacgatccgaccaacgacggcactggcgagatggtggcggtgaaagccctcaaggcagactgcggcccccagcaccgctcgggctggaagcaggagattgacattctgcgcacgctctaccacgagcacatcatcaagtacaagggctgctgcgaggaccaaggcgagaagtcgctgcagctggtcatggagtacgtgcccctgggcagcctccgagactacctgccccggcacagcatcgggctggcccagctgctgctcttcgcccagcagatctgcgagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtatgccccagagtgcctgaaggagtataagttctactatgcgtcagatgtctggtccttcggggtgaccctgtatgagctgctgacgcactgtgactccagccagagcccccccacgaaattccttgagctcataggcattgctcagggtcagatgacagttctgagactcactgagttgctggaacgaggggagaggctgccacggcccgacaaatgtccctgtgaggtgagacttcctttgtctttccctgaccccactatcctgctgtggagagggcagcccccaccagccctggtttttccttctaggtctatcatctcatgaagaactgctgggagacagaggcgtcctttcgcccaaccttcgagaacctcatacccattctgaagacagtccatgagaagtaccaaggccaggccccttcagtgttcagcgtgtgctgaggcacaatggcagccctgcctgggaggactggaccaggcagtggctgcagagggagcctcctgctccctgctccaggatgaaaccaagagggggatgtcagcctcacccacaccgtgtgccttactcctgtctagagaccccacctctgtgaacttatttttctttcttggccgtgagcctaaccatgatcttgagggacccaacatttgtaggggcactaatccagcccttaaatcccccagcttccaaacttgaggcccaccatctccaccatctggtaataaactcatgttttctctg

SEQ ID NO: 76823 - DNA, 1456 bp, Homo sapiens
aacccttcacctttaccctcaccctaatccgcgggagattgacattctgcgcacgctctaccacgagcacatcatcaagtacaagggctgctgcgaggaccaaggtgggcgggacccggcgagtcctagagacttgagggggcgtggttagagcgtgggtgtggccttgtgggcggggccagtctggcctagccaattagagactctcaaccccaggctgcagtacgcggttcttggcatctgggtgagcgtggctgggctgcctccttcccatctggggggtgctacctgctggggccaggatggacgggagccaccagcagctccctcaagtgagaatggggttctggatgggtccatcccacctgagaactgggtctagtgtgcgcgggtcttggccttccctcccgaccttggaggggctctgctgggctcaaggtaggcggtccccggcccgccctctatcgtcccccaccggggccgcccctctccgcggcaggcgagaagtcgctgcagctggtcatggagtacgtgcccctgggcagcctccgagactacctgccccggcacagcatcgggctggcccagctgctgctcttcgcccagcagatctgcgagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtatgccccagagtgcctgaaggagtataagttctactatgcgtcagatgtctggtccttcggggtgaccctgtatgagctgctgacgcactgtgactccagccagagcccccccacgaaattccttgagctcataggcattgctcagggtcagatgacagttctgagactcactgagttgctggaacgaggggagaggctgccacggcccgacaaatgtccctgtgaggtctatcatctcatgaagaactgctgggagacagaggcgtcctttcgcccaaccttcgagaacctcatacccattctgaagacagtccatgagaagtaccaaggccaggccccttcagtgttcagcgtgtgctgaggcacaatggcagccctgcctgggaggactggaccaggcagtggctgcagagggagcctcctgctccctgctccaggatgaaaccaagagggggatgtcagcctcacccacaccgtgtgccttactcctgtctagagaccccacctctgtgaacttatttttctttcttggccgtgagcctaaccatgatcttgagggacccaacatttgtaggggcactaatccagcccttaaatcccccagcttccaaacttgaggcccaccatctccaccatctggtaataaactcatgttttctctg

SEQ ID NO: 76824 - DNA, 4073 bp, Homo sapiens
acaagcagtagctacccgcgggagcggggaggggtccgggttcgagcttgtgttcccccggaagggtgagtctggacgcgggcgcggaaggagcgcggccggaggtcctcaggaagaagccgcggggactggctgcgcttgacaggctgcacttggatgggagcacctggtgcctcgggactgctccgatgcccgggtctgtgctgaatgtgtaatatgcggaactatattgaaacattacaaccatcttttgatggcaacaccctgaggacctcccttttccagatggggaaactgaggcccagaattgctaagtggcttgcttgagttgacacagggagctccaggactcaccctcagctgagccacctgccgggagcatgcctctgcgccactgggggatggccaggggcagtaagcccgttggggatggagcccagcccatggctgccatgggaggcctgaaggtgcttctgcactgggctggtccaggcggcggggagccctgggtcactttcagtgagtcatcgctgacagctgaggaagtctgcatccacattgcacataaagttggtatcactcctccttgcttcaatctctttgccctcttcgatgctcaggcccaagtctggttgcccccaaaccacatcctagagatccccagagatgcaagcctgatgctatatttccgcataaggttttatttccggaactggcatggcatgaatcctcgggaaccggctgtgtaccgttgtgggcccccaggaaccgaggcatcctcagatcagacagcacaggggatgcaactcctggacccagcctcatttgagtacctctttgagcagggcaagcatgagtttgtgaatgacgtggcatcactgtgggagctgtcgaccgaggaggagatccaccactttaagaatgagagcctgggcatggcctttctgcacctctgtcacctcgctctccgccatggcatccccctggaggaggtggccaagaagaccagcttcaaggactgcatcccgcgctccttccgccggcatatccggcagcacagcgccctgacccggctgcgccttcggaacgtcttccgcaggttcctgcgggacttccagccgggccgactctcccagcagatggtcatggtcaaatacctagccacactcgagcggctggcaccccgcttcggcacagagcgtgtgcccgtgtgccacctgaggctgctggcccaggccgagggggagccctgctacatccgggacagtggggtggcccctacagaccctggccctgagtctgctgctgggcccccaacccacgaggtgctggtgacaggcactggtggcatccagtggtggccagtagaggaggaggtgaacaaggaggagggttctagtggcagcagtggcaggaacccccaagccagcctgtttgggaagaaggccaaggctcacaaggcagtcggccagccggcagacaggccgcgggagccactgtgggcctacttctgtgacttccgggacatcacccacgtggtgctgaaagagcactgtgtcagcatccaccggcaggacaacaagtgcctggagctgagcttgccttcccgggctgcggcgctgtccttcgtgtcgctggtggacggctatttccgcctgacggccgactccagccactacctgtgccacgaggtggctcccccacggctggtgatgagcatccgggatgggatccacggacccctgctggagccatttgtgcaggccaagctgcggcccgaggacggcctgtacctcattcactggagcaccagccacccctaccgcctgatcctcacagtggcccagcgtagccaggcaccagacggcatgcagagcttgcggctccgaaagttccccattgagcagcaggacggggccttcgtgctggagggctggggccggtccttccccagcgttcgggaacttggggctgccttgcagggctgcttgctgagggccggggatgactgcttctctctgcgtcgctgttgcctgccccaaccaggagaaacctccaatctcatcatcatgcggggggctcgggccagccccaggacactcaacctcagccagctcagcttccaccgggttgaccagaaggagatcacccagctgtcccacttgggccagggcacaaggaccaacgtgtatgagggccgcctgcgagtggagggcagcggggaccctgaggagggcaagatggatgacgaggaccccctcgtgcctggcagggaccgtgggcaggagctacgagtggtgctcaaagtgctggaccctagtcaccatgacatcgccctggccttctacgagacagccagcctcatgagccaggtctcccacacgcacctggccttcgtgcatggcgtctgtgtgcgcggccctgaaaatatcatggtgacagagtacgtggagcacggacccctggatgtgtggctgcggagggagcggggccatgtgcccatggcttggaagatggtggtggcccagcagctggccagcgccctcagctacctggagaacaagaacctggttcatggtaatgtgtgtggccggaacatcctgctggcccggctggggttggcagagggcaccagccccttcatcaagctgagtgatcctggcgtgggcctgggcgccctctccagggaggagcgggtggagaggatcccctggctggcccccgaatgcctaccaggtggggccaacagcctaagcaccgccatggacaagtgggggtttggcgccaccctcctggagatctgctttgacggagaggcccctctgcagagccgcagtccctccgagaaggagcatttctaccagaggcagcaccggctgcccgagccctcctgcccacagctggccacactcaccagccagtgtctgacctatgagccaacccagaggccatcattccgcaccatcctgcgtgacctcacccggctgcagccccacaatcttgctgacgtcttgactgtgaacccggactcaccggcgtcggaccctacggttttccacaagcgctatttgaaaaagatccgagatctgggcgagggtcacttcggcaaggtcagcttgtactgctacgatccgaccaacgacggcactggcgagatggtggcggtgaaagccctcaaggcagactgcggcccccagcaccgctcgggctggaagcaggagattgacattctgcgcacgctctaccacgagcacatcatcaagtacaagggctgctgcgaggaccaaggcgagaagtcgctgcagctggtcatggagtacgtgcccctgggcagcctccgagactacctgccccggcacagcatcgggctggcccagctgctgctcttcgcccagcagatctgcgagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtatgccccagagtgcctgaaggagtataagttctactatgcgtcagatgtctggtccttcggggtgaccctgtatgagctgctgacgcactgtgactccagccagagcccccccacggtgagagccaggcccgcagccccaccgggagtttgctagagcaattagaaaggcataggctgggccaggcgcggtggctcaagcctgtaatcccagcactttgggaggccgaggcgggcggatcacgaggtcaggagatcgagaccaacctggctaacacggtgaaacccgtctctactaaaaatacaaaaaaaattagccaggcgtggtggcgggcgcctgtagtcccagctactcaggagactgaggcaggagaatggcatgaacccgggaggcggagcttgcagtgagccgagatctcccgactgcactccagctgggtgacagagcgagactccgtctaagacaggacaggacggagagagagagaaagaa

SEQ ID NO: 76825 - DNA, 3500 bp, Homo sapiens
acaagcagtagctacccgcgggagcggggaggggtccgggttcgagcttgtgttcccccggaagggtgagtctggacgcgggcgcggaaggagcgcggccggaggtcctcaggaagaagccgcggggactggctgcgcttgacaggctgcacttggatgggagcacctggtgcctcgggactgctccgatgcccgggtctgtgctgaatgtgtaatatgcggaactatattgaaacattacaaccatcttttgatggcaacaccctgaggacctcccttttccagatggggaaactgaggcccagaattgctaagtggcttgcttgagttgacacagggagctccaggactcaccctcagctgagccacctgccgggagcatgcctctgcgccactgggggatggccaggggcagtaagcccgttggggatggagcccagcccatggctgccatgggaggcctgaaggtgcttctgcactgggctggtccaggcggcggggagccctgggtcactttcagtgagtcatcgctgacagctgaggaagtctgcatccacattgcacataaagttggtatcactcctccttgcttcaatctctttgccctcttcgatgctcaggcccaagtctggttgcccccaaaccacatcctagagatccccagagatgcaagcctgatgctatatttccgcataaggttttatttccggaactggcatggcatgaatcctcgggaaccggctgtgtaccgttgtgggcccccaggaaccgaggcatcctcagatcagacagcacaggggatgcaactcctggacccagcctcatttgagtacctctttgagcagggcaagcatgagtttgtgaatgacgtggcatcactgtgggagctgtcgaccgaggaggagatccaccactttaagaatgagagcctgggcatggcctttctgcacctctgtcacctcgctctccgccatggcatccccctggaggaggtggccaagaagaccagcttcaaggactgcatcccgcgctccttccgccggcatatccggcagcacagcgccctgacccggctgcgccttcggaacgtcttccgcaggttcctgcgggacttccagccgggccgactctcccagcagatggtcatggtcaaatacctagccacactcgagcggctggcaccccgcttcggcacagagcgtgtgcccgtgtgccacctgaggctgctggcccaggccgagggggagccctgctacatccgggacagtggggtggcccctacagaccctggccctgagtctgctgctgggcccccaacccacgaggtgctggtgacaggcactggtggcatccagtggtggccagtagaggaggaggtgaacaaggaggagggttctagtggcagcagtggcaggaacccccaagccagcctgtttgggaagaaggccaaggctcacaaggcagtcggccagccggcagacaggccgcgggagccactgtgggcctacttctgtgacttccgggacatcacccacgtggtgctgaaagagcactgtgtcagcatccaccggcaggacaacaagtgcctggagctgagcttgccttcccgggctgcggcgctgtccttcgtgtcgctggtggacggctatttccgcctgacggccgactccagccactacctgtgccacgaggtggctcccccacggctggtgatgagcatccgggatgggatccacggacccctgctggagccatttgtgcaggccaagctgcggcccgaggacggcctgtacctcattcactggagcaccagccacccctaccgcctgatcctcacagtggcccagcgtagccaggcaccagacggcatgcagagcttgcggctccgaaagttccccattgagcagcaggacggggccttcgtgctggagggctggggccggtccttccccagcgttcgggaacttggggctgccttgcagggctgcttgctgagggccggggatgactgcttctctctgcgtcgctgttgcctgccccaaccaggagaaacctccaatctcatcatcatgcggggggctcgggccagccccaggacactcaacctcagccagctcagcttccaccgggttgaccagaaggagatcacccagctgtcccacttgggccagggcacaaggaccaacgtgtatgagggccgcctgcgagtggagggcagcggggaccctgaggagggcaagatggatgacgaggaccccctcgtgcctggcagggaccgtgggcaggagctacgagtggtgctcaaagtgctggaccctagtcaccatgacatcgccctggccttctacgagacagccagcctcatgagccaggtctcccacacgcacctggccttcgtgcatggcgtctgtgtgcgcggccctgaaaatatcatggtgacagagtacgtggagcacggacccctggatgtgtggctgcggagggagcggggccatgtgcccatggcttggaagatggtggtggcccagcagctggccagcgccctcagctacctggagaacaagaacctggttcatggtaatgtgtgtggccggaacatcctgctggcccggctggggttggcagagggcaccagccccttcatcaagctgagtgatcctggcgtgggcctgggcgccctctccagggaggagcgggtggagaggatcccctggctggcccccgaatgcctaccaggtggggccaacagcctaagcaccgccatggacaagtgggggtttggcgccaccctcctggagatctgctttgacggagaggcccctctgcagagccgcagtccctccgagaaggagcatttctaccagaggcagcaccggctgcccgagccctcctgcccacagctggccacactcaccagccagtgtctgacctatgagccaacccagaggccatcattccgcaccatcctgcgtgacctcacccggctgcagccccacaatcttgctgacgtcttgactgtgaacccggactcaccggcgtcggaccctacggttttccacaagcgctatttgaaaaagatccgagatctgggcgagggtcacttcggcaaggtcagcttgtactgctacgatccgaccaacgacggcactggcgagatggtggcggtgaaagccctcaaggcagactgcggcccccagcaccgctcgggctggaagcaggagattgacattctgcgcacgctctaccacgagcacatcatcaagtacaagggctgctgcgaggaccaaggcgagaagtcgctgcagctggtcatggagtacgtgcccctgggcagcctccgagactacctgccccggcacagctggcagtagccctcctctctggctgccccactggccacatctctggcctgctagattaaagctgtaaagtcaccctagccatcattctactatcaacattactaataagtggctcctttaacctctccacccttatca

SEQ ID NO: 76826 - DNA, 4525 bp, Homo sapiens
acaagcagtagctacccgcgggagcggggaggggtccgggttcgagcttgtgttcccccggaagggtgagtctggacgcgggcgcggaaggagcgcggccggaggtcctcaggaagaagccgcggggactggctgcgcttgacaggctgcacttggatgggagcacctggtgcctcgggactgctccgatgcccgggtctgtgctgaatgtgtaatatgcggaactatattgaaacattacaaccatcttttgatggcaacaccctgaggacctcccttttccagatggggaaactgaggcccagaattgctaagtggcttgcttgagttgacacagggagctccaggactcaccctcagctgagccacctgccgggagcatgcctctgcgccactgggggatggccaggggcagtaagcccgttggggatggagcccagcccatggctgccatgggaggcctgaaggtgcttctgcactgggctggtccaggcggcggggagccctgggtcactttcagtgagtcatcgctgacagctgaggaagtctgcatccacattgcacataaagttggtatcactcctccttgcttcaatctctttgccctcttcgatgctcaggcccaagtctggttgcccccaaaccacatcctagagatccccagagatgcaagcctgatgctatatttccgcataaggttttatttccggaactggcatggcatgaatcctcgggaaccggctgtgtaccgttgtgggcccccaggaaccgaggcatcctcagatcagacagcacaggggatgcaactcctggacccagcctcatttgagtacctctttgagcagggcaagcatgagtttgtgaatgacgtggcatcactgtgggagctgtcgaccgaggaggagatccaccactttaagaatgagagcctgggcatggcctttctgcacctctgtcacctcgctctccgccatggcatccccctggaggaggtggccaagaagaccagcttcaaggactgcatcccgcgctccttccgccggcatatccggcagcacagcgccctgacccggctgcgccttcggaacgtcttccgcaggttcctgcgggacttccagccgggccgactctcccagcagatggtcatggtcaaatacctagccacactcgagcggctggcaccccgcttcggcacagagcgtgtgcccgtgtgccacctgaggctgctggcccaggccgagggggagccctgctacatccgggacagtggggtggcccctacagaccctggccctgagtctgctgctgggcccccaacccacgaggtgctggtgacaggcactggtggcatccagtggtggccagtagaggaggaggtgaacaaggaggagggttctagtggcagcagtggcaggaacccccaagccagcctgtttgggaagaaggccaaggctcacaaggcagtcggccagccggcagacaggccgcgggagccactgtgggcctacttctgtgacttccgggacatcacccacgtggtgctgaaagagcactgtgtcagcatccaccggcaggacaacaagtgcctggagctgagcttgccttcccgggctgcggcgctgtccttcgtgtcgctggtggacggctatttccgcctgacggccgactccagccactacctgtgccacgaggtggctcccccacggctggtgatgagcatccgggatgggatccacggacccctgctggagccatttgtgcaggccaagctgcggcccgaggacggcctgtacctcattcactggagcaccagccacccctaccgcctgatcctcacagtggcccagcgtagccaggcaccagacggcatgcagagcttgcggctccgaaagttccccattgagcagcaggacggggccttcgtgctggagggctggggccggtccttccccagcgttcgggaacttggggctgccttgcagggctgcttgctgagggccggggatgactgcttctctctgcgtcgctgttgcctgccccaaccaggagaaacctccaatctcatcatcatgcggggggctcgggccagccccaggacactcaacctcagccagctcagcttccaccgggttgaccagaaggagatcacccagctgtcccacttgggccagggcacaaggaccaacgtgtatgagggccgcctgcgagtggagggcagcggggaccctgaggagggcaagatggatgacgaggaccccctcgtgcctggcagggaccgtgggcaggagctacgagtggtgctcaaagtgctggaccctagtcaccatgacatcgccctggccttctacgagacagccagcctcatgagccaggtctcccacacgcacctggccttcgtgcatggcgtctgtgtgcgcggccctgaaaatatcatggtgacagagtacgtggagcacggacccctggatgtgtggctgcggagggagcggggccatgtgcccatggcttggaagatggtggtggcccagcagctggccagcgccctcagctacctggagaacaagaacctggttcatggtaatgtgtgtggccggaacatcctgctggcccggctggggttggcagagggcaccagccccttcatcaagctgagtgatcctggcgtgggcctgggcgccctctccagggaggagcgggtggagaggatcccctggctggcccccgaatgcctaccaggtggggccaacagcctaagcaccgccatggacaagtgggggtttggcgccaccctcctggagatctgctttgacggagaggcccctctgcagagccgcagtccctccgagaaggagcatttctaccagaggcagcaccggctgcccgagccctcctgcccacagctggccacactcaccagccagtgtctgacctatgagccaacccagaggccatcattccgcaccatcctgcgtgacctcacccggctgcagccccacaatcttgctgacgtcttgactgtgaacccggactcaccggcgtcggaccctacggttttccacaagcgctatttgaaaaagatccgagatctgggcgagggtcacttcggcaaggtcagcttgtactgctacgatccgaccaacgacggcactggcgagatggtggcggtgaaagccctcaaggcagactgcggcccccagcaccgctcgggctggaagcaggagattgacattctgcgcacgctctaccacgagcacatcatcaagtacaagggctgctgcgaggaccaaggcgagaagtcgctgcagctggtcatggagtacgtgcccctgggcagcctccgagactacctgccccggcacagcatcgggctggcccagctgctgctcttcgcccagcagatctgcgagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtatgccccagagtgcctgaaggagtataagttctactatgcgtcagatgtctggtccttcggggtgaccctgtatgagctgctgacgcactgtgactccagccagagcccccccacgaaattccttgagctcataggcattgctcagggtcagatgacagttctgagactcactgagttgctggaacgaggggagaggctgccacggcccgacaaatgtccctgtgaggtctatcatctcatgaagaactgctgggagacagaggcgtcctttcgcccaaccttcgagaacctcatacccattctgaagacagtccatgagaagtaccaaggccaggccccttcagtgttcagcgtgtgctgaggcacaatggcagccctgcctgggaggactggaccaggcagtggctgcagagggagcctcctgctccctgctccaggatgaaaccaagagggggatgtcagcctcacccacaccgtgtgccttactcctgtctagagaccccacctctgtgaacttatttttctttcttggccgtgagcctaaccatgatcttgagggacccaacatttgtaggggcactaatccagcccttaaatcccccagcttccaaacttgaggcccaccatctccaccatctggtaataaactcatgttttctctgaaaacacaacccccccccccacacccacacaaccacactcttcgccagcgcacaaggccaccgacaacgctcttccaaaccccttccccgggccccgcggcccaccggcacacaacacgtgcacaagaccggcccccagaaaaccggcgacacaccacaaggccaggaaccccagcaaacacacactgcccggcgacacaacacgccacacacacccacaaggacaccccacggccaccggggatataaaacgggtccacgagaccgaataatagccggt

SEQ ID NO: 76827 - DNA, 5443 bp, Homo sapiens
acaagcagtagctacccgcgggagcggggaggggtccgggttcgagcttgtgttcccccggaagggtgagtctggacgcgggcgcggaaggagcgcggccggaggtcctcaggaagaagccgcggggactggctgcgcttgacaggctgcacttggatgggagcacctggtgcctcgggactgctccgatgcccgggtctgtgctgaatgtgtaatatgcggaactatattgaaacattacaaccatcttttgatggcaacaccctgaggacctcccttttccagatggggaaactgaggcccagaattgctaagtggcttgcttgagttgacacagggagctccaggactcaccctcagctgagccacctgccgggagcatgcctctgcgccactgggggatggccaggggcagtaagcccgttggggatggagcccagcccatggctgccatgggaggcctgaaggtgcttctgcactgggctggtccaggcggcggggagccctgggtcactttcagtgagtcatcgctgacagctgaggaagtctgcatccacattgcacataaagttggtatcactcctccttgcttcaatctctttgccctcttcgatgctcaggcccaagtctggttgcccccaaaccacatcctagagatccccagagatgcaagcctgatgctatatttccgcataaggttttatttccggaactggcatggcatgaatcctcgggaaccggctgtgtaccgttgtgggcccccaggaaccgaggcatcctcagatcagacagcacaggggatgcaactcctggacccagcctcatttgagtacctctttgagcagggcaagcatgagtttgtgaatgacgtggcatcactgtgggagctgtcgaccgaggaggagatccaccactttaagaatgagagcctgggcatggcctttctgcacctctgtcacctcgctctccgccatggcatccccctggaggaggtggccaagaagaccagcttcaaggactgcatcccgcgctccttccgccggcatatccggcagcacagcgccctgacccggctgcgccttcggaacgtcttccgcaggttcctgcgggacttccagccgggccgactctcccagcagatggtcatggtcaaatacctagccacactcgagcggctggcaccccgcttcggcacagagcgtgtgcccgtgtgccacctgaggctgctggcccaggccgagggggagccctgctacatccgggacagtggggtggcccctacagaccctggccctgagtctgctgctgggcccccaacccacgaggtgctggtgacaggcactggtggcatccagtggtggccagtagaggaggaggtgaacaaggaggagggttctagtggcagcagtggcaggaacccccaagccagcctgtttgggaagaaggccaaggctcacaaggcagtcggccagccggcagacaggccgcgggagccactgtgggcctacttctgtgacttccgggacatcacccacgtggtgctgaaagagcactgtgtcagcatccaccggcaggacaacaagtgcctggagctgagcttgccttcccgggctgcggcgctgtccttcgtgtcgctggtggacggctatttccgcctgacggccgactccagccactacctgtgccacgaggtggctcccccacggctggtgatgagcatccgggatgggatccacggacccctgctggagccatttgtgcaggccaagctgcggcccgaggacggcctgtacctcattcactggagcaccagccacccctaccgcctgatcctcacagtggcccagcgtagccaggcaccagacggcatgcagagcttgcggctccgaaagttccccattgagcagcaggacggggccttcgtgctggagggctggggccggtccttccccagcgttcgggaacttggggctgccttgcagggctgcttgctgagggccggggatgactgcttctctctgcgtcgctgttgcctgccccaaccaggagaaacctccaatctcatcatcatgcggggggctcgggccagccccaggacactcaacctcagccagctcagcttccaccgggttgaccagaaggagatcacccagctgtcccacttgggccagggcacaaggaccaacgtgtatgagggccgcctgcgagtggagggcagcggggaccctgaggagggcaagatggatgacgaggaccccctcgtgcctggcagggaccgtgggcaggagctacgagtggtgctcaaagtgctggaccctagtcaccatgacatcgccctggccttctacgagacagccagcctcatgagccaggtctcccacacgcacctggccttcgtgcatggcgtctgtgtgcgcggccctgaaaatatcatggtgacagagtacgtggagcacggacccctggatgtgtggctgcggagggagcggggccatgtgcccatggcttggaagatggtggtggcccagcagctggccagcgccctcagctacctggagaacaagaacctggttcatggtaatgtgtgtggccggaacatcctgctggcccggctggggttggcagagggcaccagccccttcatcaagctgagtgatcctggcgtgggcctgggcgccctctccagggaggagcgggtggagaggatcccctggctggcccccgaatgcctaccaggtggggccaacagcctaagcaccgccatggacaagtgggggtttggcgccaccctcctggagatctgctttgacggagaggcccctctgcagagccgcagtccctccgagaaggagcatttctaccagaggcagcaccggctgcccgagccctcctgcccacagctggccacactcaccagccagtgtctgacctatgagccaacccagaggccatcattccgcaccatcctgcgtgacctcacccggctgcagccccacaatcttgctgacgtcttgactgtgaacccggactcaccggcgtcggaccctacggttttccacaagcgctatttgaaaaagatccgagatctgggcgagggtcacttcggcaaggtcagcttgtactgctacgatccgaccaacgacggcactggcgagatggtggcggtgaaagccctcaaggcagactgcggcccccagcaccgctcgggctggaagcaggagattgacattctgcgcacgctctaccacgagcacatcatcaagtacaagggctgctgcgaggaccaaggtgggcgggacccggcgagtcctagagacttgagggggcgtggttagagcgtgggtgtggccttgtgggcggggccagtctggcctagccaattagagactctcaaccccaggctgcagtacgcggttcttggcatctgggtgagcgtggctgggctgcctccttcccatctggggggtgctacctgctggggccaggatggacgggagccaccagcagctccctcaagtgagaatggggttctggatgggtccatcccacctgagaactgggtctagtgtgcgcgggtcttggccttccctcccgaccttggaggggctctgctgggctcaaggtaggcggtccccggcccgccctctatcgtcccccaccggggccgcccctctccgcggcaggcgagaagtcgctgcagctggtcatggagtacgtgcccctgggcagcctccgagactacctgccccggcacagcatcgggctggcccagctgctgctcttcgcccagcagatctgcgaggttggtcggccccgcccctgcttctggagcttgccccttcctcttcagcttgggctggcctgagcgatccggtgcagtctgctctcacgctccgcccctgctcgtttgcccaggctgtcttgtccttgcactgacctccgaactgtttggcttgcttggccacaccccctcctcccaagggaccacgcacagccggctcggcccctcccaactcgccctcctgcccagctttgctcgtctagccccgtccctgctttctggctcagcctccttttgcttggtgccacgtgccatccggccctctccagcggccgggtagccaccggcctgacctgactgtcccccagccctcctggctgctcaggtcctgccgccgcccccggccgaaccccgccccactgaaactcacgagccctgccccgtccccagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtgaccaggcggggtgcagtctgagggggtgctggggtcacttggaacaggcagggtggagtagacggatgctgggtatcatgatagggcatgatcccagtgaagcgcggcggggcctagcggtgcgggggtggggcctatggaggcaaggggcggtgtatagagtgcggcttggcctggtgggcggggttaacccggcctagccaatgagcggcctagccaatgagcatatcaccccgctcaggctgcgctcttaagggtgggtcccaactgagcccagagggtccttcagtctcaggtgagggcttcagcctggtctgatccccaagccctcagtgcagccccccgtggcctgagtgcccccctccccctaggtatgccccagagtgcctgaaggagtataagttctactatgcgtcagatgtctggtccttcggggtgaccctgtatgagctgctgacgcactgtgactccagccagagcccccccacgaaattccttgagctcataggcattgctcagggtcagatgacagttctgagactcactgagttgctggaacgaggggagaggctgccacggcccgacaaatgtccctgtgaggtctatcatctcatgaagaactgctgggagacagaggcgtcctttcgcccaaccttcgagaacctcatacccattctgaagacagtccatgagaagtaccaaggccaggccccttcagtgttcagcgtgtgctgaggcacaatggcagccctgcctgggaggactggaccaggcagtggctgcagagggagcctcctgctccctgctccaggatgaaaccaagagggggatgtcagcctcacccacaccgtgtgccttactcctgtctagagaccccacctctgtgaacttatttttctttcttggccgtgagcctaaccatgatcttgagggacccaacatttgtaggggcactaatccagcccttaaatcccccagcttccaaacttgaggcccaccatctccaccatctggtaataaactcatgttttctctg

SEQ ID NO: 76828 - DNA, 1837 bp, Homo sapiens
cctcggcctcccaggtgctgggattacaggcatgagccacagtgccggccccagaagaggttttatctaagtgtagaattatgccaacaagcctggctaggaagggcagcctaggcagagtgcatggcctgtgcaaaggctgaggcttcagtgtattaaggagctgtggtctacaggaggggcaggagggaagcttggggcaggaggctgactgtgacactccagctctgcataatcactggacctgggtcccagtcctggttctacggctgtgagcacgtcctcccactttgtggagcctcagttgcctcatctgtataatggaactgataagagcgggcacctggcggtccactctggggacttgactctgcctcttggggaacgggttgggggcgaggggaggatgttgactcctctgggtccctttcccaacagaaggagcatttctaccagaggcagcaccggctgcccgagccctcctgcccacagctggccacactcaccagccagtgtctgacctatgagccaacccagaggccatcattccgcaccatcctgcgtgacctcacccggctgcagccccacaatcttgctgacgtcttgactgtgaacccggactcaccggcgtcggaccctacggttttccacaagcgctatttgaaaaagatccgagatctgggcgagggtcacttcggcaaggtcagcttgtactgctacgatccgaccaacgacggcactggcgagatggtggcggtgaaagccctcaaggcagactgcggcccccagcaccgctcgggctggaagcaggagattgacattctgcgcacgctctaccacgagcacatcatcaagtacaagggctgctgcgaggaccaaggcgagaagtcgctgcagctggtcatggagtacgtgcccctgggcagcctccgagactacctgccccggcacagcatcgggctggcccagctgctgctcttcgcccagcagatctgcgagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtatgccccagagtgcctgaaggagtataagttctactatgcgtcagatgtctggtccttcggggtgaccctgtatgagctgctgacgcactgtgactccagccagagcccccccacgaaattccttgagctcataggcattgctcagggtcagatgacagttctgagactcactgagttgctggaacgaggggagaggctgccacggcccgacaaatgtccctgtgaggtctatcatctcatgaagaactgctgggagacagaggcgtcctttcgcccaaccttcgagaacctcatacccattctgaagacagtccatgagaagtaccaaggccaggccccttcagtgttcagcgtgtgctgaggcacaatggcagccctgcctgggaggactggaccaggcagtggctgcagagggagcctcctgctccctgctccaggatgaaaccaagagggggatgtcagcctcacccacaccgtgtgccttactcctgtctagagaccccacctctgtgaacttatttttctttcttggccgtgagcctaaccatgatcttgagggacccaacatttgtaggggcactaatccagcccttaaatcccccagcttccaaacttgaggcccaccatctccaccatctggtaataaactcatgttttctctg

SEQ ID NO: 76829 - DNA, 4134 bp, Homo sapiens
acaagcagtagctacccgcgggagcggggaggggtccgggttcgagcttgtgttcccccggaagggtgagtctggacgcgggcgcggaaggagcgcggccggaggtcctcaggaagaagccgcggggactggctgcgcttgacaggctgcacttggatgggagcacctggtgcctcgggactgctccgatgcccgggtctgtgctgaatgtgtaatatgcggaactatattgaaacattacaaccatcttttgatggcaacaccctgaggacctcccttttccagatggggaaactgaggcccagaattgctaagtggcttgcttgagttgacacagggagctccaggactcaccctcagctgagccacctgccgggagcatgcctctgcgccactgggggatggccaggggcagtaagcccgttggggatggagcccagcccatggctgccatgggaggcctgaaggtgcttctgcactgggctggtccaggcggcggggagccctgggtcactttcagtgagtcatcgctgacagctgaggaagtctgcatccacattgcacataaagttggtatcactcctccttgcttcaatctctttgccctcttcgatgctcaggcccaagtctggttgcccccaaaccacatcctagagatccccagagatgcaagcctgatgctatatttccgcataaggttttatttccggaactggcatggcatgaatcctcgggaaccggctgtgtaccgttgtgggcccccaggaaccgaggcatcctcagatcagacagcacaggggatgcaactcctggacccagcctcatttgagtacctctttgagcagggcaagcatgagtttgtgaatgacgtggcatcactgtgggagctgtcgaccgaggaggagatccaccactttaagaatgagagcctgggcatggcctttctgcacctctgtcacctcgctctccgccatggcatccccctggaggaggtggccaagaagaccagcttcaaggactgcatcccgcgctccttccgccggcatatccggcagcacagcgccctgacccggctgcgccttcggaacgtcttccgcaggttcctgcgggacttccagccgggccgactctcccagcagatggtcatggtcaaatacctagccacactcgagcggctggcaccccgcttcggcacagagcgtgtgcccgtgtgccacctgaggctgctggcccaggccgagggggagccctgctacatccgggacagtggggtggcccctacagaccctggccctgagtctgctgctgggcccccaacccacgaggtgctggtgacaggcactggtggcatccagtggtggccagtagaggaggaggtgaacaaggaggagggttctagtggcagcagtggcaggaacccccaagccagcctgtttgggaagaaggccaaggctcacaaggcagtcggccagccggcagacaggccgcgggagccactgtgggcctacttctgtgacttccgggacatcacccacgtggtgctgaaagagcactgtgtcagcatccaccggcaggacaacaagtgcctggagctgagcttgccttcccgggctgcggcgctgtccttcgtgtcgctggtggacggctatttccgcctgacggccgactccagccactacctgtgccacgaggtggctcccccacggctggtgatgagcatccgggatgggatccacggacccctgctggagccatttgtgcaggccaagctgcggcccgaggacggcctgtacctcattcactggagcaccagccacccctaccgcctgatcctcacagtggcccagcgtagccaggcaccagacggcatgcagagcttgcggctccgaaagttccccattgagcagcaggacggggccttcgtgctggagggctggggccggtccttccccagcgttcgggaacttggggctgccttgcagggctgcttgctgagggccggggatgactgcttctctctgcgtcgctgttgcctgccccaaccaggagaaacctccaatctcatcatcatgcggggggctcgggccagccccaggacactcaacctcagccagctcagcttccaccgggttgaccagaaggagatcacccagctgtcccacttgggccagggcacaaggaccaacgtgtatgagggccgcctgcgagtggagggcagcggggaccctgaggagggcaagatggatgacgaggaccccctcgtgcctggcagggaccgtgggcaggagctacgagtggtgctcaaagtgctggaccctagtcaccatgacatcgccctggccttctacgagacagccagcctcatgagccaggtctcccacacgcacctggccttcgtgcatggcgtctgtgtgcgcggccctgaaaatatcatggtgacagagtacgtggagcacggacccctggatgtgtggctgcggagggagcggggccatgtgcccatggcttggaagatggtggtggcccagcagctggccagcgccctcagctacctggagaacaagaacctggttcatggtaatgtgtgtggccggaacatcctgctggcccggctggggttggcagagggcaccagccccttcatcaagctgagtgatcctggcgtgggcctgggcgccctctccagggaggagcgggtggagaggatcccctggctggcccccgaatgcctaccaggtggggccaacagcctaagcaccgccatggacaagtgggggtttggcgccaccctcctggagatctgctttgacggagaggcccctctgcagagccgcagtccctccgagaaggagcatttctaccagaggcagcaccggctgcccgagccctcctgcccacagctggccacactcaccagccagtgtctgacctatgagccaacccagaggccatcattccgcaccatcctgcgtgacctcacccggctgcagccccacaatcttgctgacgtcttgactgtgaacccggactcaccggcgtcggaccctacggttttccacaagcgctatttgaaaaagatccgagatctgggcgagggtcacttcggcaaggtcagcttgtactgctacgatccgaccaacgacggcactggcgagatggtggcggtgaaagccctcaaggcagactgcggcccccagcaccgctcgggctggaagcaggagattgacattctgcgcacgctctaccacgagcacatcatcaagtacaagggctgctgcgaggaccaaggcgagaagtcgctgcagctggtcatggagtacgtgcccctgggcagcctccgagactacctgccccggcacagcatcgggctggcccagctgctgctcttcgcccagcagatctgcgagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtatgccccagagtgcctgaaggagtataagttctactatgcgtcagatgtctggtccttcggggtgaccctgtatgagctgctgacgcactgtgactccagccagagcccccccacggtctatcatctcatgaagaactgctgggagacagaggcgtcctttcgcccaaccttcgagaacctcatacccattctgaagacagtccatgagaagtaccaaggccaggccccttcagtgttcagcgtgtgctgaggcacaatggcagccctgcctgggaggactggaccaggcagtggctgcagagggagcctcctgctccctgctccaggatgaaaccaagagggggatgtcagcctcacccacaccgtgtgccttactcctgtctagagaccccacctctgtgaacttatttttctttcttggccgtgagcctaaccatgatcttgagggacccaacatttgtaggggcactaatccagcccttaaatcccccagcttccaaacttgaggcccaccatctccaccatctggtaataaactcatgttttctctg

SEQ ID NO: 76830 - DNA, 4840 bp, Homo sapiens
acaagcagtagctacccgcgggagcggggaggggtccgggttcgagcttgtgttcccccggaagggtgagtctggacgcgggcgcggaaggagcgcggccggaggtcctcaggaagaagccgcggggactggctgcgcttgacaggctgcacttggatgggagcacctggtgcctcgggactgctccgatgcccgggtctgtgctgaatgtgtaatatgcggaactatattgaaacattacaaccatcttttgatggcaacaccctgaggacctcccttttccagatggggaaactgaggcccagaattgctaagtggcttgcttgagttgacacagggagctccaggactcaccctcagctgagccacctgccgggagcatgcctctgcgccactgggggatggccaggggcagtaagcccgttggggatggagcccagcccatggctgccatgggaggcctgaaggtgcttctgcactgggctggtccaggcggcggggagccctgggtcactttcagtgagtcatcgctgacagctgaggaagtctgcatccacattgcacataaagttggtatcactcctccttgcttcaatctctttgccctcttcgatgctcaggcccaagtctggttgcccccaaaccacatcctagagatccccagagatgcaagcctgatgctatatttccgcataaggttttatttccggaactggcatggcatgaatcctcgggaaccggctgtgtaccgttgtgggcccccaggaaccgaggcatcctcagatcagacagcacaggggatgcaactcctggacccagcctcatttgagtacctctttgagcagggcaagcatgagtttgtgaatgacgtggcatcactgtgggagctgtcgaccgaggaggagatccaccactttaagaatgagagcctgggcatggcctttctgcacctctgtcacctcgctctccgccatggcatccccctggaggaggtggccaagaagaccagcttcaaggactgcatcccgcgctccttccgccggcatatccggcagcacagcgccctgacccggctgcgccttcggaacgtcttccgcaggttcctgcgggacttccagccgggccgactctcccagcagatggtcatggtcaaatacctagccacactcgagcggctggcaccccgcttcggcacagagcgtgtgcccgtgtgccacctgaggctgctggcccaggccgagggggagccctgctacatccgggacagtggggtggcccctacagaccctggccctgagtctgctgctgggcccccaacccacgaggtgctggtgacaggcactggtggcatccagtggtggccagtagaggaggaggtgaacaaggaggagggttctagtggcagcagtggcaggaacccccaagccagcctgtttgggaagaaggccaaggctcacaaggcagtcggccagccggcagacaggccgcgggagccactgtgggcctacttctgtgacttccgggacatcacccacgtggtgctgaaagagcactgtgtcagcatccaccggcaggacaacaagtgcctggagctgagcttgccttcccgggctgcggcgctgtccttcgtgtcgctggtggacggctatttccgcctgacggccgactccagccactacctgtgccacgaggtggctcccccacggctggtgatgagcatccgggatgggatccacggacccctgctggagccatttgtgcaggccaagctgcggcccgaggacggcctgtacctcattcactggagcaccagccacccctaccgcctgatcctcacagtggcccagcgtagccaggcaccagacggcatgcagagcttgcggctccgaaagttccccattgagcagcaggacggggccttcgtgctggagggctggggccggtccttccccagcgttcgggaacttggggctgccttgcagggctgcttgctgagggccggggatgactgcttctctctgcgtcgctgttgcctgccccaaccaggagaaacctccaatctcatcatcatgcggggggctcgggccagccccaggacactcaacctcagccagctcagcttccaccgggttgaccagaaggagatcacccagctgtcccacttgggccagggcacaaggaccaacgtgtatgagggccgcctgcgagtggagggcagcggggaccctgaggagggcaagatggatgacgaggaccccctcgtgcctggcagggaccgtgggcaggagctacgagtggtgctcaaagtgctggaccctagtcaccatgacatcgccctggccttctacgagacagccagcctcatgagccaggtctcccacacgcacctggccttcgtgcatggcgtctgtgtgcgcggccctgaaaatatcatggtgacagagtacgtggagcacggacccctggatgtgtggctgcggagggagcggggccatgtgcccatggcttggaagatggtggtggcccagcagctggccagcgccctcagctacctggagaacaagaacctggttcatggtaatgtgtgtggccggaacatcctgctggcccggctggggttggcagagggcaccagccccttcatcaagctgagtgatcctggcgtgggcctgggcgccctctccagggaggagcgggtggagaggatcccctggctggcccccgaatgcctaccaggtggggccaacagcctaagcaccgccatggacaagtgggggtttggcgccaccctcctggagatctgctttgacggagaggcccctctgcagagccgcagtccctccgagaaggagcatttctaccagaggcagcaccggctgcccgagccctcctgcccacagctggccacactcaccagccagtgtctgacctatgagccaacccagaggccatcattccgcaccatcctgcgtgacctcacccggctgcagccccacaatcttgctgacgtcttgactgtgaacccggactcaccggcgtcggaccctacggttttccacaagcgctatttgaaaaagatccgagatctgggcgagggtcacttcggcaaggtcagcttgtactgctacgatccgaccaacgacggcactggcgagatggtggcggtgaaagccctcaaggcagactgcggcccccagcaccgctcgggctggaagcaggagattgacattctgcgcacgctctaccacgagcacatcatcaagtacaagggctgctgcgaggaccaaggtgggcgggacccggcgagtcctagagacttgagggggcgtggttagagcgtgggtgtggccttgtgggcggggccagtctggcctagccaattagagactctcaaccccaggctgcagtacgcggttcttggcatctgggtgagcgtggctgggctgcctccttcccatctggggggtgctacctgctggggccaggatggacgggagccaccagcagctccctcaagtgagaatggggttctggatgggtccatcccacctgagaactgggtctagtgtgcgcgggtcttggccttccctcccgaccttggaggggctctgctgggctcaaggtaggcggtccccggcccgccctctatcgtcccccaccggggccgcccctctccgcggcaggcgagaagtcgctgcagctggtcatggagtacgtgcccctgggcagcctccgagactacctgccccggcacagcatcgggctggcccagctgctgctcttcgcccagcagatctgcgaggttggtcggccccgcccctgcttctggagcttgccccttcctcttcagcttgggctggcctgagcgatccggtgcagtctgctctcacgctccgcccctgctcgtttgcccaggctgtcttgtccttgcactgacctccgaactgtttggcttgcttggccacaccccctcctcccaagggaccacgcacagccggctcggcccctcccaactcgccctcctgcccagctttgctcgtctagccccgtccctgctttctggctcagcctccttttgcttggtgccacgtgccatccggccctctccagcggccgggtagccaccggcctgacctgactgtcccccagccctcctggctgctcaggtcctgccgccgcccccggccgaaccccgccccactgaaactcacgagccctgccccgtccccagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtctatcatctcatgaagaactgctgggagacagaggcgtcctttcgcccaaccttcgagaacctcatacccattctgaagacagtccatgagaagtaccaaggccaggccccttcagtgttcagcgtgtgctgaggcacaatggcagccctgcctgggaggactggaccaggcagtggctgcagagggagcctcctgctccctgctccaggatgaaaccaagagggggatgtcagcctcacccacaccgtgtgccttactcctgtctagagaccccacctctgtgaacttatttttctttcttggccgtgagcctaaccatgatcttgagggacccaacatttgtaggggcactaatccagcccttaaatcccccagcttccaaacttgaggcccaccatctccaccatctggtaataaactcatgttttctctg

SEQ ID NO: 76831 - DNA, 3056 bp, Homo sapiens
acaagcagtagctacccgcgggagcggggaggggtccgggttcgagcttgtgttcccccggaagggtgagtctggacgcgggcgcggaaggagcgcggccggaggtcctcaggaagaagccgcggggactggctgcgcttgacaggctgcacttggatgggagcacctggtgcctcgggactgctccgatgcccgggtctgtgctgaatgtgtaatatgcggaactatattgaaacattacaaccatcttttgatggcaacaccctgaggacctcccttttccagatggggaaactgaggcccagaattgctaagtggcttgcttgagttgacacagggagctccaggactcaccctcagctgagccacctgccgggagcatgcctctgcgccactgggggatggccaggggcagtaagcccgttggggatggagcccagcccatggctgccatgggaggcctgaaggtgcttctgcactgggctggtccaggcggcggggagccctgggtcactttcagtgagtcatcgctgacagctgaggaagtctgcatccacattgcacataaagttggtatcactcctccttgcttcaatctctttgccctcttcgatgctcaggcccaagtctggttgcccccaaaccacatcctagagatccccagagatgcaagcctgatgctatatttccgcataaggttttatttccggaactggcatggcatgaatcctcgggaaccggctgtgtaccgttgtgggcccccaggaaccgaggcatcctcagatcagacagcacaggggatgcaactcctggacccagcctcatttgagtacctctttgagcagggcaagcatgagtttgtgaatgacgtggcatcactgtgggagctgtcgaccgaggaggagatccaccactttaagaatgagagcctgggcatggcctttctgcacctctgtcacctcgctctccgccatggcatccccctggaggaggtggccaagaagaccagcttcaaggactgcatcccgcgctccttccgccggcatatccggcagcacagcgccctgacccggctgcgccttcggaacgtcttccgcaggttcctgcgggacttccagccgggccgactctcccagcagatggtcatggtcaaatacctagccacactcgagcggctggcaccccgcttcggcacagagcgtgtgcccgtgtgccacctgaggctgctggcccaggccgagggggagccctgctacatccgggacagtggggtggcccctacagaccctggccctgagtctgctgctgggcccccaacccacgaggtgctggtgacaggcactggtggcatccagtggtggccagtagaggaggaggtgaacaaggaggagggttctagtggcagcagtggcaggaacccccaagccagcctgtttgggaagaaggccaaggctcacaaggcagtcggccagccggcagacaggccgcgggagccactgtgggcctacttctgtgacttccgggacatcacccacgtggtgctgaaagagcactgtgtcagcatccaccggcaggacaacaagtgcctggagctgagcttgccttcccgggctgcggcgctgtccttcgtgtcgctggtggacggctatttccgcctgacggccgactccagccactacctgtgccacgaggtggctcccccacggctggtgatgagcatccgggatgggatccacggacccctgctggagccatttgtgcaggccaagctgcggcccgaggacggcctgtacctcattcactggagcaccagccacccctaccgcctgatcctcacagtggcccagcgtagccaggcaccagacggcatgcagagcttgcggctccgaaagttccccattgagcagcaggacggggccttcgtgctggagggctggggccggtccttccccagcgttcgggaacttggggctgccttgcagggctgcttgctgagggccggggatgactgcttctctctgcgtcgctgttgcctgccccaaccaggagaaacctccaatctcatcatcatgcggggggctcgggccagccccaggacactcaacctcagccagctcagcttccaccgggttgaccagaaggagatcacccagctgtcccacttgggccagggcacaaggaccaacgtgtatgagggccgcctgcgagtggagggcagcggggaccctgaggagggcaagatggatgacgaggaccccctcgtgcctggcagggaccgtgggcaggagctacgagtggtgctcaaagtgctggaccctagtcaccatgacatcgccctggccttctacgagacagccagcctcatgagccaggtctcccacacgcacctggccttcgtgcatggcgtctgtgtgcgcggccctgaaaatatcatggtgacagagtacgtggagcacggacccctggatgtgtggctgcggagggagcggggccatgtgcccatggcttggaagatggtggtggcccagcagctggccagcgccctcagctacctggagaacaagaacctggttcatggtaatgtgtgtggccggaacatcctgctggcccggctggggttggcagagggcaccagccccttcatcaagctgagtgatcctggcgtgggcctgggcgccctctccagggaggagcgggtggagaggatcccctggctggcccccgaatgcctaccaggtggggccaacagcctaagcaccgccatggacaagtgggggtttggcgccaccctcctggagattgcagagggagcctcctgctccctgctccaggatgaaaccaagagggggatgtcagcctcacccacaccgtgtgccttactcctgtctagagaccccacctctgtgaacttatttttctttcttggccgtgagcctaaccatgatcttgagggacccaacatttgtaggggcactaatccagcccttaaatcccccagcttccaaacttgaggcccaccatctccaccatctggtaataaactcatgttttctctg

SEQ ID NO: 76832 - DNA, 849 bp, Homo sapiens
taaaagataaaatccattcctcctcccagtgagcaagcatggcttgcatttctcaaaaatgagaacttccatggcagccaagaaaacgtcttctcagaggaactttcgtttgatgcatctcccaagcccacatgcctcctgtgttccagccacctctgcccatttcacatttaaaccagctctccattcccattgagttgccctaacaacattgtctccagtgtcagaaccatattaaggttcgtttctcagattgggagcctgcaacaccatacagccaacattgcctttgccacgccactgccaccatccccaccattgccctatggtgggcagatgaattccagaaaccctcagggagccaggataattaggcaacccatctgaattggccacgtaagtgacaggcacttatctctcgggttcttgcttttgcagactccagggaagtcctgtctagaggtcgatggcagagactcctagtctttcccatgaggggttgataggaatcaaattgggattcctttggctttgggttttgtttttttgttgttgtttttggttttcagtttgttttttggtgtatggggggtgattttgtttctgaataagaaaaagaagaggcaaccatggcccttatgtgggtttatcctttttgagcaatgttttcagcctacaagtaaggaatcttgcaaagtcttttgtccagcaagcagtcttaaaaatgtttttcctaactcccttttgcaggtgactaagtacaaaaaaatagttttctcattgtattcaaaatagtgagtaggttccctggataatacacagtggtagttgacatattttctcaaaaca

SEQ ID NO: 76833 - DNA, 609 bp, Homo sapiens
tagaggatcccccggaagcacctgcaacaccatacagccaacattgcctttgccacgccactgccaccatccccaccattgccctatggtgggcagatgaattccagaaaccctcagggagccaggataattaggcaacccatctgaattggccacgtaagtgacaggcacttatctctcgggttcttgcttttgcagactccagggaagtcctgtctagaggtcgatggcagagactcctagtctttcccatgaggggttgataggaatcaaattgggattcctttggctttgggttttgtttttttgttgttgtttttggttttcagtttgttttttggtgtatggggggtgattttgtttctgaataagaaaaagaagaggcaaccatggcccttatgtgggtttatcctttttgagcaatgttttcagcctacaagtaaggaatcttgcaaagtcttttgtccagcaagcagtcttaaaaatgtttttcctaactcccttttgcaggtgactaagtacaaaaaaatagttttctcattgtattcaaaatagtgagtaggttccctggataatacacagtggtagttgacatattttctcaaaaca

SEQ ID NO: 76834 - DNA, 738 bp, Homo sapiens
gctcaccctggggaattccaagacattgtccttgaaggaggctccaagctcaggacctcaggatgggagatgaggagaagcggaacagggccatcacggcccgcaggcagcacctgaagagcgtgatgctgcagatagcggccacggagctggagaaggaggagagccgccgtgaggcagagaagcagaactacctggcggagcactgcccgccgctgcatatcccgggctccatgtctgaagtgcaggagctctgcaaacagctgcacgccaagatcgatgcggctgaagaggagaagtacgacatggaggtgagggtgcagaagaccagcaaggagctggaggacatgaaccagaagctatttgatctgcggggcaagttcaagcggcccccactgcggagggtgcgcatgtcggccgatgccatgctcaaggccctgctgggctcgaagcacaaggtgtgcatggacctgagggccaacctgaagcaggtcaagaaggaggacacagagaaggagcgggacctgcgagacgtgggtgactggaggaagaacatcgaggagaagtctggcatggagggccggaagaagatgtttgagtccgagtcctaggccactcgctgcccctacgcctgccccggtgcccggctcccagcagaacatactagggagatgcacccagagcctgccagggagggctggcctcaccaccaccgtcaataaaggatttgaatcccca

SEQ ID NO: 76835 - DNA, 709 bp, Homo sapiens
cacctggcaaagtgtcacacaccacacagcaccatgtcccagtgcaagaagcggaacagggccatcacggcccgcaggcagcacctgaagagcgtgatgctgcagatagcggccacggagctggagaaggaggagagccgccgtgaggcagagaagcagaactacctggcggagcactgcccgccgctgcatatcccgggctccatgtctgaagtgcaggagctctgcaaacagctgcacgccaagatcgatgcggctgaagaggagaagtacgacatggaggtgagggtgcagaagaccagcaaggagctggaggacatgaaccagaagctatttgatctgcggggcaagttcaagcggcccccactgcggagggtgcgcatgtcggccgatgccatgctcaaggccctgctgggctcgaagcacaaggtgtgcatggacctgagggccaacctgaagcaggtcaagaaggaggacacagagaaggagcgggacctgcgagacgtgggtgactggaggaagaacatcgaggagaagtctggcatggagggccggaagaagatgtttgagtccgagtcctaggccactcgctgcccctacgcctgccccggtgcccggctcccagcagaacatactagggagatgcacccagagcctgccagggagggctggcctcaccaccaccgtcaataaaggatttgaatcccca

SEQ ID NO: 76836 - DNA, 692 bp, Homo sapiens
  misc_feature (43)..(43): n is a, c, g, or t
  misc_feature (45)..(45): n is a, c, g, or t
tgctgaggtactctaaggatctccctcctacccacgggaacangncatcatggcccgcaggcagcacctgaagagcgtgatgctgcagatagcggccacggagctggagaaggaggagagccgccgtgaggcagagaagcagaactacctggcggagcactgcccgccgctgcatatcccgggctccatgtctgaagtgcaggagctctgcaaacagctgcacgccaagatcgatgcggctgaagaggagaagtacgacatggaggtgagggtgcagaagaccagcaaggagctggaggacatgaaccagaagctatttgatctgcggggcaagttcaagcggcccccactgcggagggtgcgcatgtcggccgatgccatgctcaaggccctgctgggctcgaagcacaaggtgtgcatggacctgagggccaacctgaagcaggtcaagaaggaggacacagagaaggagcgggacctgcgagacgtgggtgactggaggaagaacatcgaggagaagtctggcatggagggccggaagaagatgtttgagtccgagtcctaggccactcgctgcccctacgcctgccccggtgcccggctcccagcagaacatactagggagatgcacccagagcctgccagggagggctggcctcaccaccaccgtcaataaaggatttgaatcccca

SEQ ID NO: 76837 - DNA, 561 bp, Homo sapiens
gctcaccctggggaattccaagacattgtccttgaaggaggctccaagctcaggacctcaggatgggagatgaggagaagcggaacagggccatcacggcccgcaggcagcacctgaagagcgtgatgctgcagatagcggccacggagctggagaaggaggagagccgccgtgaggcagagaagcagaactacctggcggagcactgcccgccgctgcatatcccgggctccatgtctgaagtgcaggagctctgcaaacagctgcacgccaagatcgatgcggctgaagaggagaagtacgacatggaggtgagggtgcagaagaccagcaaggagctggaggacatgaaccagaagctatttgatctgcggggcaagttcaagcggcccccactgcggagggtgcgcatgtcggccgatgccatgctcaaggccctgctgggctcgaagcacaaggtgtgcatggacctgagggccaacctgaagcaggtcaagaaggaggacacagagaaggaacggacctgcgaacgtgggtaggaggtgaagatcctgtagagtg

SEQ ID NO: 76838 - DNA, 695 bp, Homo sapiens
actgggaaccactgggttagagtatatgaagagctgttagtggccatttagataatcttaggtttagagagacctgtgttaatttattgtcatcacatagcctaagtgaacagtggaatgtgaaaggcagtttattaataatcaccttaaaaggtgtggaaccgaagtcttgtctcctctcttttatttggatctctctgcctgtgtgtacatgctccctcttcatctcgacttggttgtggagaggtggtatgtgtgtttcttccgtgagtttttatatgctggcaccttcatttccctctaactgctccaccttccttttccccccttcctctgcgtacttctctcttctttttttatgtgtcttcctccccatgtctgtgtgtatgagagagagaaagataatggcagagctggaatggaatacatcaatcatctaattccctcagtttatagatttggaaattaaggcccaagaattcaggtgacttgaccaaattcacatgactaaaaagtggcagagcaaggaacagaagccactactttttccactttactactctgtcctgttatctgcacatttgtgtgtgtgtatatgtgtggatatgtgtctaccccctcctctgtaatatgaaatacaaatagagggtttttttgctatgtgtagaataaaactgttctctattgtgtttgaa

SEQ ID NO: 76839 - DNA, 315 bp, Homo sapiens
ttttttttttagtagagacgggtttcaccatgttggccaagatggtctcaatctcttgacctcgtgatccaccggccttggcttcccaaattgctgggattacaggcgtgacacatggtgcctggccacagcatgttttttaatttttaaattggagggattgtttctttatcaatttattatgatctaatttaaatactccttttaaaatacttggctgattctcaagttgtagtacatcaagtaagcattttaaaatgtcttctaatttgaccattctactcataatctttataattatgatgaaaaacacaa

SEQ ID NO: 76840 - DNA, 521 bp, Homo sapiens
tgtgcttttaattgggaaatcagatactaagcttgttagaatcaagtctaaaatacaagaaagctggcttaaggaaaagcttgaggcactacctaaaattaaaatgttcaagttctagtttaacttccatattcttagtctgagataagggtgtcaaagtatagtggtctatagattgtaaagtgcccctagatttggaaactggccatttcactgtatagaaaatatactctttgatcacgttgtatataaatgtccaagtttgaagcaatatgattattttgatcttgaatcagtaattaaggtggacttcaaactgttgaggttttattttctgagaggaccaaagagtcatgaatgtgccagggaaagtccttaggttctaaaaccagacttagatctaggcacatagaaaccgctccacacatccatagtgaatcttattgaattaaagacccttggtaaaatagacacagctaccattagaaggaagcttgcaactgaataacttgtctttctta

SEQ ID NO: 76841 - DNA, 2840 bp, Homo sapiens
gtcgctgcggagcggaggcggggcgtagggcggggtcacgtggggctgcgcccaaggctgccgggagcagactgggctgcgggcggcggggccggcgcctgcctggagggatggggctgccgggcgcgtaggggccatgccgcccgggacccgggcctgccgcgttccgcgccccggccgccgcgccccacgtccgcgccgggatggtgaacctggcggccatggtgtggcgccggcttctgcggaagaggtgggtgctcgccctggtcttcgggctgtcgctcgtctacttcctcagcagcaccttcaagcaggaggagagggcagtgagagataggaatctcctccaggttcatgaccataatcagcccatcccgtggaaagtgcagtttaacttgggcaatagcagtcgtccgagcaatcagtgccgcaactccattcaagggaagcacctcatcacggatgaactcggctacgtttgcgagaggaaggatttgctggtaaatggctgctgtaatgtcaacgtccctagcacgaagcagtactgctgtgatggctgctggcccaacggctgctgcagcgcctatgagtactgtgtctcctgctgcctgcagcccaacaagcaacttctcctggagcgcttcctcaaccgggcagccgtggcattccagaacctcttcatggcagtcgaagatcactttgagttgtgcctggccaaatgcaggacctcatctcagagcgtgcagcatgagaacacctaccgggaccccatagcaaagtattgctatggagaaagcccgcccgagctcttccccgcttgacgggtgcagcggacttgctccagcctgggtgaggaggccccgctgaagaactcgcctcctgggacccagcttcagccatcgggccaggctgcaggaagaagacaaaggcagcgtgaggaaaccttggctttgaccccttctcgtgttgtcatctttggcttcgctcaccacccgggcttaccagatggaactcttctgtaaagcagcttggcccctccagccagtcccattcgggaaagatgaaaccggaggccgggctcacggtggtggtggagttcttggatgactcagccctgggacctgcacagggacctgtgacttgtgttcatcgggggccggtgtcacttccagttttgatccaggctctttcactgtaaaattatttattggattcctttggagtaatgggaacattctaatgttttatgtaggaaaatgccttgccattctagttgaatatgttcaaggaaattatttttgttgttgttctgtgttctcgagtttcaggagttaaatcattcttccacccagatacaacattttctcttttaggacgtgaatattctctctaggcagttatttttgtttgtatttcgacagtatcaagcataggccctgaacgtgacctgttagccatatcctgacgtgtaaaattatctaaaaactcagacactcttccattctaatctaactgcacgatttctaacagtgggcaccatgtgcctgccctcaggttattttccagtggtagtcgaatgtgctcatataccctatggagagcactgttttagcagaaatctaatttctcttcctggaggaatttgttctcatttcttttgccacttaaaattaactgtgggctactcagccagggtacagtgggagcctcaggaaggtcagaggcaacctcctcccctgttctatcaatagaaacccaacgttgaggcaattcctaaacagacgcacctcgtagcttgctgtatgtgtttattctttattgctttcagctttggggctgtaacaggtacaaatatttggtttccctatgatttatagagaagaagaagaaacccagctttctatcagagcactgcaagagaagagtcttacacctgccctcagtgggagatgagaatggtcattatgacttagagaatgctacacgtgtaggttgctggtgtgtcctgaatccacaggcataaagcactccccatttttcctactgtaatgcagattctccggctcaaggtctagaatatttgatcctaagatcaagacatcatgcccttcgaatagtactgctctttgttttcaggagtcacgtgaacacacaactctcctatattcctcacgaacctcaggattgagcaaggtctttgtaatttttttggttcactttattgacctgggagcaaggtgctaattctgtggtcagtattcaatgtttttttcagtggagctttttctttgggccatatttgccttctaatacattcctgcaatatgtagtggtgatttcccttagcttcctcctactacctcttatactcatctccccaaattatttgcctcccttaaataagttttcctagaaggtaagctggtcaggcaatttgaaaaatattagatcccaagaaatctattccgtttgcattggacttctcggattccatgtgtttgcagcaggactacatcgaactctgatgtgccggattgtggcatgtctgcatgtctcatccatctattgtttttggtaactcagtttggaatttcagtgtctgtcttccctgggttgacattggaatcagcctctcctttgagcttattttaactcttgagcaacataacatagatttaatgtgaacagtttataccaaagggcagcctgtgcctgtttatggatcctctctgcctttgtacttgaagagcgcattttacatttccagtcctttcacagacaggagctccaaccttacgatggagaattaaacttgcttgtatttccactttgtggatgag

SEQ ID NO: 76842 - DNA, 3831 bp, Homo sapiens
gtcgctgcggagcggaggcggggcgtagggcggggtcacgtggggctgcgcccaaggctgccgggagcagactgggctgcgggcggcggggccggcgcctgcctggagggatggggctgccgggcgcgtaggggccatgccgcccgggacccgggcctgccgcgttccgcgccccggccgccgcgccccacgtccgcgccgggatggtgaacctggcggccatggtgtggcgccggcttctgcggaagaggtgggtgctcgccctggtcttcgggctgtcgctcgtctacttcctcagcagcaccttcaagcaggaggagagggcagtgagagataggaatctcctccaggttcatgaccataatcagcccatcccgtggaaagtgcagtttaacttgggcaatagcagtcgtccgagcaatcagtgccgcaactccattcaagggaagcacctcatcacggatgaactcggctacgtttgcgagaggaaggatttgctggtaaatggctgctgtaatgtcaacgtccctagcacgaagcagtactgctgtgatggctgctggcccaacggctgctgcagcgcctatgagtactgtgtctcctgctgcctgcagcccaacaagcaacttctcctggagcgcttcctcaaccgggcagccgtggcattccagaacctcttcatggcagtcgaagatcactttgagttgtgcctggccaaatgcaggacctcatctcagagcgtgcagcatgagaacacctaccgggaccccatagcaaagtattgctatggagaaagcccgcccgagctcttccccgcttgacgggtgcagcggacttgctccagcctgggtgaggaggccccgctgaagaactcgcctcctgggacccagcttcagccatcgggccaggctgcaggaagaagacaaaggcagcgtgaggaaaccttggctttgaccccttctcgtgttgtcatctttggcttcgctcaccacccgggcttaccagatggaactcttctgtaaagcagcttggcccctccagccagtcccattcgggaaagatgaaaccggaggccgggctcacggtggtggtggagttcttggatgactcagccctgggacctgcacagggacctgtgacttgtgttcatcgggggccggtgtcacttccagttttgatccaggctctttcactgtaaaattatttattggattcctttggagtaatgggaacattctaatgttttatgtaggaaaatgccttgccattctagttgaatatgttcaaggaaattatttttgttgttgttctgtgttctcgagtttcaggagttaaatcattcttccacccagatacaacattttctcttttaggacgtgaatattctctctaggcagttatttttgtttgtatttcgacagtatcaagcataggccctgaacgtgacctgttagccatatcctgacgtgtaaaattatctaaaaactcagacactcttccattctaatctaactgcacgatttctaacagtgggcaccatgtgcctgccctcaggttattttccagtggtagtcgaatgtgctcatataccctatggagagcactgttttagcagaaatctaatttctcttcctggaggaatttgttctcatttcttttgccacttaaaattaactgtgggctactcagccagggtacagtgggagcctcaggaaggtcagaggcaacctcctcccctgttctatcaatagaaacccaacgttgaggcaattcctaaacagacgcacctcgtagcttgctgtatgtgtttattctttattgctttcagctttggggctgtaacaggtacaaatatttggtttccctatgatttatagagaagaagaagaaacccagctttctatcagagcactgcaagagaagagtcttacacctgccctcagtgggagatgagaatggtcattatgacttagagaatgctacacgtgtaggttgctggtgtgtcctgaatccacaggcataaagcactccccatttttcctactgtaatgcagattctccggctcaaggtctagaatatttgatcctaagatcaagacatcatgcccttcgaatagtactgctctttgttttcaggagtcacgtgaacacacaactctcctatattcctcacgaacctcaggattgagcaaggtctttgtaatttttttggttcactttattgacctgggagcaaggtgctaattctgtggtcagtattcaatgtttttttcagtggagctttttctttgggccatatttgccttctaatacattcctgcaatatgtagtggtgatttcccttagcttcctcctactacctcttatactcatctccccaaattatttgcctcccttaaataagttttcctagaaggtaagctggtcaggcaatttgaaaaatattagatcccaagaaatctattccgtttgcattggacttctcggattccatgtgtttgcagcaggactacatcgaactctgatgtgccggattgtggcatgtctgcatgtctcatccatctattgtttttggtaactcagtttggaatttcagtgtctgtcttccctgggttgacattggaatcagcctctcctttgagcttattttaactcttgagcaacataacatagatttaatgtgaacagtttataccaaagggcagcctgtgcctgtttatggatcctctctgcctttgtacttgaagagcgcattttacatttccagtcctttcacagacaggagctccaaccttacgatggagaattaaacttgcttgtatttccactttgtggatgaggaactatgagaggtggagtgacttcctgggtccccgctgagacttagtgacagatcccagacaagaacttcatctctgactccaggtctagtcctcttccccctgtctcttgccaactccagccctgacaccgtgggcgtctcccctgagagcagatatatttcaattgtccaggccaaaagaggggcgaggcggcataaacacccaaattaggtggaggatccaaaagtcattttcatttggctgtggaatatgttttttgtatttcaatcagctaggggtgtgttcactgtttttggaaattcacagcgcttgagcctccataatgaagccgggctgcagagcacctggcacgtgctccaggctcccagctcccaacctaggacctctccctgccctccactctggttggtttgtggttccctcgaccgagggtttctagaatcagggaccttgtctaagttttgtttgcccagagcccagcgaagtgtgtgatacaccttgggagtttaggagatcacaaaagggatgaaaacacctttagaaaacatttcattggtggggcgtggtggcttatgcctgtaatcccagcactttggaaggctgaggcaggtggatcacctgaaggcaggagttcagaccagcctgaccaatatggtgaaaccccatctatactaaaaatacaaaaattagccgggtgtgggggcgtgtgcctgtttttgtgagactctgtctcaaaaaaaagaaaaaaatattgttaataagtgagtgttttcggctcaagggaattgagtcatacgttgcatctcccccagttctgcatcttatttgctgcgcttgctggagttgtaaagattggtcctaacagggaaagaagcacacaagagactgtgaaaagggctctgagacaagcaaggacaaaagagggagggaaataccttccacagggcctgggatctggcaatgctagagccttttttttttttttttt

SEQ ID NO: 76843 - DNA, 3674 bp, Homo sapiens
gtcgctgcggagcggaggcggggcgtagggcggggtcacgtggggctgcgcccaaggctgccgggagcagactgggctgcgggcggcggggccggcgcctgcctggagggatggggctgccgggcgcgtaggggccatgccgcccgggacccgggcctgccgcgttccgcgccccggccgccgcgccccacgtccgcgccgggatggtgaacctggcggccatggtgtggcgccggcttctgcggaagaggtgggtgctcgccctggtcttcgggctgtcgctcgtctacttcctcagcagcaccttcaagcaggctacgtttgcgagaggaaggatttgctggtaaatggctgctgtaatgtcaacgtccctagcacgaagcagtactgctgtgatggctgctggcccaacggctgctgcagcgcctatgagtactgtgtctcctgctgcctgcagcccaacaagcaacttctcctggagcgcttcctcaaccgggcagccgtggcattccagaacctcttcatggcagtcgaagatcactttgagttgtgcctggccaaatgcaggacctcatctcagagcgtgcagcatgagaacacctaccgggaccccatagcaaagtattgctatggagaaagcccgcccgagctcttccccgcttgacgggtgcagcggacttgctccagcctgggtgaggaggccccgctgaagaactcgcctcctgggacccagcttcagccatcgggccaggctgcaggaagaagacaaaggcagcgtgaggaaaccttggctttgaccccttctcgtgttgtcatctttggcttcgctcaccacccgggcttaccagatggaactcttctgtaaagcagcttggcccctccagccagtcccattcgggaaagatgaaaccggaggccgggctcacggtggtggtggagttcttggatgactcagccctgggacctgcacagggacctgtgacttgtgttcatcgggggccggtgtcacttccagttttgatccaggctctttcactgtaaaattatttattggattcctttggagtaatgggaacattctaatgttttatgtaggaaaatgccttgccattctagttgaatatgttcaaggaaattatttttgttgttgttctgtgttctcgagtttcaggagttaaatcattcttccacccagatacaacattttctcttttaggacgtgaatattctctctaggcagttatttttgtttgtatttcgacagtatcaagcataggccctgaacgtgacctgttagccatatcctgacgtgtaaaattatctaaaaactcagacactcttccattctaatctaactgcacgatttctaacagtgggcaccatgtgcctgccctcaggttattttccagtggtagtcgaatgtgctcatataccctatggagagcactgttttagcagaaatctaatttctcttcctggaggaatttgttctcatttcttttgccacttaaaattaactgtgggctactcagccagggtacagtgggagcctcaggaaggtcagaggcaacctcctcccctgttctatcaatagaaacccaacgttgaggcaattcctaaacagacgcacctcgtagcttgctgtatgtgtttattctttattgctttcagctttggggctgtaacaggtacaaatatttggtttccctatgatttatagagaagaagaagaaacccagctttctatcagagcactgcaagagaagagtcttacacctgccctcagtgggagatgagaatggtcattatgacttagagaatgctacacgtgtaggttgctggtgtgtcctgaatccacaggcataaagcactccccatttttcctactgtaatgcagattctccggctcaaggtctagaatatttgatcctaagatcaagacatcatgcccttcgaatagtactgctctttgttttcaggagtcacgtgaacacacaactctcctatattcctcacgaacctcaggattgagcaaggtctttgtaatttttttggttcactttattgacctgggagcaaggtgctaattctgtggtcagtattcaatgtttttttcagtggagctttttctttgggccatatttgccttctaatacattcctgcaatatgtagtggtgatttcccttagcttcctcctactacctcttatactcatctccccaaattatttgcctcccttaaataagttttcctagaaggtaagctggtcaggcaatttgaaaaatattagatcccaagaaatctattccgtttgcattggacttctcggattccatgtgtttgcagcaggactacatcgaactctgatgtgccggattgtggcatgtctgcatgtctcatccatctattgtttttggtaactcagtttggaatttcagtgtctgtcttccctgggttgacattggaatcagcctctcctttgagcttattttaactcttgagcaacataacatagatttaatgtgaacagtttataccaaagggcagcctgtgcctgtttatggatcctctctgcctttgtacttgaagagcgcattttacatttccagtcctttcacagacaggagctccaaccttacgatggagaattaaacttgcttgtatttccactttgtggatgaggaactatgagaggtggagtgacttcctgggtccccgctgagacttagtgacagatcccagacaagaacttcatctctgactccaggtctagtcctcttccccctgtctcttgccaactccagccctgacaccgtgggcgtctcccctgagagcagatatatttcaattgtccaggccaaaagaggggcgaggcggcataaacacccaaattaggtggaggatccaaaagtcattttcatttggctgtggaatatgttttttgtatttcaatcagctaggggtgtgttcactgtttttggaaattcacagcgcttgagcctccataatgaagccgggctgcagagcacctggcacgtgctccaggctcccagctcccaacctaggacctctccctgccctccactctggttggtttgtggttccctcgaccgagggtttctagaatcagggaccttgtctaagttttgtttgcccagagcccagcgaagtgtgtgatacaccttgggagtttaggagatcacaaaagggatgaaaacacctttagaaaacatttcattggtggggcgtggtggcttatgcctgtaatcccagcactttggaaggctgaggcaggtggatcacctgaaggcaggagttcagaccagcctgaccaatatggtgaaaccccatctatactaaaaatacaaaaattagccgggtgtgggggcgtgtgcctgtttttgtgagactctgtctcaaaaaaaagaaaaaaatattgttaataagtgagtgttttcggctcaagggaattgagtcatacgttgcatctcccccagttctgcatcttatttgctgcgcttgctggagttgtaaagattggtcctaacagggaaagaagcacacaagagactgtgaaaagggctctgagacaagcaaggacaaaagagggagggaaataccttccacagggcctgggatctggcaatgctagagccttttttttttttttttt

SEQ ID NO: 76844 - DNA, 3365 bp, Homo sapiens
gcacgagctcctccgctgactaatatgcttaaattcagggcggcggggccggcgcctgcctggagggatggggctgccgggcgcgtaggggccatgccgcccgggacccgggcctgccgcgttccgcgccccggccgccgcgccccacgtccgcgccgggatggtgaacctggcggccatggtgtggcgccggcttctgcggaagaggtgggtgctcgccctggtcttcgggctgtcgctcgtctacttcctcagcagcaccttcaagcagagcgtgcagcatgagaacacctaccgggaccccatagcaaagtattgctatggagaaagcccgcccgagctcttccccgcttgacgggtgcagcggacttgctccagcctgggtgaggaggccccgctgaagaactcgcctcctgggacccagcttcagccatcgggccaggctgcaggaagaagacaaaggcagcgtgaggaaaccttggctttgaccccttctcgtgttgtcatctttggcttcgctcaccacccgggcttaccagatggaactcttctgtaaagcagcttggcccctccagccagtcccattcgggaaagatgaaaccggaggccgggctcacggtggtggtggagttcttggatgactcagccctgggacctgcacagggacctgtgacttgtgttcatcgggggccggtgtcacttccagttttgatccaggctctttcactgtaaaattatttattggattcctttggagtaatgggaacattctaatgttttatgtaggaaaatgccttgccattctagttgaatatgttcaaggaaattatttttgttgttgttctgtgttctcgagtttcaggagttaaatcattcttccacccagatacaacattttctcttttaggacgtgaatattctctctaggcagttatttttgtttgtatttcgacagtatcaagcataggccctgaacgtgacctgttagccatatcctgacgtgtaaaattatctaaaaactcagacactcttccattctaatctaactgcacgatttctaacagtgggcaccatgtgcctgccctcaggttattttccagtggtagtcgaatgtgctcatataccctatggagagcactgttttagcagaaatctaatttctcttcctggaggaatttgttctcatttcttttgccacttaaaattaactgtgggctactcagccagggtacagtgggagcctcaggaaggtcagaggcaacctcctcccctgttctatcaatagaaacccaacgttgaggcaattcctaaacagacgcacctcgtagcttgctgtatgtgtttattctttattgctttcagctttggggctgtaacaggtacaaatatttggtttccctatgatttatagagaagaagaagaaacccagctttctatcagagcactgcaagagaagagtcttacacctgccctcagtgggagatgagaatggtcattatgacttagagaatgctacacgtgtaggttgctggtgtgtcctgaatccacaggcataaagcactccccatttttcctactgtaatgcagattctccggctcaaggtctagaatatttgatcctaagatcaagacatcatgcccttcgaatagtactgctctttgttttcaggagtcacgtgaacacacaactctcctatattcctcacgaacctcaggattgagcaaggtctttgtaatttttttggttcactttattgacctgggagcaaggtgctaattctgtggtcagtattcaatgtttttttcagtggagctttttctttgggccatatttgccttctaatacattcctgcaatatgtagtggtgatttcccttagcttcctcctactacctcttatactcatctccccaaattatttgcctcccttaaataagttttcctagaaggtaagctggtcaggcaatttgaaaaatattagatcccaagaaatctattccgtttgcattggacttctcggattccatgtgtttgcagcaggactacatcgaactctgatgtgccggattgtggcatgtctgcatgtctcatccatctattgtttttggtaactcagtttggaatttcagtgtctgtcttccctgggttgacattggaatcagcctctcctttgagcttattttaactcttgagcaacataacatagatttaatgtgaacagtttataccaaagggcagcctgtgcctgtttatggatcctctctgcctttgtacttgaagagcgcattttacatttccagtcctttcacagacaggagctccaaccttacgatggagaattaaacttgcttgtatttccactttgtggatgaggaactatgagaggtggagtgacttcctgggtccccgctgagacttagtgacagatcccagacaagaacttcatctctgactccaggtctagtcctcttccccctgtctcttgccaactccagccctgacaccgtgggcgtctcccctgagagcagatatatttcaattgtccaggccaaaagaggggcgaggcggcataaacacccaaattaggtggaggatccaaaagtcattttcatttggctgtggaatatgttttttgtatttcaatcagctaggggtgtgttcactgtttttggaaattcacagcgcttgagcctccataatgaagccgggctgcagagcacctggcacgtgctccaggctcccagctcccaacctaggacctctccctgccctccactctggttggtttgtggttccctcgaccgagggtttctagaatcagggaccttgtctaagttttgtttgcccagagcccagcgaagtgtgtgatacaccttgggagtttaggagatcacaaaagggatgaaaacacctttagaaaacatttcattggtggggcgtggtggcttatgcctgtaatcccagcactttggaaggctgaggcaggtggatcacctgaaggcaggagttcagaccagcctgaccaatatggtgaaaccccatctatactaaaaatacaaaaattagccgggtgtgggggcgtgtgcctgtttttgtgagactctgtctcaaaaaaaagaaaaaaatattgttaataagtgagtgttttcggctcaagggaattgagtcatacgttgcatctcccccagttctgcatcttatttgctgcgcttgctggagttgtaaagattggtcctaacagggaaagaagcacacaagagactgtgaaaagggctctgagacaagcaaggacaaaagagggagggaaataccttccacagggcctgggatctggcaatgctagagccttttttttttttttttt

SEQ ID NO: 76845 - DNA, 679 bp, Homo sapiens
  misc_feature (427)..(427): n is a, c, g, or t
  misc_feature (434)..(434): n is a, c, g, or t
  misc_feature (451)..(451): n is a, c, g, or t
  misc_feature (453)..(453): n is a, c, g, or t
gcacgagctcctccgctgactaatatgcttaaattcagggcggcggggccggcgcctgcctggagggatggggctgccgggcgcgtaggggccatgccgcccgggacccgggcctgccgcgttccgcgccccggccgccgcgccccacgtccgcgccgggatggtgaacctggcggccatggtgtggcgccggcttctgcggaagaggtgggtgctcgccctggtcttcgggctgtcgctcgtctacttcctcagcagcaccttcaagcagtctgaaaacagccagttacttcccaagagttgcacagagaagcctgcacacttccatctggatatttagttaccctcttggaaacagtctccactccacccatcacattctacctccaaggactggaacacagacttattcccacctccccgcttntgggctnttggctggccccaggtntntgacaatcctcccttggggccagaggtactcaaggatgccaagagggatattgagttcacacacacacacacacaaggtgcaaaaaaaccccttgggtattggcctaaccaataaacacttttctttggttaatcattgctattatcaaaaaatcttaatataaaaatctaggctatacaaagaaaattactcaaatacaaatgttgttcacattgtaaaaaaaaa

SEQ ID NO: 76846 - DNA, 2797 bp, Homo sapiens
gcacgagctcctccgctgactaatatgcttaaattcagggcggcggggccggcgcctgcctggagggatggggctgccgggcgcgtaggggccatgccgcccgggacccgggcctgccgcgttccgcgccccggccgccgcgccccacgtccgcgccgggatggtgaacctggcggccatggtgtggcgccggcttctgcggaagaggtgggtgctcgccctggtcttcgggctgtcgctcgtctacttcctcagcagcaccttcaagcaggaggagagggcagtgagagataggaatctcctccaggttcatgaccataatcagcccatcccgtggaaagtgcagtttaacttgggcaatagcagtcgtccgagcaatcagtgccgcaactccattcaagggaagcacctcatcacggatgaactcggctacgtttgcgagaggaaggatttgctggtaaatggctgctgtaatgtcaacgtccctagcacgaagcagtactgctgtgatggctgctggcccaacggctgctgcagcgcctatgagtactgtgtctcctgctgcctgcagcccaacaagcaacttctcctggagcgcttcctcaaccgggcagccgtggcattccagaacctcttcatggcagtcgaagatcactttgagttgtgcctggccaaatgcaggacctcatctcagagcgtgcagcatgagaacacctaccgggaccccatagcaaagtattgctatggagaaagcccgcccgagctcttccccgcttgacgggtgcagcggacttgctccagcctgggtgaggaggccccgctgaagaactcgcctcctgggacccagcttcagccatcgggccaggctgcaggaagaagacaaaggcagcgtgaggaaaccttggctttgaccccttctcgtgttgtcatctttggcttcgctcaccacccgggcttaccagatggaactcttctgtaaagcagcttggcccctccagccagtcccattcgggaaagatgaaaccggaggccgggctcacggtggtggtggagttcttggatgactcagccctgggacctgcacagggacctgtgacttgtgttcatcgggggccggtgtcacttccagttttgatccaggctctttcactgtaaaattatttattggattcctttggagtaatgggaacattctaatgttttatgtaggaaaatgccttgccattctagttgaatatgttcaaggaaattatttttgttgttgttctgtgttctcgagtttcaggagttaaatcattcttccacccagatacaacattttctcttttaggacgtgaatattctctctaggcagttatttttgtttgtatttcgacagtatcaagcataggccctgaacgtgacctgttagccatatcctgacgtgtaaaattatctaaaaactcagacactcttccattctaatctaactgcacgatttctaacagtgggcaccatgtgcctgccctcaggttattttccagtggtagtcgaatgtgctcatataccctatggagagcactgttttagcagaaatctaatttctcttcctggaggaatttgttctcatttcttttgccacttaaaattaactgtgggctactcagccagggtacagtgggagcctcaggaaggtcagaggcaacctcctcccctgttctatcaatagaaacccaacgttgaggcaattcctaaacagacgcacctcgtagcttgctgtatgtgtttattctttattgctttcagctttggggctgtaacaggtacaaatatttggtttccctatgatttatagagaagaagaagaaacccagctttctatcagagcactgcaagagaagagtcttacacctgccctcagtgggagatgagaatggtcattatgacttagagaatgctacacgtgtaggttgctggtgtgtcctgaatccacaggcataaagcactccccatttttcctactgtaatgcagattctccggctcaaggtctagaatatttgatcctaagatcaagacatcatgcccttcgaatagtactgctctttgttttcaggagtcacgtgaacacacaactctcctatattcctcacgaacctcaggattgagcaaggtctttgtaatttttttggttcactttattgacctgggagcaaggtgctaattctgtggtcagtattcaatgtttttttcagtggagctttttctttgggccatatttgccttctaatacattcctgcaatatgtagtggtgatttcccttagcttcctcctactacctcttatactcatctccccaaattatttgcctcccttaaataagttttcctagaaggtaagctggtcaggcaatttgaaaaatattagatcccaagaaatctattccgtttgcattggacttctcggattccatgtgtttgcagcaggactacatcgaactctgatgtgccggattgtggcatgtctgcatgtctcatccatctattgtttttggtaactcagtttggaatttcagtgtctgtcttccctgggttgacattggaatcagcctctcctttgagcttattttaactcttgagcaacataacatagatttaatgtgaacagtttataccaaagggcagcctgtgcctgtttatggatcctctctgcctttgtacttgaagagcgcattttacatttccagtcctttcacagacaggagctccaaccttacgatggagaattaaacttgcttgtatttccactttgtggatgag

SEQ ID NO: 76847 - DNA, 3776 bp, Homo sapiens
gtcgctgcggagcggaggcggggcgtagggcggggtcacgtggggctgcgcccaaggctgccgggagcagactgggctgcgggcggcggggccggcgcctgcctggagggatggggctgccgggcgcgtaggggccatgccgcccgggacccgggcctgccgcgttccgcgccccggccgccgcgccccacgtccgcgccgggatggtgaacctggcggccatggtgtggcgccggcttctgcggaagaggtgggtgctcgccctggtcttcgggctgtcgctcgtctacttcctcagcagcaccttcaagcaggaggagagggcagtgagagataggaatctcctccaggttcatgaccataatcagcccatcccgtggaaagtgcagtttaacttgggcaatagcagtcgtccgagcaatcagtgccgcaactccattcaagggaagcacctcatcacggatgaactcggctacgtttgcgagaggaaggatttgctggtaaatggctgctgtaatgtcaacgtccctagcacgaagcagtactgctgtgatggctgctggcccaacggctgctgcagcgcctatgagtactgtgtctcctgctgcctgcagcccaacaagcaacttctcctggagcgcttcctcaaccgggcagccgtggcattccagaacctcttcatggcagtcgaagatcactttgagttgtgcctggccaaatgcaggacctcatctcagagcgtgcagcatgagaacacctaccgggaccccatagcaaagtattgctatggagaaagcccgcccgagctcttccccgcttgacgggtgcagcggacttgctccagcctgggtgaggaggccccgctgaagaactcgcctcctgggacccagcttcagccatcgggccaggctgcaggaagaagacaaaggcagcgtgaggaaaccttggctttgaccccttctcgtgttgtcatctttggcttcgctcaccacccgggcttaccagatggaactcttctgtaaagcagcttggcccctccagccagtcccattcgggaaagatgaaaccggaggccgggctcacggtggtggtggagttcttggatgactcagccctgggacctgcacagggacctgtgacttgtgttcatcgggggccggtgtcacttccagttttgatccaggctctttcactgtaaaattatttattggattcctttggagtaatgggaacattctaatgttttatgtaggaaaatgccttgccattctagttgaatatgttcaaggaaattatttttgttgttgttctgtgttctcgagtttcaggagttaaatcattcttccacccagatacaacattttctcttttaggacgtgaatattctctctaggcagttatttttgtttgtatttcgacagtatcaagcataggccctgaacgtgacctgttagccatatcctgacgtgtaaaattatctaaaaactcagacactcttccattctaatctaactgcacgatttctaacagtgggcaccatgtgcctgccctcaggttattttccagtggtagtcgaatgtgctcatataccctatggagagcactgttttagcagaaatctaatttctcttcctggaggaatttgttctcatttcttttgccacttaaaattaactgtgggctactcagccagggtacagtgggagcctcaggaaggtcagaggcaacctcctcccctgttctatcaatagaaacccaacgttgaggcaattcctaaacagacgcacctcgtagcttgctgtatgtgtttattctttattgctttcagctttggggctgtaacaggtacaaatatttggtttccctatgatttatagagaagaagaagaaacccagctttctatcagagcactgcaagagaagagtcttacacctgccctcagtgggagatgagaatggtcattatgacttagagaatgctacacgtgtaggttgctggtgtgtcctgaatccacaggcataaagcactccccatttttcctactgtaatgcagattctccggctcaaggtctagaatatttgatcctaagatcaagacatcatgcccttcgaatagtactgctctttgttttcaggagtcacgtgaacacacaactctcctatattcctcacgaacctcaggattgagcaaggtctttgtaatttttttggttcactttattgacctgggagcaaggtgctaattctgtggtcagtattcaatgtttttttcagtggagctttttctttgggccatatttgccttctaatacattcctgcaatatgtagtggtgatttcccttagcttcctcctactacctcttatactcatctccccaaattatttgcctcccttaaataagttttcctagaaggtaagctggtcaggcaatttgatgtgtttgcagcaggactacatcgaactctgatgtgccggattgtggcatgtctgcatgtctcatccatctattgtttttggtaactcagtttggaatttcagtgtctgtcttccctgggttgacattggaatcagcctctcctttgagcttattttaactcttgagcaacataacatagatttaatgtgaacagtttataccaaagggcagcctgtgcctgtttatggatcctctctgcctttgtacttgaagagcgcattttacatttccagtcctttcacagacaggagctccaaccttacgatggagaattaaacttgcttgtatttccactttgtggatgaggaactatgagaggtggagtgacttcctgggtccccgctgagacttagtgacagatcccagacaagaacttcatctctgactccaggtctagtcctcttccccctgtctcttgccaactccagccctgacaccgtgggcgtctcccctgagagcagatatatttcaattgtccaggccaaaagaggggcgaggcggcataaacacccaaattaggtggaggatccaaaagtcattttcatttggctgtggaatatgttttttgtatttcaatcagctaggggtgtgttcactgtttttggaaattcacagcgcttgagcctccataatgaagccgggctgcagagcacctggcacgtgctccaggctcccagctcccaacctaggacctctccctgccctccactctggttggtttgtggttccctcgaccgagggtttctagaatcagggaccttgtctaagttttgtttgcccagagcccagcgaagtgtgtgatacaccttgggagtttaggagatcacaaaagggatgaaaacacctttagaaaacatttcattggtggggcgtggtggcttatgcctgtaatcccagcactttggaaggctgaggcaggtggatcacctgaaggcaggagttcagaccagcctgaccaatatggtgaaaccccatctatactaaaaatacaaaaattagccgggtgtgggggcgtgtgcctgtttttgtgagactctgtctcaaaaaaaagaaaaaaatattgttaataagtgagtgttttcggctcaagggaattgagtcatacgttgcatctcccccagttctgcatcttatttgctgcgcttgctggagttgtaaagattggtcctaacagggaaagaagcacacaagagactgtgaaaagggctctgagacaagcaaggacaaaagagggagggaaataccttccacagggcctgggatctggcaatgctagagccttttttttttttttttt

SEQ ID NO: 76848 - DNA, 3596 bp, Homo sapiens
gtcgctgcggagcggaggcggggcgtagggcggggtcacgtggggctgcgcccaaggctgccgggagcagactgggctgcgggcggcggggccggcgcctgcctggagggatggggctgccgggcgcgtaggggccatgccgcccgggacccgggcctgccgcgttccgcgccccggccgccgcgccccacgtccgcgccgggatggtgaacctggcggccatggtgtggcgccggcttctgcggaagaggtgggtgctcgccctggtcttcgggctgtcgctcgtctacttcctcagcagcaccttcaagcaggaggagagggcagtgagagataggaatctcctccaggttcatgaccataatcagcccatcccgtggaaagtgcagtttaacttgggcaatagcagtcgtccgagcaatcagtgccgcaactccattcaagggaagcacctcatcacggatgaactcggctacgtttgcgagaggaaggatttgctggtaaatggctgctgtaatgtcaacgtccctagcacgaagcagtactgctgtgatggctgctggcccaacggctgctgcagcgcctatgagtactgtgtctcctgctgcctgcagcccaacaagcaacttctcctggagcgcttcctcaaccgggcagccgtggcattccagaacctcttcatggcagtcgaagatcactttgagttgtgcctggccaaatgcaggacctcatctcagagcgtgcagcatgagaacacctaccgggaccccatagcaaagtattgctatggagaaagcccgcccgagctcttccccgcttgacgggtgcagcggacttgctccagcctgggtgaggaggccccgctgaagaactcgccccctgggacctgcacagggacctgtgacttgtgttcatcgggggccggtgtcacttccagttttgatccaggctctttcactgtaaaattatttattggattcctttggagtaatgggaacattctaatgttttatgtaggaaaatgccttgccattctagttgaatatgttcaaggaaattatttttgttgttgttctgtgttctcgagtttcaggagttaaatcattcttccacccagatacaacattttctcttttaggacgtgaatattctctctaggcagttatttttgtttgtatttcgacagtatcaagcataggccctgaacgtgacctgttagccatatcctgacgtgtaaaattatctaaaaactcagacactcttccattctaatctaactgcacgatttctaacagtgggcaccatgtgcctgccctcaggttattttccagtggtagtcgaatgtgctcatataccctatggagagcactgttttagcagaaatctaatttctcttcctggaggaatttgttctcatttcttttgccacttaaaattaactgtgggctactcagccagggtacagtgggagcctcaggaaggtcagaggcaacctcctcccctgttctatcaatagaaacccaacgttgaggcaattcctaaacagacgcacctcgtagcttgctgtatgtgtttattctttattgctttcagctttggggctgtaacaggtacaaatatttggtttccctatgatttatagagaagaagaagaaacccagctttctatcagagcactgcaagagaagagtcttacacctgccctcagtgggagatgagaatggtcattatgacttagagaatgctacacgtgtaggttgctggtgtgtcctgaatccacaggcataaagcactccccatttttcctactgtaatgcagattctccggctcaaggtctagaatatttgatcctaagatcaagacatcatgcccttcgaatagtactgctctttgttttcaggagtcacgtgaacacacaactctcctatattcctcacgaacctcaggattgagcaaggtctttgtaatttttttggttcactttattgacctgggagcaaggtgctaattctgtggtcagtattcaatgtttttttcagtggagctttttctttgggccatatttgccttctaatacattcctgcaatatgtagtggtgatttcccttagcttcctcctactacctcttatactcatctccccaaattatttgcctcccttaaataagttttcctagaaggtaagctggtcaggcaatttgaaaaatattagatcccaagaaatctattccgtttgcattggacttctcggattccatgtgtttgcagcaggactacatcgaactctgatgtgccggattgtggcatgtctgcatgtctcatccatctattgtttttggtaactcagtttggaatttcagtgtctgtcttccctgggttgacattggaatcagcctctcctttgagcttattttaactcttgagcaacataacatagatttaatgtgaacagtttataccaaagggcagcctgtgcctgtttatggatcctctctgcctttgtacttgaagagcgcattttacatttccagtcctttcacagacaggagctccaaccttacgatggagaattaaacttgcttgtatttccactttgtggatgaggaactatgagaggtggagtgacttcctgggtccccgctgagacttagtgacagatcccagacaagaacttcatctctgactccaggtctagtcctcttccccctgtctcttgccaactccagccctgacaccgtgggcgtctcccctgagagcagatatatttcaattgtccaggccaaaagaggggcgaggcggcataaacacccaaattaggtggaggatccaaaagtcattttcatttggctgtggaatatgttttttgtatttcaatcagctaggggtgtgttcactgtttttggaaattcacagcgcttgagcctccataatgaagccgggctgcagagcacctggcacgtgctccaggctcccagctcccaacctaggacctctccctgccctccactctggttggtttgtggttccctcgaccgagggtttctagaatcagggaccttgtctaagttttgtttgcccagagcccagcgaagtgtgtgatacaccttgggagtttaggagatcacaaaagggatgaaaacacctttagaaaacatttcattggtggggcgtggtggcttatgcctgtaatcccagcactttggaaggctgaggcaggtggatcacctgaaggcaggagttcagaccagcctgaccaatatggtgaaaccccatctatactaaaaatacaaaaattagccgggtgtgggggcgtgtgcctgtttttgtgagactctgtctcaaaaaaaagaaaaaaatattgttaataagtgagtgttttcggctcaagggaattgagtcatacgttgcatctcccccagttctgcatcttatttgctgcgcttgctggagttgtaaagattggtcctaacagggaaagaagcacacaagagactgtgaaaagggctctgagacaagcaaggacaaaagagggagggaaataccttccacagggcctgggatctggcaatgctagagccttttttttttttttttt

SEQ ID NO: 76849 - DNA, 391 bp, Homo sapiens
gaatctcctccaggttcatgaccataatcagcccatcccgtggaaagtgcagtttaacttgggcaatagcagtcgtccgagcaatcagtgccgcaactccattcaagggaagcacctcatcacggatgaactcggtgaggctggcttcccttcctctccaggcggtcaggagcgtaggctggttgggccattcatagggtttttgtttgaatagggattcctctgcaacacattttctctcctcgctcatctccaacattccccaggtttttgtcttctataccctactcatcattcaaggttcccttcaacatcagagaagcttgttttgataactctaactcttaaaagttctttctgcctacaacttacaacatgagcactgtgtcac

SEQ ID NO: 76850 - DNA, 2141 bp, Homo sapiens
ctaagatccattttctaaactccaattgagcattctctgtatctgggtggtttttacttttttacttaatcttgcttgatcaggaactctggtgtcttcttggccccccacgtgatctcgttcatggtcacttttttgtttatctcattttctctgaggctggtccttcctgttaacgtcttggcatttgtgggaagcacaaaatgttcttgtctctccaactctgcttttcgctccctgccctgccattcctctcccgcgcctgccctctcccttccatctttcccaggtacttttctctcccagccctgccactcttctgccgcacctgcgctctcccctccatctttcccaggtacttttgagccttgactccccaggtcccttcattctgtgctcactccatgatgtcattttgttctccagttaaagaaagtacagacaataaccaccaagtcgaactcgatcaaacaggggaaaaaccaacttttccctgttgtcatgaatggcaaagaagatgttttgtggtgcactgagctcgaaaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaggggtgtgctgagttctataatataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaatttttttgtaactggagccacgacgtaacaaatatggggaaaaaactgtgccttgtttcaacagtttttgctaatttttaggctgaaagatgacggatgcctagagtttaccttatgtttaattaaaatcagtatttgtctata

SEQ ID NO: 76851 - DNA, 4256 bp, Homo sapiens
gaagggagagagcaaacaaaggggtcaggagggaaaataatgcactggcttcctgagcccctgcagaggctgagcagggagagggggccagggccagaggggacagaggctggcggcagacgggccgggacaggcaggtcctaaatggcattgtttgaaggggccggctaattgcacagagcagtctgagcctgagaccccagccctggcctccccactctgtcctgggtgctggcgtctgagccttcgggacagcctgtccacatggaaccaagtcctgagcctccaagcttggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggccgaagatcaagctcgcgactctccaagagggaggtgtccagtctgctaagctacacacaggacttgacaggcgatggcgacggggaagatggggatggctctgacaccccagtcatgccaaagctcttccgggaaaccaggactcgttcagaaagcccagctgtccgaactcgaaataacaacagtgtctccagccgggagaggcacaggccttccccacgttccacccgaggccggcagggccgcaaccatgtggacgagtcccccgtggagttcccggctaccaggtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtctctgcagacaaactggtggcactggggctgttcagccagcactttaatttggccaccttcaataagctcgtctcctatcgaaaagccatgtaccatgctctggagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccagagaacaagactcgaagacgcacagctgacgactcagccacctctgactactgccccgcacccaagcgcctcaagacaaattgctataacaacggcaaagaccgaggggatgaagatcagagccgagaacaaatggcttcagatgttgccaacaacaagagcagcctggaagatggctgtttgtcttgtggcaggaaaaaccccgtgtccttccaccctctctttgagggggggctctgtcagacatgccgggatcgcttccttgagctgttttacatgtatgatgacgatggctatcagtcttactgcactgtgtgctgcgagggccgagagctgctgctttgcagcaacacgagctgctgccggtgtttctgtgtggagtgcctggaggtgctggtgggcacaggcacagcggccgaggccaagcttcaggagccctggagctgctacatgtgtctcccgcagcgctgtcatggcgtcctgcggcgccggaaggactggaacgtgcgcctgcaggccttcttcaccagtgacacggggcttgaatacgaagcccccaagctgtaccctgccattcccgcagcccgaaggcggcccattcgagtcctgtcattgtttgatggcatcgcgacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatattgaagaatggggcccatttgacttggtgattggcggaagcccatgcaacgatctctcaaatgtgaatccagccaggaaaggcctgtatgagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggagtgtaatccagtgatgattgatgccatcaaagtttctgctgctcacagggcccgatacttctggggcaacctacccgggatgaacaggcccgtgatagcatcaaagaatgataaactcgagctgcaggactgcttggaatacaataggatagccaagttaaagaaagtacagacaataaccaccaagtcgaactcgatcaaacaggggaaaaaccaacttttccctgttgtcatgaatggcaaagaagatgttttgtggtgcactgagctcgaaaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaggggtgtgctgagttctataatataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaatttttttgtaactggagccacgacgtaacaaatatggggaaaaaactgtgccttgtttcaacagtttttgctaatttttaggctgaaagatgacggatgcctagagtttaccttatgtttaattaaaatcagtatttgtctata

SEQ ID NO: 76852 - DNA, 510 bp, Homo sapiens
cggccgcagcccgcgtggacgctccgagcgccccccgacggacgggaccggctccctggcggtcgggcgagcgggcggcaacgctgcccggccggcagcgctggggttaagtggcccaagtaaacctagctcggcgatcggcgccggagattcgcgagcccagcgccctgcacggccgccagccggcctcccgccagccagccccgacccgcggctccgccgcccagccgcgccccagccagccctgcggcaggtgagcgccccggggccccggggaggctcggccgccagctgcttcgagggctgctaggggaggggacggcgggggctcccgaagctgccggggagagaccctctccagggacctcccgaggaggggctctcgccgggttggagacccggctgggtttgcggggtgaggaaacgtccacggaccctgcttggggtggaacggggacagcgggtgggacgcgggggacatacgtctgacggggaccggagatactagag

SEQ ID NO: 76853 - DNA, 4205 bp, Homo sapiens
cggccgcagcccgcgtggacgctccgagcgccccccgacggacgggaccggctccctggcggtcgggcgagcgggcggcaacgctgcccggccggcagcgctggggttaagtggcccaagtaaacctagctcggcgatcggcgccggagattcgcgagcccagcgccctgcacggccgccagccggcctcccgccagccagccccgacccgcggctccgccgcccagccgcgccccagccagccctgcggcaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggccgaagatcaagctcgcgactctccaagagggaggtgtccagtctgctaagctacacacaggacttgacaggcgatggcgacggggaagatggggatggctctgacaccccagtcatgccaaagctcttccgggaaaccaggactcgttcagaaagcccagctgtccgaactcgaaataacaacagtgtctccagccgggagaggcacaggccttccccacgttccacccgaggccggcagggccgcaaccatgtggacgagtcccccgtggagttcccggctaccaggtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtctctgcagacaaactggtggcactggggctgttcagccagcactttaatttggccaccttcaataagctcgtctcctatcgaaaagccatgtaccatgctctggagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccagtggttaataagtcgaaggtgcgtcgtgcaggcagtaggaaattagaatcaaggaaatacgagaacaagactcgaagacgcacagctgacgactcagccacctctgactactgccccgcacccaagcgcctcaagacaaattgctataacaacggcaaagaccgaggggatgaagatcagagccgagaacaaatggcttcagatgttgccaacaacaagagcagcctggaagatggctgtttgtcttgtggcaggaaaaaccccgtgtccttccaccctctctttgagggggggctctgtcagacatgccgggatcgcttccttgagctgttttacatgtatgatgacgatggctatcagtcttactgcactgtgtgctgcgagggccgagagctgctgctttgcagcaacacgagctgctgccggtgtttctgtgtggagtgcctggaggtgctggtgggcacaggcacagcggccgaggccaagcttcaggagccctggagctgctacatgtgtctcccgcagcgctgtcatggcgtcctgcggcgccggaaggactggaacgtgcgcctgcaggccttcttcaccagtgacacggggcttgaatacgaagcccccaagctgtaccctgccattcccgcagcccgaaggcggcccattcgagtcctgtcattgtttgatggcatcgcgacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatattgaagaatggggcccatttgacttggtgattggcggaagcccatgcaacgatctctcaaatgtgaatccagccaggaaaggcctgtatgagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggagtgtaatccagtgatgattgatgccatcaaagtttctgctgctcacagggcccgatacttctggggcaacctacccgggatgaacagttaaagaaagtacagacaataaccaccaagtcgaactcgatcaaacaggggaaaaaccaacttttccctgttgtcatgaatggcaaagaagatgttttgtggtgcactgagctcgaaaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaggggtgtgctgagttctataatataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaatttttttgtaactggagccacgacgtaacaaatatggggaaaaaactgtgccttgtttcaacagtttttgctaatttttaggctgaaagatgacggatgcctagagtttaccttatgtttaattaaaatcagtatttgtctata

SEQ ID NO: 76854 - DNA, 4224 bp, Homo sapiens
cggccgcagcccgcgtggacgctccgagcgccccccgacggacgggaccggctccctggcggtcgggcgagcgggcggcaacgctgcccggccggcagcgctggggttaagtggcccaagtaaacctagctcggcgatcggcgccggagattcgcgagcccagcgccctgcacggccgccagccggcctcccgccagccagccccgacccgcggctccgccgcccagccgcgccccagccagccctgcggcaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggccgaagatcaagctcgcgactctccaagagggaggtgtccagtctgctaagctacacacaggacttgacaggcgatggcgacggggaagatggggatggctctgacaccccagtcatgccaaagctcttccgggaaaccaggactcgttcagaaagcccagctgtccgaactcgaaataacaacagtgtctccagccgggagaggcacaggccttccccacgttccacccgaggccggcagggccgcaaccatgtggacgagtcccccgtggagttcccggctaccaggtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtctctgcagacaaactggtggcactggggctgttcagccagcactttaatttggccaccttcaataagctcgtctcctatcgaaaagccatgtaccatgctctggagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccagtggttaataagtcgaaggtgcgtcgtgcaggcagtaggaaattagaatcaaggaaatacgagaacaagactcgaagacgcacagctgacgactcagccacctctgactactgccccgcacccaagcgcctcaagacaaattgctataacaacggcaaagaccgaggggatgaagatcagagccgagaacaaatggcttcagatgttgccaacaacaagagcagcctggaagatggctgtttgtcttgtggcaggaaaaaccccgtgtccttccaccctctctttgagggggggctctgtcagacatgccgggatcgcttccttgagctgttttacatgtatgatgacgatggctatcagtcttactgcactgtgtgctgcgagggccgagagctgctgctttgcagcaacacgagctgctgccggtgtttctgtgtggagtgcctggaggtgctggtgggcacaggcacagcggccgaggccaagcttcaggagccctggagctgctacatgtgtctcccgcagcgctgtcatggcgtcctgcggcgccggaaggactggaacgtgcgcctgcaggccttcttcaccagtgacacggggcttgaatacgaagcccccaagctgtaccctgccattcccgcagcccgaaggcggcccattcgagtcctgtcattgtttgatggcatcgcgacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatattgaagaatggggcccatttgacttggtgattggcggaagcccatgcaacgatctctcaaatgtgaatccagccaggaaaggcctgtatgagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggagtgtaatccagtgatgattgatgccatcaaagtttctgctgctcacagggcccgatacttctggggcaacctacccgggatgaacaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaggggtgtgctgagttctataatataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaatttttttgtaactggagccacgacgtaacaaatatggggaaaaaactgtgccttgtttcaacagtttttgctaatttttaggctgaaagatgacggatgcctagagtttaccttatgtttaattaaaatcagtatttgtctataaaaaaagaaaacacaagagacgggaaagcagaagagaagacaaagaaaaggaggggaggaaaaatcacagggagaaaaggaccatggtgagaggaccaggaaaagagggggaaaaagggagaaaagatagaaccgggg

SEQ ID NO: 76855 - DNA, 4149 bp, Homo sapiens
cggccgcagcccgcgtggacgctccgagcgccccccgacggacgggaccggctccctggcggtcgggcgagcgggcggcaacgctgcccggccggcagcgctggggttaagtggcccaagtaaacctagctcggcgatcggcgccggagattcgcgagcccagcgccctgcacggccgccagccggcctcccgccagccagccccgacccgcggctccgccgcccagccgcgccccagccagccctgcggcaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggccgaagatcaagctcgcgactctccaagagggaggtgtccagtctgctaagctacacacaggacttgacaggcgatggcgacggggaagatggggatggctctgacaccccagtcatgccaaagctcttccgggaaaccaggactcgttcagaaagcccagctgtccgaactcgaaataacaacagtgtctccagccgggagaggcacaggccttccccacgttccacccgaggccggcagggccgcaaccatgtggacgagtcccccgtggagttcccggctaccaggtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtctctgcagacaaactggtggcactggggctgttcagccagcactttaatttggccaccttcaataagctcgtctcctatcgaaaagccatgtaccatgctctggagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccagtggttaataagtcgaaggtgcgtcgtgcaggcagtaggaaattagaatcaaggaaatacgagaacaagactcgaagacgcacagctgacgactcagccacctctgactactgccccgcacccaagcgcctcaagacaaattgctataacaacggcaaagaccgaggggatgaagatcagagccgagaacaaatggcttcagatgttgccaacaacaagagcagcctggaagatggctgtttgtcttgtggcaggaaaaaccccgtgtccttccaccctctctttgagggggggctctgtcagacatgccgggatcgcttccttgagctgttttacatgtatgatgacgatggctatcagtcttactgcactgtgtgctgcgagggccgagagctgctgctttgcagcaacacgagctgctgccggtgtttctgtgtggagtgcctggaggtgctggtgggcacaggcacagcggccgaggccaagcttcaggagccctggagctgctacatgtgtctcccgcagcgctgtcatggcgtcctgcggcgccggaaggactggaacgtgcgcctgcaggccttcttcaccagtgacacggggcttgaatacgaagcccccaagctgtaccctgccattcccgcagcccgaaggcggcccattcgagtcctgtcattgtttgatggcatcgcgacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatattgaagaatggggcccatttgacttggtgattggcggaagcccatgcaacgatctctcaaatgtgaatccagccaggaaaggcctgtatgagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggagtgtaatccagtgatgattgatgccatcaaagtttctgctgctcacagggcccgatacttctggggcaacctacccgggatgaacaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaggggtgtgctgagttctataatataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaatttttttgtaactggagccacgacgtaacaaatatggggaaaaaactgtgccttgtttcaacagtttttgctaatttttaggctgaaagatgacggatgcctagagtttaccttatgtttaattaaaatcagtatttgtctataagaaaaaaaaacaacaaaacacaaacactacaacacaacaaacaacaacacaacacaaggggg

SEQ ID NO: 76856 - DNA, 4275 bp, Homo sapiens
cggccgcagcccgcgtggacgctccgagcgccccccgacggacgggaccggctccctggcggtcgggcgagcgggcggcaacgctgcccggccggcagcgctggggttaagtggcccaagtaaacctagctcggcgatcggcgccggagattcgcgagcccagcgccctgcacggccgccagccggcctcccgccagccagccccgacccgcggctccgccgcccagccgcgccccagccagccctgcggcaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggccgaagatcaagctcgcgactctccaagagggaggtgtccagtctgctaagctacacacaggacttgacaggcgatggcgacggggaagatggggatggctctgacaccccagtcatgccaaagctcttccgggaaaccaggactcgttcagaaagcccagctgtccgaactcgaaataacaacagtgtctccagccgggagaggcacaggccttccccacgttccacccgaggccggcagggccgcaaccatgtggacgagtcccccgtggagttcccggctaccaggtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtctctgcagacaaactggtggcactggggctgttcagccagcactttaatttggccaccttcaataagctcgtctcctatcgaaaagccatgtaccatgctctggagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccagtggttaataagtcgaaggtgcgtcgtgcaggcagtaggaaattagaatcaaggaaatacgagaacaagactcgaagacgcacagctgacgactcagccacctctgactactgccccgcacccaagcgcctcaagacaaattgctataacaacggcaaagaccgaggggatgaagatcagagccgagaacaaatggcttcagatgttgccaacaacaagagcagcctggaagatggctgtttgtcttgtggcaggaaaaaccccgtgtccttccaccctctctttgagggggggctctgtcagacatgccgggatcgcttccttgagctgttttacatgtatgatgacgatggctatcagtcttactgcactgtgtgctgcgagggccgagagctgctgctttgcagcaacacgagctgctgccggtgtttctgtgtggagtgcctggaggtgctggtgggcacaggcacagcggccgaggccaagcttcaggagccctggagctgctacatgtgtctcccgcagcgctgtcatggcgtcctgcggcgccggaaggactggaacgtgcgcctgcaggccttcttcaccagtgacacggggcttgaatacgaagcccccaagctgtaccctgccattcccgcagcccgaaggcggcccattcgagtcctgtcattgtttgatggcatcgcgacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatattgaagaatggggcccatttgacttggtgattggcggaagcccatgcaacgatctctcaaatgtgaatccagccaggaaaggcctgtatgagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggagtgtaatccagtgatgattgatgccatcaaagtttctgctgctcacagggcccgatacttctggggcaacctacccgggatgaacaggcccgtgatagcatcaaagaatgataaactcgagctgcaggactgcttggaatacaataggatagccaagttaaagaaagtacagacaataaccaccaagtcgaactcgatcaaacaggggaaaaaccaacttttccctgttgtcatgaatggcaaagaagatgttttgtggtgcactgagctcgaaaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaggggtgtgctgagttctataatataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaatttttttgtaactggagccacgacgtaacaaatatggggaaaaaactgtgccttgtttcaacagtttttgctaatttttaggctgaaagatgacggatgcctagagtttaccttatgtttaattaaaatcagtatttgtctata

SEQ ID NO: 76857 - DNA, 4026 bp, Homo sapiens
cggccgcagcccgcgtggacgctccgagcgccccccgacggacgggaccggctccctggcggtcgggcgagcgggcggcaacgctgcccggccggcagcgctggggttaagtggcccaagtaaacctagctcggcgatcggcgccggagattcgcgagcccagcgccctgcacggccgccagccggcctcccgccagccagccccgacccgcggctccgccgcccagccgcgccccagccagccctgcggcaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggccgaagatcaagctcgcgactctccaagagggaggtgtccagtctgctaagctacacacaggacttgacaggcgatggcgacggggaagatggggatggctctgacaccccagtcatgccaaagctcttccgggaaaccaggactcgttcagaaagcccagctgtccgaactcgaaataacaacagtgtctccagccgggagaggcacaggccttccccacgttccacccgaggccggcagggccgcaaccatgtggacgagtcccccgtggagttcccggctaccaggtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtctctgcagacaaactggtggcactggggctgttcagccagcactttaatttggccaccttcaataagctcgtctcctatcgaaaagccatgtaccatgctctggagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccagagaacaagactcgaagacgcacagctgacgactcagccacctctgactactgccccgcacccaagcgcctcaagacaaattgctataacaacggcaaagaccgaggggatgaagatcagagccgagaacaaatggcttcagatgttgccaacaacaagagcagcctggaagatggctgtttgtcttgtggcaggaaaaaccccgtgtccttccaccctctctttgagggggggctctgtcagacatgccgggatcgcttccttgagctgttttacatgtatgatgacgatggctatcagtcttactgcactgtgtgctgcgagggccgagagctgctgctttgcagcaacacgagctgctgccggtgtttctgtgtggagtgcctggaggtgctggtgggcacaggcacagcggccgaggccaagcttcaggagccctggagctgctacatgtgtctcccgcagcgctgtcatggcgtcctgcggcgccggaaggactggaacgtgcgcctgcaggccttcttcaccagtgacacggggcttgaatacgaagcccccaagctgtaccctgccattcccgcagcccgaaggcggcccattcgagtcctgtcattgtttgatggcatcgcgacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatattgaagaatggggcccatttgacttggtgattggcggaagcccatgcaacgatctctcaaatgtgaatccagccaggaaaggcctgtatgagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggagtgtaatccagtgatgattgatgccatcaaagtttctgctgctcacagggcccgatacttctggggcaacctacccgggatgaacaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaggggtgtgctgagttctataatataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaatttttttgtaactggagccacgacgtaacaaatatggggaaaaaactgtgccttgtttcaacagtttttgctaatttttaggctgaaagatgacggatgcctagagtttaccttatgtttaattaaaatcagtatttgtctata

SEQ ID NO: 76858 - DNA, 4086 bp, Homo sapiens
cggccgcagcccgcgtggacgctccgagcgccccccgacggacgggaccggctccctggcggtcgggcgagcgggcggcaacgctgcccggccggcagcgctggggttaagtggcccaagtaaacctagctcggcgatcggcgccggagattcgcgagcccagcgccctgcacggccgccagccggcctcccgccagccagccccgacccgcggctccgccgcccagccgcgccccagccagccctgcggcaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggccgaagatcaagctcgcgactctccaagagggaggtgtccagtctgctaagctacacacaggacttgacaggcgatggcgacggggaagatggggatggctctgacaccccagtcatgccaaagctcttccgggaaaccaggactcgttcagaaagcccagctgtccgaactcgaaataacaacagtgtctccagccgggagaggcacaggccttccccacgttccacccgaggccggcagggccgcaaccatgtggacgagtcccccgtggagttcccggctaccaggtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtctctgcagacaaactggtggcactggggctgttcagccagcactttaatttggccaccttcaataagctcgtctcctatcgaaaagccatgtaccatgctctggagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccagtggttaataagtcgaaggtgcgtcgtgcaggcagtaggaaattagaatcaaggaaatacgagaacaagactcgaagacgcacagctgacgactcagccacctctgactactgccccgcacccaagcgcctcaagacaaattgctataacaacggcaaagaccgaggggatgaagatcagagccgagaacaaatggcttcagatgttgccaacaacaagagcagcctggaagatggctgtttgtcttgtggcaggaaaaaccccgtgtccttccaccctctctttgagggggggctctgtcagacatgccgggatcgcttccttgagctgttttacatgtatgatgacgatggctatcagtcttactgcactgtgtgctgcgagggccgagagctgctgctttgcagcaacacgagctgctgccggtgtttctgtgtggagtgcctggaggtgctggtgggcacaggcacagcggccgaggccaagcttcaggagccctggagctgctacatgtgtctcccgcagcgctgtcatggcgtcctgcggcgccggaaggactggaacgtgcgcctgcaggccttcttcaccagtgacacggggcttgaatacgaagcccccaagctgtaccctgccattcccgcagcccgaaggcggcccattcgagtcctgtcattgtttgatggcatcgcgacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatattgaagaatggggcccatttgacttggtgattggcggaagcccatgcaacgatctctcaaatgtgaatccagccaggaaaggcctgtatgagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggagtgtaatccagtgatgattgatgccatcaaagtttctgctgctcacagggcccgatacttctggggcaacctacccgggatgaacaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaggggtgtgctgagttctataatataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaatttttttgtaactggagccacgacgtaacaaatatggggaaaaaactgtgccttgtttcaacagtttttgctaatttttaggctgaaagatgacggatgcctagagtttaccttatgtttaattaaaatcagtatttgtctata

SEQ ID NO: 76859 - DNA, 4156 bp, Homo sapiens
cggccgcagcccgcgtggacgctccgagcgccccccgacggacgggaccggctccctggcggtcgggcgagcgggcggcaacgctgcccggccggcagcgctggggttaagtggcccaagtaaacctagctcggcgatcggcgccggagattcgcgagcccagcgccctgcacggccgccagccggcctcccgccagccagccccgacccgcggctccgccgcccagccgcgccccagccagccctgcggcaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggccgaagatcaagctcgcgactctccaagagggaggtgtccagtctgctaagctacacacaggacttgacaggcgatggcgacggggaagatggggatggctctgacaccccagtcatgccaaagctcttccgggaaaccaggactcgttcagaaagcccagctgtccgaactcgaaataacaacagtgtctccagccgggagaggcacaggccttccccacgttccacccgaggccggcagggccgcaaccatgtggacgagtcccccgtggagttcccggctaccaggtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtctctgcagacaaactggtggcactggggctgttcagccagcactttaatttggccaccttcaataagctcgtctcctatcgaaaagccatgtaccatgctctggagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccagtggttaataagtcgaaggtgcgtcgtgcaggcagtaggaaattagaatcaaggaaatacgagaacaagactcgaagacgcacagctgacgactcagccacctctgactactgccccgcacccaagcgcctcaagacaaattgctataacaacggcaaagaccgaggggatgaagatcagagccgagaacaaatggcttcagatgttgccaacaacaagagcagcctggaagatggctgtttgtcttgtggcaggaaaaaccccgtgtccttccaccctctctttgagggggggctctgtcagacatgccgggatcgcttccttgagctgttttacatgtatgatgacgatggctatcagtcttactgcactgtgtgctgcgagggccgagagctgctgctttgcagcaacacgagctgctgccggtgtttctgtgtggagtgcctggaggtgctggtgggcacaggcacagcggccgaggccaagcttcaggagccctggagctgctacatgtgtctcccgcagcgctgtcatggcgtcctgcggcgccggaaggactggaacgtgcgcctgcaggccttcttcaccagtgacacggggcttgaatacgaagcccccaagctgtaccctgccattcccgcagcccgaaggcggcccattcgagtcctgtcattgtttgatggcatcgcgacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatattgaagaatggggcccatttgacttggtgattggcggaagcccatgcaacgatctctcaaatgtgaatccagccaggaaaggcctgtatgagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggagtgtaatccagtgatgattgatgccatcaaagtttctgctgctcacagggcccgatacttctggggcaacctacccgggatgaacaggcccgtgatagcatcaaagaatgataaactcgagctgcaggactgcttggaatacaataggatagccaaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaggggtgtgctgagttctataatataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaatttttttgtaactggagccacgacgtaacaaatatggggaaaaaactgtgccttgtttcaacagtttttgctaatttttaggctgaaagatgacggatgcctagagtttaccttatgtttaattaaaatcagtatttgtctata

SEQ ID NO: 76860 - DNA, 421 bp, Homo sapiens
ggttctttttctattgtctgtttttccctcttcattgaatttcttagcacagctggccttttttattgtatccctgacactatatgtgaaggagagcagaggctctagatgttgttcttccagagaagatttaacttccctggtagcagctagagtgcaagcaaaccatcttagtccagccaaggcctgtaatagctggaggttggtcacaatatttgtaaagctatgtcaactgctcatttgcccgtactactagttttgtagccctgcaggagtcccggctgagagcttcacatgttattatgacctctccttggaaggtcctggttctgttgtactaaaagactagaaaattctggatttctgcttaactttaatcttttgccctgtaaagcttaagaattcaataaaatgtttgagt

SEQ ID NO: 76861 - DNA, 1102 bp, Homo sapiens
ttcttctcaggtgggaaattggcaagtggagtccatgtagtctcacatgtggggtcggcctacagaccagagacgtcttctgcagccacctgctttccagagagatgaatgaaacagtcatcctggctgatgagctgtgtcgccagcccaagcccagcacggtgcaagcttgtaaccgctttaattgccccccagcctggtaccctgcacagtggcagccgtgttccagaacgtgtggcgggggtgttcagaaacgtgaggttctttgcaagcagcgcatggctgatggcagcttcctggagcttcctgagaccttctgttcagcttcaaaacctgcctgccagcaagcatgcaagaaagatgactgtcccagcgagtggcttctctcagactggacagagtgttccacaagctgcggggaaggcacccagactcgaagcgccatttgccgaaagatgctgaaaaccggcctctcaacggttgtcaattccaccctgtgcccgcccctgcctttctcttcctccatcaggccctgtatgctggcaacctgtgcaaggcccgggcggccatccacgaagcacagcccgcacatcgcggccgccaggaaggtctacatacagactcgcaggcagaggaagctgcacttcgtggtggggggcttcgcctacctgctccccaagacggcggtggtgctgcgctgcccggcgcgcagggtccgcaagcccctcatcacctgggagaaggacggccagcacctcatcagctcgacgcacgtcacggtggcccccttcggctatctcaagatccaccgcctcaagccctcggatgcaggcgtctacacctgctcagcgggcccggcccgggagcactttgtgattaagctcatcggaggcaaccgcaagctcgtggcccggcccttgagcccgagaagtgaggaagaggtgcttgcggggaggaagggcggcccgaaggaggccctgcagacccacaaacaccagaacgggatcttctccaacggcagcaaggcggagaagcggggcctggccgccaacccggggagccgctacgacgacctcgtctcccggctgctggagcagggcgg

SEQ ID NO: 76862 - DNA, 989 bp, Homo sapiens
ttcttctcaggtgggaaattggcaagtggagtccatgtagtctcacatgtggggtcggcctacagaccagagacgtcttctgcagccacctgctttccagagagatgaatgaaacagtcatcctggctgatgagctgtgtcgccagcccaagcccagcacggtgcaagcttgtaaccgctttaattgccccccagcctggtaccctgcacagtggcagccgtgttccagaacgtgtggcgggggtgttcagaaacgtgaggttctttgcaagcagcgcatggctgatggcagcttcctggagcttcctgagaccttctgttcagcttcaaaacctgcctgccagcaagcatgcaagaaagatgactgtcccagcgagtggcttctctcagactggacagagtgttccacaagctgcggggaaggcacccagactcgaagcgccatttgccgaaagatgctgaaaaccggcctctcaacggttgtcaattccaccctgtgcccgcccctgcctttctcttcctccatcaggccctgtatgctggcaacctgtgcaagtaagtatgtcagggctctgggaatggggagatgaaacccacacagcagcagctatagccaccacgccgtggccttccctaaactcaagacctgtgggaaatagtgggacagtagaaccccatggagggctgcaggcaggagagctcagctggagacggaaaaggaatcttaattacacgtggccaggctaaattctcctctccactggaaaaacagtttgcaggggggtagagcaaagttcacttgctggcatacagagatctggaagctggaggcagtgtattactaatgatgtctaatgttatccactctggggttttaaacgactctaaacagatttgttctgtttaatattaatccctagatcctcgacccctggggggcatccggacacacacatctagggattggttgccaggtagtagtagtagtg

SEQ ID NO: 76863 - DNA, 774 bp, Homo sapiens
tctcattcaatccagccctttaggaatctcgtagacagatagtactctaaagggaaagatttgaatgtgtcactgtggccctggcccaggcaaatcattttgagcagctcctgtctgctgtgcattcttccaggacacaaagccgggggggaagacatggtctgaggctctcaaggaaataatgtgctgcaaagccaagctcgttagttctttatgaagtgagggacaaagatctgttcattcagcagagccgtggtatgtgcctgttaaatcgggcactgtgcaagccaatagggtgaagatatacatattaatgagacacagccctaatctttaggagctcaaactttagttgtgggagagacagtcaagtccattaaaatatacacagtgctaagtgtttaacagtagcctttgttaaggctacagagcacaaagggaaagagtaacaaagcgcctgggggaggtgggagagcttagagaggaggtagcgttctgagttggatcttgaaggctgtggtattgaacctccaaagcggggagagaggctctctcagcgcaaagaccaaggtattataaagtgcgtacagtagcagctacttactatggctggatgatgatgataattttatctaatatttatgtaatccgtagaatgtatcagttatgtcttttcctatttaatcttcagaaatagaaacagcccaacaatttaggtaagtatagcccccattatcctgcactccagcctgggtgacaaagcaagattatctc

SEQ ID NO: 76864 - DNA, 720 bp, Homo sapiens
tctcattcaatccagccctttaggaatctcgtagacagatagtactctaaagggaaagatttgaatgtgtcactgtggccctggcccaggcaaatcattttgagcagctcctgtctgctgtgcattcttccaggacacaaagccgggggggaagacatggtctgaggctctcaaggaaataatgtgctgcaaagccaagctcgttagttctttatgaagtgagggacaaagatctgttcattcagcagagccgtggtatgtgcctgttaaatcgggcactgtgcaagccaatagggtgaagatatacatattaatgagacacagccctaatctttaggagctcaaactttagttgtgggagagacagtcaagtccattacaaagggaaagagtaacaaagcgcctgggggaggtgggagagcttagagaggaggtagcgttctgagttggatcttgaaggctgtggtattgaacctccaaagcggggagagaggctctctcagcgcaaagaccaaggtattataaagtgcgtacagtagcagctacttactatggctggatgatgatgataattttatctaatatttatgtaatccgtagaatgtatcagttatgtcttttcctatttaatcttcagaaatagaaacagcccaacaatttaggtaagtatagcccccattatcctgcactccagcctgggtgacaaagcaagattatctc

SEQ ID NO: 76865 - DNA, 113 bp, Homo sapiens
tttttttccagaaaacttttaaatgttttctctgatttccactggggcagatttttacaaaatttttaagaaagactaacaagagctttgaagacgtgggattttgatttctt

SEQ ID NO: 76866 - DNA, 693 bp, Homo sapiens
gctttccatttattaactcatctcacattcacaaatgaccccataaagtaagcactattgttatccccattgtactgacagggaagctgaggtccagaggagcttgggtgccttgctcgaggtcacacagcttgtgagtggtggttggagctgaggaaacgtgagaaattgttgttcccaagctgtgaggtgccacatgggggccaagataaaattattctttttctttttagagatagggtctcaccatcattcaggttgtagtacagtggcgcaatcatggctcactgccacctccaactcctgggcttaagggatcctcccacctcagcctcctgagtagctgggtctacaggccagtgccaccatggtgggctaatttttaaaagtttttattttccatagagattgggctttgccattttgcccaggctggtcttgaactcgtgggctgaagcaatccggctccgtcaacctcccaaagccctgggattacaggcgtgagccactgtgcctggcctgttctccatttttttacttctttctctgcgtccagattgatccccttgaacactaatttaggggacactaaaaatctgctacatttgctggttattttctaaattaacatttaaaagttgcgtatttccttatcaaggtatgagaatgatttaaaaaaaaaaaaaaaaaaat

SEQ ID NO: 76867 - DNA, 393 bp, Homo sapiens
tattgtgtgcagcgcacagagcctagtgtcagtgtttctctggggattgaagcagacagttctgccaaccagcatggatgggggaatagcctgggcaggatgcaagccacatcgtgcagaatatgattcttagtggaatagaaagccaagtgccatggaagccaagacacgtgcaggcttaccaagatgccccaagccattggagagaatatggagtttctcagtgcacagaagattcagaagatttacttaaacttaaagggcaagtagaccttaagaagctgtaaaacttgaggacatccaagattctgacatatgaaatataatttctttggcacctatggtataccatacactcttagctactaaacttagctactttttgaatgcatg

SEQ ID NO: 76868 - DNA, 648 bp, Homo sapiens
ttccaccattaatataaaatgtgtgcattttcttttatggtagaaaattcacactacaggaacattgatcatatgctttctgctttagtttctataaagaatgagtcacagagaagacaattgctttatttcaatgcctaggaagttattgcctttcaccttttgagcatctgtgttgcacacttaatggaaatacttgaaatataatattgatctacttatcaaattatagtaaatatgaagtaagaaacatcacatggtaacaattattcctttcactcaatggacatgattagcgagaaaataataaagaaatatttcgtatttgcagcctacctttaaagtattgaagcataattgtgaaacatttacaagttgctgagttgtcacttgtggaaatacaaaaaagaaaaagaaaaattgataaaccattgtcttatgatttcaaaaatttcacgggaagggggcagataataagtggttttatgcctataagttatttagaattccacatatttttaaaagggggttttaatatgttgttatttgacctgctttgagatgtctacagtcttgacttcttgatatctttgtatcttgttacagtcttattattacaagcagtgttaggcaattaaatttggaatt

SEQ ID NO: 76869 - DNA, 274 bp, Homo sapiens
cagagagagactctgtcaaaaaaaaaaaaaaagaaaggaaggaaggtaggtaggtaggtgggtatttggggccagctggcctgtaatcccagcacttggaggctgaggtgggtgaatcacttgaggtcaggagtttgagaccagcctggccaacatggtgaaaccctgtcactactaaaaatacaaaaattagctgggcgtggtagtgccacttgtaatcccaactactggggaggctggaacctcggaggcggagattgcagtgggctaagat

SEQ ID NO: 76870 - DNA, 414 bp, Homo sapiens
aacttgaccaatttaaacaaaaatgtaatttctctgtcctgttggtgtaatgtaatcaagagtttgtgataggaaattaatttttcaaccagtgatacaattttatgactgaatttaatatggacctgttaatgtgacattttcatgtttctgttgagtctgccttgatgaataactcagagcacttattctgtggtacacagagtcagtatttctcatttctggaattggatgctttattttctggtatgcctgtgataagagaggtgatagagtggcttctgcatctaattggtttgaatcctggtattacacttaactgatttgggcaaatgtatcctcgaggctcgatattttgttttgtttttctcccctgtaagagcactcactgctgtcttagcttgggctgctgtg

SEQ ID NO: 76871 - DNA, 357 bp, Homo sapiens
  misc_feature (249)..(249): n is a, c, g, or t
attcttgcacttacaggatcgaggtccccattttcttgctggctgtcagccgagggccattcccaccttctagagccctccacacattccttagctcatagcccccggcttttgtcttaaaagccagcagtggtgggtcaggtgcttctcatgtcacatctctctgacttactcttctggttccctttttcactttgaaggacttgtgtggttagatagatcgggccctctgtggttagatagatcggngccctctgtggttagatagatcgggccctctgtggttagacgggtcgggccctctgtggttagatgggtcgggccctctgtggttagataggtcgggcctcctggata

SEQ ID NO: 76872 - DNA, 570 bp, Homo sapiens
agtagatgtaactttttaaaaaggaaatggcttataacatcaagtgctccagaaaaaatcaaaatcttttgattttccagggagaatggcaaaaaaaggggaaaaagaatctttggtgaggaaggccttcaggaaaaagcaaccagtccagaaagatcaaaatcaagaaagactgtacatagagtgtgcacaccatcagttcagagtgcaagagtgggggtagggggctaaagtctggctctcgtgggcagaagaggtgggcacagaaagcagagcaagcagcacgaaccattcccgagagagcctgactatgaaggggagagaacaaatggcacttgtctcacagactctggggcagtgcccaggaaattaaatttaggactatatatcaatttaaaagtactggatagagtaacgaaagtgatgttttcagtaagtgttgtacagcagaaggcttgtttttgttgattttaaaaatctttcatgggagattggagagatgctggtaaaaaaaaatacagcattaaaataaaatctttcactataaaactagctagtacggccaggagt

SEQ ID NO: 76873 - DNA, 429 bp, Homo sapiens
atattacgttactgaaactgaaataataaaaaggtcaagtgtattagaaatcttagctacagaacagtaaaaactttcttcaacaggagactgatatcatttaattcttatttcatttttgtgtactaattatacagcataaaaatgtttaaataaaaagtcacctattaacactcacataacacagaacattacaattaatgtttactttcatcttttaaagatgttcttcagaaatcttcatttaaatcattaagtgtctcatgaaaaattattcagagaaaatgataggaaagtaaaatcagtatctgtatacctatcacctacatttgataactaaattaaaaccaagagttagccatatttatttgctgctttgtatttgttcaaacacaaataaaatgagtcactgaactgacagtccagata

SEQ ID NO: 76874 - DNA, 345 bp, Homo sapiens
gtgacctctgaaactaggggataaaaggcattgctgcttcctccttgttctctactaaatcactcactccgggggaagccagccaccgtgtcgtgaggacatttaagcagccctagagagaggtccgcaaggtgagaaactgaggccgcctgccgacagccatgtgagggagccaccttggaagcagatctagccccagtcaaacctccagatgcctgcagctccaagcaacaccttgactaccgcctcagaagaaaccctgggccagaaacaccaggcaaagccaatcttggatttctgacccacagaaactactacataataaatattgttttaagtctctaa

SEQ ID NO: 76875 - DNA, 711 bp, Homo sapiens
tggaacacagctataggcttctgggagatagtttattaaatgccatgcagaatgctatgtttttagatgtgcatgtaaatcaagaattagctgaggaatatctttttattagtagtagtagtaactcatttttagattcaagtaaagtttgttttccaggtgagatgacatttttaagaaattgaatttaagtatgtgcttttatatccggaccaggtttctcaaggaagcagaatacaagggaatgaaaggggaagggagggtagtgcccaagagaaacctcggctcctaagtgctcccctgccaggtttcccccgtgcctgcccactggcaccatcctggcagctccagcccacaccccctcctggaccctgggctgcctctcgctgaatagctgcagggggcctgctatgtgacaggtatggaatgaggtaatccttttccacctctaatttctgaagggtgtgtctgtccagtttttacttgttcattgaatttaaagccttaggaaccaacagctacagtgcaagctgtaattattgatgtctgtttcatattcatctgtaagttctggcatttgatcaagaagtcaatatatcacttcatcttcaggctgaatgtgtctcagctataaaggttttattgtttgatggatagcatacaattatgactgcccacaataaaaagtgttttcatttgtaagatgggtga

SEQ ID NO: 76876 - DNA, 547 bp, Homo sapiens
gtagctataaaatttaggaactatatgttctcccccactgctttagagtaacctctggatttttcccaagccatgacagaatggcattagacttactctccaatcaaaatacaacacatggcaagacacacaaggcagctattttcaggaacacacaggcagcattgtgatccttgagagaatacaaagactgaaagtctaagatcaagatgccagcagagttggtgtttggagagtgcttcccctgtgggttgcagacttctcactatatcctcaagtggcttttcctcagtgtgtgcacaagggaagaaagagagagggctctggtctctcttcttacaagaacattaatcctatcagatcagggccccacccttgtaacctgatttaaccttaattacttccttaaacactccatctccaaatacagtcacactgaggattagggcttcaatatgtgaatctgggggagacaaacattcagtccataataatacttaacactactgaattgtatgctttaaaataattaagatcattttttaaa

SEQ ID NO: 76877 - DNA, 814 bp, Homo sapiens
cttccggttctgtcttttcgctggctcgatacgaacaaggaagtcgcccccagcggagccccggctcccccaggcagaggcggccccgggggcggagtcaacggcggaggccacgccctctgtgaaagggcggggcatgcaaattcgaaatgaaagcccgggaacgccggaagaagcacgggtgtaagatttcccttttcaaaggcggagaataagaaatcagcccgagagtgtaagggcgtcaatagcgctgtggacgagacagagggaatggggcaaggagcgaggctggggctctcaccgcgacttgaatgtggatgagagtgggacggtgacggcgggcgcgaaggcgagcgcatcgcttctcggccttttggctaagatcaagtgtagtatctgttcttatcagtttaatatctgatacgtcctctatccgaggacaatatattaaatggatttttggagcagggagatggaataggagcttgctccgtccactccacgcatcgacctggtattgcagtacctccaggaacggtgcaccccctccggggatacaacgtgtttcctaaaagtagagggaggtaagagacggtagcacctgcggggcggcttgcacgccgagtgcctgtgacgcgccggcttgacttaactgcttccctgaagtaccgtgaggttcctgatgtgcgggcggtagacggtaggcttatgcggcacgctttcgtttccaccgtggctactgcgctttgggaaggccacgacctcctcctttggggaggtccttaggatccgaaaaaaaaaaagtcacttgtaa

SEQ ID NO: 76878 - DNA, 1057 bp, Homo sapiens
cttccggttctgtcttttcgctggctcgatacgaacaaggaagtcgcccccagcggagccccggctcccccaggcagaggcggccccgggggcggagtcaacggcggaggccacgccctctgtgaaagggcggggcatgcaaattcgaaatgaaagcccgggaacgccggaagaagcacgggtgtaagatttcccttttcaaaggcggagaataagaaatcagcccgagagtgtaagggcgtcaatagcgctgtggacgagacagagggaatggggcaaggagcgaggctggggctctcaccgcgacttgaatgtggatgagagtgggacggtgacggcgggcgcgaaggcgagcgcatcgcttctcggccttttggctaagatcaagtgtagtatctgttcttatcagtttaatatctgatacgtcctctatccgaggacaatatattaaatggatttttggagcagggagatggaataggagcttgctccgtccactccacgcatcgacctggtattgcagtacctccaggaacggtgcaccccctccggggatacaacgtgtttcctaaaagtagagggaggtaagagacggtagcacctgcggggcggcttgcacgccgagtgcctgtgacgcgccggcttgacttaactgcttccctgaagtaccgtgaggttcctgatgtgcgggcggtagacggtaggcttatgcggcacgctttcgtttccaccgtggctactgcgctttgggaaggccacgacctcctcctttggggaggtccttaggatctcagcttggcagtcgagtgggtggcgaccttttaaaggaatgggacccacccggagttcttctttctcctgtctctctctctctctctctctctctctctgtctctccgtctctctgtgtctctgtgtctgtctctctctctctgtgtctctctctgtctctctgtctctctctctgtctctctctctctctctctctctctctctctctctcctctctctctgtctctctctctctttccctctctctctctctttcccccccccc

SEQ ID NO: 76879 - DNA, 701 bp, Homo sapiens
  misc_feature (6)..(6): n is a, c, g, or t
  misc_feature (16)..(16): n is a, c, g, or t
tagagnaagcacattnggcacgagggatcaagtgtagtatctgttcttatcagtttaatatctgatacgtcctctatccgaggacaatatattaaatggatttttggagcagggagatggaataggagcttgctccgtccactccacgcatcgacctggtattgcagtacctccaggaacggtgcaccccctccggggatacaacgtgtttcctaaaagtagagggaggtaagagacggtagcacctgcggggcggcttgcacgccgagtgcctgtgacgcgccggcttgacttaactgcttccctgaagtaccgtgaggttcctgatgtgcgggcggtagacggtaggcttatgcggcacgctttcgtttccaccgtggctactgcgctttgggaaggccacgacctcctcctttggggaggtccttaggatctcagcttggcagtcgagtgggtggcgaccttttaaaggaatgggacccacccggagttcttctttctcctgtctctctctctctctctctctctctctctgtctctccgtctctctgtgtctctgtgtctgtctctctctctctgtgtctctctctgtctctctgtctctctctctgtctctctctctctctctctctctctctctctctctcctctctctctgtctctctctctctttccctctctctctctctttcccccccccc

SEQ ID NO: 76880 - DNA, 177 bp, Homo sapiens
cttctactgcaaattcgtcttgtgatatcaacaaaggcatttacatgtgcccctagcacagagcctggcatccagaagtgttccataagcagcagcagttattgtgatgattattactgtgactattattaagagtttgccattctgcaaatagttgccttttttccattcctttag

SEQ ID NO: 76881 - DNA, 358 bp, Homo sapiens
ttcactagcctcacagatatcttgctggtgtcttaattggcatgttttgattacttgtgagattgaatatatttttgtatgaaatattaaatattttcgtatttatttcttggtcattagtattttatttatgtatttatttatttatttattttgaggcagcgtctggctctgttacccagactggagtgcagtgacacaatctcagcttactgcaacctctgtctcactggttcaagtgatcctcccacctgagtagctgggactgtaggtgtgcaccacacagcctggataatatttgcatttttagtagagatgaggtttcgccatgttacccaggctggtctcaaactcctgg

SEQ ID NO: 76882 - DNA, 452 bp, Homo sapiens
ttacatgaataagttctttagtggtgatttctgaggttttggtgcacccatcacccaagcagtgtacactttacccaatgtgtagtcttttatctctcacctgcctctcaccctttcccaagtccccaaagtccattgtatcatttttatgcttttgtatatcctgtgttattcctaaaataaattggagtagtttaacaatgaaaaataaaaagactaaacacataatagggtcttactccatgccaggcagaggcattcattattacatttgactgtcactaaaatctaaaggactatatttaattccattttcagatgaggaaaggaaattaagttacagaaattaagccagttgtttaaagctaaacagtgataagtgatagagtcaggcttgggatccaggccaactgactccagatccagggctggctgacttaaccatgatgctc

SEQ ID NO: 76883 - DNA, 391 bp, Homo sapiens
tcagacagccaggctggtctttgtggagttatttttggtaacttcccaggtgaaacaaggaacatgggtggaactgagcctccctgaggatgcctggggtcctgatccaggtccaatcatctccgaaaaaggcagctaagggtcctcttgcccaaagtgcatccagcagcctaccttatataatgtgtctcttaggaggcttcccccaagtatcttagcatctatttatgtatccctgaataaaaccctatttggttttgcacatttgcaaactttatataaacagagtcactgggtttacattagtttgcaaattgcttcttctactcaacattgttgctgagattttttttttccaggttaatgcatgaactgtaattcatttattttt

SEQ ID NO: 76884 - DNA, 507 bp, Homo sapiens
gctccagcagccacggaacatggatctgagccccgagagattcctggatgtgggagacccaccctctgtccttggtggttggtgagggctgcaggattggggcttctgatgttattgtcctggggacagactccctgggcaggatcacggagggggcagactgagctgggacaaggggcattcgggcctcgggcagtggggcaggccctagagtggcagccagtcatcacagtgatttccctgaacgggcaatgttcctttccaggcttagtgccctggcggcctcggggaagtggagaaaagagaggggcaccagggttacgattctcagcttactgaggtctgatgtgaatggcatgcaagcctctggccaggaccggccagtgccaccttctgagcatgttctgagtgttgactctgcgccgggcacgggagatgaggctccggctctgtggagctgcatccggctggggagagatggacaagagagagcaaacacccccgtgc

SEQ ID NO: 76885 - DNA, 384 bp, Homo sapiens
aaagaattcacagttaaatatgtaccacataacacagcaacaatctgtataaagcaaaatctatatgaagtataagaagaaataaaaaactaaaattaggggactttgacacttagcacaagatgtagtgggtaaaaaaggatataaaagatctaaataatataatgtgaatcttcaagtatatccctaataatcaagaatatactgcttccccccacccccaactctgtctcccaggctgcagtacagtggcatgatcacggctcactgcagccttgacctccctgcctcaggtgatcctcccacctcagcctcccaagtagctgagaccacaggtgcacaccaccatgcccagctaattttttttttttttttgcttattgt

SEQ ID NO: 76886 - DNA, 713 bp, Homo sapiens
atgtgctaccttgtttcaccttttaaaaacaacaagcaaataattatactctgctttataatgtggtggaatgtatacaaatactttcttccataatttttgagagcagtaactgtgtctcaccaatcttcatattctccactgcactgaccatagcattttgaatataatttggaatcaattaaatacatgaacaaacaagtaaaattttatggtgcagggaaagtattattattattttttaaaagggctctgagatataatctacttttctgggatagtaccaaataaaaatgaaatcaagaatttaaagcattctgaaaatactgagaaagaccattaaaaaaaagaaggctaagagtttgtttaaaaatatgagaaataaaaaaaagatccatataactgactatagcaaaagcatgtgttttctgaagtaagtaaggcagaaagtaaaatagacatccttttaatacctctcatatctatgcagagatggccaaggtctggtagtgattttcatgatgatgggtctgggaagcttattattttgtaaccagttttattacctgcccccagcaaaaggcatttgtttaccttctttcctcttttattcactttagacgtgaagagaagtatcactgcttcagtattaggctatttcaataagcaaggcaattttattacagatatcagatgcaacacatatttggtaa

SEQ ID NO: 76887 - DNA, 748 bp, Homo sapiens
ttgtatttctagctgaaaatgtcattttttttaatggtactagtcataattccagtgggtttgagagagttctgggagatatggtgaatacgaactaactaagcaaaatgattttaaagtttatgtagaattctaagcttatgctgaaaagacagtatagcgtagtgcttaagagaactgactctggggtcaaactacctgagttcatatatttgaatgctctactgctagctaagtgcatttttctgtggctcattctccctgtctgtgaagtgaggatattagttcctatctcttagaaatgttttgtggataaaacaagttattacatataagccacttatgatcgtgctttagatatagaaaattcttaataaatgaattgctattagcgttatagaaattaaacaaaattttagaaaaagggctagataagggaaacttgcttatatattcaagttggttgaattaagttacatattaagttataacaaattatgccataagtctagtataatcaaagcagtaaagcattgtcatagaaatatacaaatagattagtgaaactaaagaatccaaaaatgcctgaaccatgtttaaaaatgacatttaaattaaaaagggaaatctggtttaacagtggtggagacaactggctatttggtgggaataaacagacccacctactatcatcagaaataaatgccaaataggttaaaaatacaaaagtgagcaagcaagagagaca

SEQ ID NO: 76888 - DNA, 346 bp, Homo sapiens
ctgctgccatgcaaccaacttttcctccaaaggcccagtagcaagtattttaggttttgtgggccttaaggtaggtctctgtcacaaccacttaactctcctgttgtagcacaaaagcagctatagacaatatttaaatgactggacatagctgtgtcccagtcaaactatttacaaaagtaggctgcaggctggatttggcctgtgggtcattgtattataaacagggtgatccttgataaaatgaaatatgggcatgtcactcacttaactctaacccctgcaatgatttctcaagcactaagtttacagtactcagtttggtctgcatggcctagttgatcca

SEQ ID NO: 76889 - DNA, 797 bp, Homo sapiens
ctgagttctatgttactaggggtcttgtgtgcacatctcttagcgtgtgtgtatatgtgtctgtgcacacacgtgtaatgagtggtatacttacctgacatcagtgtgtgccgacgttcttcagcctatgggggcctccatgtccctccttcctggtgttccttcttttctggggcagctgccatttctttgattcctgcatctctcctacagcctgacctcttcttcaaggcaggattgggggagagggtctgggctgcccctccccaacacctagattccctccttccacatcctgttagcctcctttttggcagttttttccatcttcgccatctggcctggcactgtgcccattcagctcctgaagggagccccagggctcgggaagcagaagtgtgggatggggaccaggccaggggcctggcagctctcagtgctcagcttgggccgttctgtgtgactgtcagaaagaggcggctttttgaccaccaggatcctttataaagatgggctggggccaggtgcggtggctcatgcctataatctcagcactttgggaggccgagccgggtggatcaactcaggtcaggagttcaataccagcctgaccaatatggtgaaacctgtctctacttaaaatacaaaaattagccaggcatggtggcgtgcacctgtagtcccagctactcaggaggctgagacaagagaattgcttgaacctgggaggaaaaggttttagtgagctgagactgtaccactgcaatccagcctgggcaacggggaactccgtctca

SEQ ID NO: 76890 - DNA, 455 bp, Homo sapiens
tgctctgccagttaaaaactcaattggaaaggaaggatgttgggtgtaaagaggcaagggcctcacagacagatttaagtgctcttctttgtttgaattaaaagaaaatgtggttctatgttttaattaaaagatagcgtttcagaggaatttgcttagagaacccagaagtgcctaatcttggtcagccaagctaccattcttgtatgccttgtcaagtatgtgaaggggcatagcataaaaggataaaaagccaagtgagagtcaaaattctgcttaatttttaacagactagcataagcttctctgggatcaactggctataatctcatgatttacgtttaaagtataagcagtgcctcctgctttcccactaagtttgactccagttcttgggattgtatcacctaattcctggctgtagtaactcataccagtggccagtatccagagaa

SEQ ID NO: 76891 - DNA, 439 bp, Homo sapiens
aggccctgagccaggcccggctctcagggcgggagacacaggagaggttgtgcgggtccctggagcagtcgggaaccagaggggaggggatttattgagcaaggggctctgctgaaccctcccctgcatcacttcctcgcttcctcagagttgctctgtgaggaagtaccatcgttgtccccagtttacataaggaaaccaaggctctgagaggtgacatgacttacccaaaatcccacagctcaagatgatgggcctcaccccaacccctctggaaaagcctgtccagactgggagagaagggtcagtgaggcagggacagcgggattattgccacccccatttcctcaagataaacaggcacagcagggcaggtggactgcccaatctccgtgtcattgagtgggactgctgacctctgaccctctgcctccctcta

SEQ ID NO: 76892 - DNA, 470 bp, Homo sapiens
cctggcctctgatgttatccatgcccaatccagggacctgccacgcatctttagggtgacaacctcccagctggcagtgccgcccaccacgtgcactgtgctgctgctggcagagagcgagggggagcgggaacgctggctgcaggtgctgggtgagctgcagcggctgctgctggacgcgcggccaagaccccggcccgtgtacacactcaaggaggcttacgacaacgggctgccgctgctgcctcacacgctctgcgctgccatcctcgctcaagatgatgggcctcaccccaacccctctggaaaagcctgtccagactgggagagaagggtcagtgaggcagggacagcgggattattgccacccccatttcctcaagataaacaggcacagcagggcaggtggactgcccaatctccgtgtcattgagtgggactgctgacctctgaccctctgcctccctcta

SEQ ID NO: 76893 - DNA, 303 bp, Homo sapiens
aatacatggagattaaataacttgctcctcaatgattgttgggtcgaaaatgaaatcaataatgagatttaaaaattctttgaactgaacgataatagtgacacaacctatcaaaacatctgggacaccaaaagcggtgctaagaggaaagttcgtacattaaatgcctacatcgaaaagtctgaaagagcacaaatagacaatctaacataaaatcacacctcaaggagctaaagaagcaagaatgaaccaaacccaaacccagcagagaaaaagaaataaccaagatcagagcagaactaa

SEQ ID NO: 76894 - DNA, 480 bp, Homo sapiens
agcagggcgtttttcttcctggagggcctgtggagcggaggcccgaggcctagggcaaacttgccatgaagaaaggagaggctgttcgagagccctaggctgggagtcggaggacctgggttcgatttatacatacttaagcatgtcagtgaacttctgggcactttagttttctgatttccagaagtaaatactgtttcctgccttgccgtttcccaaagttgtgcgggttgaatgcctcaaattcctgcctttcctcaagagaagagcccccaggagaaaagccagtattgcttgtgctcctaacaacctgtctcttggttatgggaactctgtgaagagaatatgactgtgtcctgaagaatttggattagtttaatatgtatgcataatatatgtacacttatgtacgtatttatgtttatatgcatcaagagatacctagaagaaggtccattaaaatactattattttctgtgg

SEQ ID NO: 76895 - DNA, 3497 bp, Homo sapiens
gcttactcctttccgcagggcagcacccagggacctgagtgttgcaaggtgcgagaggggagcgccgcggggagcgccgcgggaagcgcatgtgcctcaaattcctgcctttcctcaagagaagagcccccaggagaaaagccagtattgcttgtgctcctaacaacctgtctcttgagaggctgatcatcaggggttcactttcagagaagttgagaatgcaggctgaacaaggaagaggaaggggaatcctgcagggatgaatgagaggacagcaatgcatgtgtgatgtgtgtgagcacacacacacagtaacctttcctaggagaactgtattactctaatgataatcacctttgaggaaaaaaaacttgtaagtatgaatttggtgttacaagcagcatgaattccagccaaatatcactcagaatgaaacatgggagagttaacatgcagaagaaaccttcaaagtgtagtgaatgtgggaagttctttactcagagatcatctcttacccagcaccagaggattcacagaggagagaagccctatgtgtgcagtgaatgtggaagttgtttccgtaaacagtcaaatcttactcaacatctgagaattcataccggagagaaaccttataaatgtaatgaatgtgagaaagcctttcaaacaaaagcaattcttgttcagcatctgagaattcatactggagagaaaccctataaatgcaatgaatgtggaaaagccttttgtcagagcccatcccttattaaacaccagcgaattcatactggagagaaaccatataaatgtacagaatgtggcaaagccttcagtcagagcatatgccttactcgtcatcagagaagtcattctggagataaaccttttaagtgtaatgaatgtgggaaagcctttaatcagagtgcatgtctcatgcagcatcagagaattcattcaggagagaagccctacacatgcactgaatgtggtaaagccttcactcagaactcttcccttgttgaacatgaaaggactcacactggagagaaactttataagtgtagtgagtgtgaaaaaactttccgcaaacaagcacaccttagtgagcattacagaattcatactggagaaaaaccttatgagtgtgttggatgtgggaaatcctttaggcacagttcagcacttcttcgacatcagaggcttcatgctggagagtaaaatttggaatataatgagtatgggaagatttgtatggaagcaccttttttttctcctaaattcctaggaatgtaagactcaatctgtagctagtatgaatattttgtattttgaacaagaaatgttgtgtcctaatgtgtcctagtctggagtttgatgccttatctgctgctcagtgggtgtaaccttatcccttctgagcctcagtttccccattccccccaatagaaaaatggggatatttcctagggttgtcctgagaataaaatgagttctgtgtgacagttaactgccattaattaattagccgttctaaaagtttatttacaatatcaaaatctgacaagtaaatcagcattgttgtttggttctcataatgtattgtttcttaagaacattttgtaattgggctatgattttatgatctacagacgtctatttaaactataatgtcttggtttaaataggataatacaatctaagactggtttgtccttgagaaatttcagatttaatcagagaaaaatgtactgattgggatttgagtggacattgtggggtgtatttctggataccctcaagatcttcatttaaattttgatactttctattactagatctaatttgattttaagctctaagtttcacttttccattaaacggaaagcctccctgacattaactgaataaaacctcatgttgtgggacttctgtgtgtgtttagggttggcagcaggtgattaggagaaggcatatgacagtagagaggactggaatatagaggagaatataagcatgtagatgaggatgtggctgtatttgttttgagttctaggagcacagcaccaaatgtggtctcttaagggaagatgagggtagaagatgttaagatcccaggttccagcaactgatgccactgactaacaactagccacttgtcagaggaaggagagaacagtgtcttggggatgctgatgggttggagtgcctaatggctcattaaaagccatgaaaaagcaaagaaatcaaagaatacttttgatggagctttaggctatgctaagccttttaatgtaaacaagcacctctaacgctaaaagcacccttgcaagaaaggtaggagttactattcacatcctagagtcaaggaaaaagagaagatgtttgacttgctcaaagtcaagcaggtaatgtcagaattgaatctcaaatctatatctttatagatttgcagttctggtttatataataccaaagtcacatacaggtaatttcccaccattgaaccttcctgttggtgtgagatgccaaatctgtgaaaaccagacacaggtggccaggtgggtgtcgaactcctgacctcaagtgatccgcctgcctcagcctcccaaagtgctgggattacaggtgtgagtcaccacatctggtcggattttaactattctaataggtatgtagtggtattaattgttttaatctgcagttcaccaataatatatgaatttagcatcttttcatatgtttgccatctgtatagctttggtgaggtatctgttagaggttttgcccatttttaattggattgctcattttcttattgttgaattttaagtgttccttgtatattttgtataacagacctttatcagataggtcttttgcaaatattttcctcccaggctgtggcttattttctcaatccttgattccttctctttactttttttttcttttttctttttttaaagaaatggtagcataatatacacagttgtccattttttaaagactaaaccatctcacagattgttctgtatcagtaaataaagatctttcccccacccttgcccagtgtgtcattgtcttaatagaccattattagttccctattggtggacacttaatggcttttatttttctgttgtaagcaaaactgcatatacagcatccttgtctttaggcacatgtgcaagatatttataaggtaattctcaggctgggcacagtggctcatgcctgtaatcccagcactttgggaggccgaggtgggtggatcatttgaggtcaggagttcgagaccagcctggtcaacatagtgaaaccccacctctactaaaaatacaaaaataattagccagcatgatggagggcacctgtagtcccagctactcaggaggccgaggcaggagaaattgcttgaacctgggagatgaaggttgcaatgagctgagattgcaccactgcactccagcctgggcgacagagcaagactacgtctt

SEQ ID NO: 76896 - DNA, 3064 bp, Homo sapiens
gcttactcctttccgcagggcagcacccagggacctgagtgttgcaaggtgcgagaggggagcgccgcggggagcgccgcgggaagcgcatgtgcctcaaattcctgcctttcctcaagagaagagcccccaggagaaaagccagtattgcttgtgctcctaacaacctgtctcttgagaggctgatcatcaggggttcactttcagagaagttgagaatgcaggctgaacaaggaagaggaaggggaatcctgcagggatgaatgagaggacagcaatgcatgtgtgatgtgtgtgagcacacacacacagtaacctttcctaggagaactgtattactctaatgataatcacctttgaggaaaaaaaacttgtaagtatgaatttggtgttacaagcagcatgaattccagccaaatatcactcagaatgaaacatgggagagttaacatgcagaagaaaccttcaaagtgtagtgaatgtgggaagttctttactcagagatcatctcttacccagcaccagaggattcacagaggagagaagccctatgtgtgcagtgaatgtggaagttgtttccgtaaacagtcaaatcttactcaacatctgagaattcataccggagagaaaccttataaatgtaatgaatgtgagaaagcctttcaaacaaaagcaattcttgttcagcatctgagaattcatactggagagaaaccctataaatgcaatgaatgtggaaaagccttttgtcagagcccatcccttattaaacaccagcgaattcatactggagagaaaccatataaatgtacagaatgtggcaaagccttcagtcagagcatatgccttactcgtcatcagagaagtcattctggagataaaccttttaagtgtaatgaatgtgggaaagcctttaatcagagtgcatgtctcatgcagcatcagagaattcattcaggagagaagccctacacatgcactgaatgtggtaaagccttcactcagaactcttcccttgttgaacatgaaaggactcacactggagagaaactttataagtgtagtgagtgtgaaaaaactttccgcaaacaagcacaccttagtgagcattacagaattcatactggagaaaaaccttatgagtgtgttggatgtgggaaatcctttaggcacagttcagcacttcttcgacatcagaggcttcatgctggagagtaaaatttggaatataatgagtatgggaagatttgtatggaagcaccttttttttctcctaaattcctaggaatgtaagactcaatctgtagctagtatgaatattttgtattttgaacaagaaatgttgtgtcctaatgtgtcctagtctggagtttgatgccttatctgctgctcagtgggtgtaaccttatcccttctgagcctcagtttccccattccccccaatagaaaaatggggatatttcctagggttgtcctgagaataaaatgagttctgtgtgacagttaactgccattaattaattagccgttctaaaagtttatttacaatatcaaaatctgacaagtaaatcagcattgttgtttggttctcataatgtattgtttcttaagaacattttgtaattgggctatgattttatgatctacagacgtctatttaaactataatgtcttggtttaaataggataatacaatctaagactggtttgtccttgagaaatttcagatttaatcagagaaaaatgtactgattgggatttgagtggacattgtggggtgtatttctggataccctcaagatcttcatttaaattttgatactttctattactagatctaatttgattttaagctctaagtttcacttttccattaaacggaaagcctccctgacattaactgaataaaacctcatgttgtgggacttctgtgtgtgtttagggttggcagcaggtgattaggagaaggcatatgacagtagagaggactggaatatagaggagaatataagcatgtagatgaggatgtggctgtatttgttttgagttctaggagcacagcaccaaatgtggtctcttaagggaagatgagggtagaagatgttaagatcccaggttccagcaactgatgccactgactaacaactagccacttgtcagaggaaggagagaacagtgtcttggggatgctgatgggttggagtgcctaatggctcattaaaagccatgaaaaagcaaagaaatcaaagaatacttttgatggagctttaggctatgctaagccttttaatgtaaacaagcacctctaacgctaaaagcacccttgcaagaaaggtaggagttactattcacatcctagagtcaaggaaaaagagaagatgtttgacttgctcaaagtcaagcaggtaatgtcagaattgaatctcaaatctatatctttatagatttgcagttctggtttatataataccaaagtcacatacaggtaatttcccaccattgaaccttcctgttggtgtgagatgccaaatctgtgaaaaccagacacaggtggccaggtgggtgtcgaactcctgacctcaagtgatccgcctgcctcagcctcccaaagtgctgggattacaggtgtgagtcaccacatctggtcggattttaactattctaataggtatgtagtggtattaattgttttaatctgcagttcaccaataatatatgaatttagcatcttttcatatgtttgccatctgtatagctttggtgaggtatctgttagaggttttgcccatttttaattggattgctcattttcttattgttgaattttaagtgttccttgtatattttgtataacagacctttatcagataggtcttttgcaaatattttcctcccaggctgtggcttattttctcaatccttgattccttctctttactttttttttcttttttctttttttaaagaaatggtagcataatatacacagttgtccattttttaaagactaaaccatctcacagattgttctgtatcagtaaataaagatctttcccccaccctt

SEQ ID NO: 76897 - DNA, 2902 bp, Homo sapiens
gcttactcctttccgcagggcagcacccagggacctgagtgttgcaaggtgcgagaggggagcgccgcggggagcgccgcgggaagcgcatgtgcctcaaattcctgcctttcctcaagagaagagcccccaggagaaaagccagtattgcttgtgctcctaacaacctgtctcttgagaggctgatcatcaggggttcactttcagagaagttgagaatgcaggctgaacaaggaagaggaaggggaatcctgcagggatgaatgagaggacagcaatgcatgtgtgatgtgtgtgagcacacacacacagtaacctttcctaggagaactgtattactctaatgataatcacctttgaggaaaaaaaacttgtaagtatgaatttggtgttacaagcagcatgaattccagccaaatatcactcagaatgaaacatgggagagttaacatgcagaagaaaccttcaaagtgtagtgaatgtgggaagttctttactcagagatcatctcttacccagcaccagaggattcacagaggagagaagccctatgtgtgcagtgaatgtggaagttgtttccgtaaacagtcaaatcttactcaacatctgagaattcataccggagagaaaccttataaatgtaatgaatgtgagaaagcctttcaaacaaaagcaattcttgttcagcatctgagaattcatactggagagaaaccctataaatgcaatgaatgtggaaaagccttttgtcagagcccatcccttattaaacaccagcgaattcatactggagagaaaccatataaatgtacagaatgtggcaaagccttcagtcagagcatatgccttactcgtcatcagagaagtcattctggagataaaccttttaagtgtaatgaatgtgggaaagcctttaatcagagtgcatgtctcatgcagcatcagagaattcattcaggagagaagccctacacatgcactgaatgtggtaaagccttcactcagaactcttcccttgttgaacatgaaaggactcacactggagagaaactttataagtgtagtgagtgtgaaaaaactttccgcaaacaagcacaccttagtgagcattacagaattcatactggagaaaaaccttatgagtgtgttggatgtgggaaatcctttaggcacagttcagcacttcttcgacatcagaggcttcatgctggagagtaaaatttggaatataatgagtatgggaagatttgtatggaagcaccttttttttctcctaaattcctaggaatgtaagactcaatctgtagctagtatgaatattttgtattttgaacaagaaatgttgtgtcctaatgtgtcctagtctggagtttgatgccttatctgctgctcagtgggtgtaaccttatcccttctgagcctcagtttccccattccccccaatagaaaaatggggatatttcctagggttgtcctgagaataaaatgagttctgtgtgacagttaactgccattaattaattagccgttctaaaagtttatttacaatatcaaaatctgacaagtaaatcagcattgttgtttggttctcataatgtattgtttcttaagaacattttgtaattgggctatgattttatgatctacagacgtctatttaaactataatgtcttggtttaaataggataatacaatctaagactggtttgtccttgagaaatttcagatttaatcagagaaaaatgtactgattgggatttgagtggacattgtggggtgtatttctggataccctcaagatcttcatttaaattttgatactttctattactagatctaatttgattttaagctctaagtttcacttttccattaaacggaaagcctccctgacattaactgaataaaacctcatgttgtgggacttctgtgtgtgtttagggttggcagcaggtgattaggagaaggcatatgacagtagagaggactggaatatagaggagaatataagcatgtagatgaggatgtggctgtatttgttttgagttctaggagcacagcaccaaatgtggtctcttaagggaagatgagggtagaagatgttaagatcccaggttccagcaactgatgccactgactaacaactagccacttgtcagaggaaggagagaacagtgtcttggggatgctgatgggttggagtgcctaatggctcattaaaagccatgaaaaagcaaagaaatcaaagaatacttttgatggagctttaggctatgctaagccttttaatgtaaacaagcacctctaacgctaaaagcacccttgcaagaaaggtaggagttactattcacatcctagagtcaaggaaaaagagaagatgtttgacttgctcaaagtcaagcaggtaatgtcagaattgaatctcaaatctatatctttatagatttgcagttctggtttatataataccaaagtcacatacaggtaatttcccaccattgaaccttcctgttggtgtgagatgccaaatctgtgaaaaccagacacaggtggccaggtgggtgtcgaactcctgacctcaagtgatccgcctgcctcagcctcccaaagtgctgggattacaggtgtgagtcaccacatctggtcggattttaactattctaataggtatgtagtggtattaattgttttaatctgcagttcaccaataatatatgaatttagcatcttttcatatgtttgccatctgtatagctttggtgaggtatctgttagaggttttgcccatttttaattggattgctcattttcttattgttgaattttaagtgttccttgtatatttgcaaaagacctatctgataacggtctgttatacaaaatatacaaggaacgtcgacc

SEQ ID NO: 76898 - DNA, 515 bp, Homo sapiens
gaggacagtcatctatgggcctcttctgcctatggattgtaatgtcctggggtttcctaagaaagggaatacacctgttatcctcctggctctggcatactgaggaaattaaacactgaaagtgatccaggctttcccagaggctgactggtagtgctggggagatgagcacttcctggccagcccctgtaggctccgtggccagctatgcctggacccttctagcagcaatgctgctgtattccagcaaagccaagtgcaggagtcccaggataaggcagaccccagttctgcagtgagggcggccctagtacaacacaacttggtcactggaccctcatagggatggatgcaatcccatcacccactcagatgcctgagactgtgcagaagcagggccagtgaaagcagagggcagatccagcagtgcttcaaggggccctgctatgcggatttagagtcggccatggacatggctgaagatggccaggacatagaacagggagcaacagcag

SEQ ID NO: 76899 - DNA, 520 bp, Homo sapiens
gtcttgatctcctgacgtcgtgatccacccatcttggcctcccaaagtgctaggattacaggtgtgagccaccgcgcccggctgtaatttcagaattatagatattgaatgtccatagtgacaaacacctataaaaatagaaaactctccagtactgtttttggaacctgaaagattgggttagtcatttattctgttttgttgttcaaacattgttttaagcctcagatttcaacctatatatatagaatagcagagaggggatgaggtctattagtgacattgtagttgtaaaagtgcagtttgaacctttgctttatttatgtacatactgtactgtcgtttgctctgtgcctttataaaagtaatcaaaaaaaagtatttcttcactagctattgcagtcttttataaaagactgcctttgcttagagcatgctatatattgcagtgtggaatattggaggccattataagaatgtttggaaatagcttgacccctgaaagatatctataaactca

SEQ ID NO: 76900 - DNA, 416 bp, Homo sapiens
caacactccctgctgtctcatgtctggcttggtgcagacattttcttatctgcctggcacctgcaggcatctgtgtttgtgaacccagcatataccacttctactgtgccattctctctatcctgctccttttctgggactcccagtggaaggtggcaggtgacaggtaagatggtggagcagctctccaagccctttggggactgagccacagtgtgtggctgcttccctgacctgtgtgatggcatcctagggttgttcaggaagatgcaaagcagctcagtcctgactgagttggagactggtgtctaccagatatctgctgtccacacaagctgcagctatgcagagaagctgggtgtagagaagcagctgatgggagctggggatattctgagttggtgcctggagagagg

SEQ ID NO: 76901 - DNA, 597 bp, Homo sapiens
ccttatttaggaaacatttttcaaatctccaaaagtgtaaactgtatttaaaaaagcaaatgactagcccacaggccgtacatagtttgctgacccctgcttttgtaggaatgaggagctcagctttgggggcttctcaggccttccatcttgtataaggaagacagatatgtcatgcccagaggcaggtggcagaacatcctgaaagggaagggatagtaggaaacagtgacctcccctgggcagccggaagcatttgtttaatcagattgctttcctaccacttgctgatgagtaattcttaccgcttttgggtcatggtggcttgaagaatctgatgagggccgggcacagtggctcatatctataatcttaacactttggaaggccaaggtggaaggatcacttgagcccagaagttcaagaccagcctgggcaacatagtgagacccccatctctacaaaaattttaaacaattaaaataaaaagtctggtgaaacttctggatccagattctctcttcaaaataagttccatcctcaacactcaaactcacactttcacggtatttgagaggccgcactcatccctcaccc

SEQ ID NO: 76902 - DNA, 437 bp, Homo sapiens
acccacagggaaggagaaggtggggctggtctccgctgggccagcaggtggcgccagggcctgtcggtctctccccttggccacctcccttgcgcttgctcatctcatgcccaggcgctgagggttctcagctggggcaggagagatggggtcctgaggcctgggtgaagttccaagccctggggctcgggggcagactctcgctcacccctcccagaaagatgttttcctaggggatgtccagcctaacacggcagggaaggaagtggtggtcacctgggaaaggggccaacctgagaggttgggggtcctgatgaggctgctattctcttgaggacatgaaatgagaggcggtgaagtcagtcagtgagtcaaaagctgagatctaggaaccagacacaatgtgggagaagctgcggtgaaatcaatcagtgaga

SEQ ID NO: 76903 - DNA, 534 bp, Homo sapiens
cgagaaggagccaaagctggagccagaaagcctggcaccgccaccttcccctgacagttagcaccttcctttcacaacatctcccttaagggggaagcgtctgctgtggaacccaccgcaaggcaacgcaggcagagttcagcctgaagagcgccaggccagcctcctctgtcttccgagcaccgcttctcaggtcgcttcccaatctgaggaggctgtcgtgtccacaaccagtccagggggatgtgcgccactagctgaggacgccaggcccggcgacaccacaaaggcttggccatgcggaatgtgccctcaagagcacacacttcgggtagagggcacttgcattgagctcttcagctttttaaatccactgtagttcatgagcctgtgtgacataattacttttacattttatattgtcaattagtttattggcattttcaatcttttcaactattggctatgaaaatatgaatttaacgtaacattcaaatgagtattaaagaaaaataaagtagaacttcattagaa

SEQ ID NO: 76904 - DNA, 359 bp, Homo sapiens
tgagactgagtctcactctgtcacccagactggagtgcagtggcacgatctcagttcactgcaagctccaccttctgggttcacgccattctcccgcctcagcctcccgagtagctgggacttcaggcgcccgccaccacacccagctaatttttgtatttttagtagagacggggtttcactgtgttagccaggatggtcttgatctcctgaccttgtgatccgcccacctcggcctcccaaagtgctgggattacaggtgtgagccaccacacctggccccatgatttgtcttttaatataaatggaaaactggagagagagaattgtgtttcaaaaactgtagcacacctgttgtt

SEQ ID NO: 76905 - DNA, 627 bp, Homo sapiens
ctggggtctgggaaggaggctatggtgaagtctaggacatgtgtgtttctgcagcgcctaggctgccagtcaaccacaggggagggccaagcccagtatggccccatcctccctggcctaactctgcttcttggccatcctgggagcagtcaagtactccaggcattgtcttcacagctgtctgtttcctgtcctctgtcctgagctctgtaccatccatatggaccttgccttttgtagccttctgggtgctgagtggatgtttaggacccaggatggctggggtgaacaatggggagggtatctgtgtccagtgtttcagaggctttggttaggacaaggctggcaaatgtagggttagtttggttttgttttttaaaagaacaaaaagataagatgatgaatagcctgtttcccatgatcaatttaaacataactgttaagaatgaatacagttaggtaaatgtgaatgagataaatgtttataaatgaacttgtcatagtttaaaaattctttttggtaacttgaaaccttatagtgaaattaagtaatagagatactcattaattgtctgagttatttctaagtaagttaaaatatgaaaacatatatgattattcataagt

SEQ ID NO: 76906 - DNA, 411 bp, Homo sapiens
tgagatggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctgtatttcatcttaatgtaagaataacagtcaaagaaaattggtaaaatatatactatattaggggatgttttgtgactgcaattgaattttctttcatatattgttcactttaataaaattaacctgc

SEQ ID NO: 76907 - DNA, 541 bp, Homo sapiens
atttttaatgggttactcttaagtgttacgtaattccttatgctgtggtgatcttgacattttaccagttcaagtgaagtatagaaagcgtccctccatttaagattcattacctctccatttataatataattctcttaaatattttctctttatacattgggaacatcagacaatattataactttgtcatcagtgatgaaacacaagttagaaaaacagaggctgggcgtggtggctcacactggtaatcccagcactctgggaggctgaggtgggcggatcgcttgagatagggagttcgggagcagcctggccaacatagtgaaacccatctctagtaaatacaaaaattagctgggcatggtggtgcgtgcctgtggtcccggctgctcgggagactgaggcgggagaatcactttggccccggggatggaggttgcagtgagccaagatcgcaccattgcactccagcctggcgacagagcaagactctgtgtcagaaataaatacataaatacataaatagatagaaagaaag

SEQ ID NO: 76908 - DNA, 402 bp, Homo sapiens
cttcatttcccactgccttgtgtattattaaaatttaagtctgcccatagctttcaactgaaagaaaataggcaatattagaacagatcaggctgagggcaaattacaactaaaaaaaaccccaaaccatctgaacagtggggatgttttcagttaacagcagtatggtattggaataacttattgatagttttagatagaaatctatttatagaactcagcaaccacagaccaatcaatttttcaactataacaactatataaaaccaaacacacaggccaggtattgtggcttatgcctataatcccagcactctgggacgccaaggcaggaggatctcttgaggccaggagtctaagagtagcctgggcaacatagtgagacccccatctctacaaata

SEQ ID NO: 76909 - DNA, 342 bp, Homo sapiens
tggggtttctccacgttgcccaggctagtcttgaactcctgcgctcaagtgatccacctgtcttggcctcccaacaggcatgaaccaacacccccagccagttttagtgatttttcaagaaatacatactcattttagaaagtacaaagagattgaaataagagctcactaaccagagacgacccattatggtttaaatttctttgtatatgtgcctaccttttcctgtgtgtgcatatttaatacacagcttgagtattccttctctgaaatccttgggaccagaagcgttgtggatttcaggcttgttcagactttggaatatttgcattatacttactg

SEQ ID NO: 76910 - DNA, 1115 bp, Homo sapiens
actcttgctttcaagagatgtggaatttctcttttataagaatctatgtggatataaatagtggtgatcaaggcactcttacactaagagttcagtgatgatacatctctgtcctttcttggcaatttttgctaccacttatttttagtgcctatataacattttaaagttgcatcctcctttttatgactgatgagaagcatatgcctctatgaggaagaaaaggtatttatgacttacagaaaaaaatttctcacagctatgagtaagctatagggaactgaaaacaagaggccaaagaacctttttttttttaatggccttggttacataaagatatttagaccagctttcaaaaataacaacagtttttaaaatttaccatatcgagcctcagtacgttactctaaaacacagctttataattcctctataatctacattaaatgaagagtaaaataaaactacaaatttaggaagatgaggaggaccaaaaaaactacaaataaggtaaataagaaaaattgcaaacctcaaatctcttacaaagaaaattatgatattaatagtttccttactcacatttggtaattgtataaagactgcagagttactacctgtacatctgaaaaaggagaaaaaggacctaaccagtgttgctgaaagaaattttacaaataaagggatcgatctggtagctagtcaggtttatttttacctgggatttagggcttcctgaggcaatgtagcctttacccttttttaggtcttagctccctttgaaaatctgatgaaatcattagatttggggggtaggatgtcttgtataaaaaattttgtatgggcttgtttatgtatttcagggagtttgtgagtgctctgaaaacgaatgaactcctagaccacctgtatcggaatcacctgagttgcatattaaaattgcagactattggactccaccctaatcttattgtattagaatttctaggcctggcactgtggctcacacctgtaatcccagcactttgggaggccaaggcaggtggatcacgaggtcaggagattgagaccatcctggctaacacagtgaaaccctctctctactaaaaatacaa

SEQ ID NO: 76911 - DNA, 1005 bp, Homo sapiens
aagaaactctgtctcgaagtaaataaataaatttttaaaaaccaacctgatgtgaagttgaaacacaagacgcggaaataaaaactcagagtataaatatctatattgttaccattatctgggataattgatgatttataagaagctgaggtttcgtcttcctagaaatggacttttattaggccagcaagaatgaccacttagccatttaaatgatttgtcagcatcttttgctgctctcttctaagaccattggttttcactaaaggataaatacctgctaagcaaattataaaatactataagacatttaatctcctggaagaggacttgctgataattggatcaaagttccagcattattgctcttttcgaatcatatggacttagtgttctcatgaccgaggagtcacatttttagcttgctaaaatattcactggagaacatggtgaaatccacgagtggaaacgttccatggtattttcaaacgccacgtgtcaggaatttggcatgccttcctctgggagaggcactggagtgtggccagatggaacccagcagggtacagagggcatttgtgggagcagttaggaaaccaggacgtccagcttctgcctgccagggagctcgctcatgttgtctctgaaatttgcataagagcaattacctcatattctaattttaaagatacaatttttaaagacatggaaggctctgaggcctcctgaaggctattcctatgtgaggtattgtttacgggtggcctttcactatttccaaatcagcgatgaaaagaagactgagtctaaaataaatgaagcaacagacttcagcagcctgagagaattttgttcaattccagtctccttaaaaaaaaatcggtttttgctttcaatttaggaaaattgttttgggttgcattgttgaaagtaatgatttctagcagctacttatgtataatctcttaaccaattaaattctgaatctcttaaaaaaaaaaaaaa

SEQ ID NO: 76912 - DNA, 108 bp, Homo sapiens
gactcttacagtgaagacagagctcttcaatacaccctgtggaaaggctggccaggtaagttactgttcaaatcaggaccatttgtggagtgaagtgtgtgtgtgtgt

SEQ ID NO: 76913 - DNA, 310 bp, Homo sapiens
tgatctgcccacctcagactcccaaagtgctgggactacaagcgtgaaccactgcacctggcctatcatgagaatttctaacattcttttagctctttgtacatgctaagggcatcggctgcaacatttcacccaattttatcatcagcaaccttatgaagcaggtacataattatccccattttacagaaaggaagactgaggcccaggtggcagaaaatgcctctccataaatactgggctagtaagtttcagagccaggaaaccaggcttgccagagactctaagagctgcctttttaacctctcct

SEQ ID NO: 76914 - DNA, 989 bp, Homo sapiens
atcatagttgaaccgtcctggaatagaagtgagtaaggtgaaccaggtgtggtggctcatgcctgtaatcctagcactttgggagaccgaggtgggaggattgcttgaggcctggagttcaggaacatcctgggcaacatagcaagatcctgtctctacaaaaaatccaaagtttttttaaattaaaaaaaaaaagtgagtaaggcagcttgaaccggaaatgcacaaaactgctatccagtttgcaaggcttttcccaatgactttgagggatggaacctgaaggaagcgggaggaggcaaatagggaggaaagtgaaatgatttataaatgacttgctaattttgtccaaagggagtaatgataattagggcattcttcccacacgaagatgacacaattgacccaatatcattgaggcaaacagtttgggctgtttttccagtagtatgacagtgacggtgtgtcaaccgcaggacctcacccacatttctttgggacctaggagtgtgggaaatagcagccagatttgaggtacaaatcatggtgtccagcctgcaaagcctttttgcagcaatctaagcctgactgctcctgttgtatggtcaaagtcattttaatctactttagcttattgtaaaatgttcaagaattgtattttgtcttgaaaaccatgaattttattgtttagggggagttattttttaaggagtgcaggatttcagttttggatgatgaaaaagttttgaagatgggtagtgacagtggtcacacaacattgtaaatgtacttaatgccattgtacacttacgtgactttaaagtaaacatgaaattttctacatttgtttgtttgatccaactgttatcctccctaagggtacttggaagttctttctggacattgccactgggaacttactatttaaatattgttggtcctcttggattccatcagtactccagagacttccttcgtttctaatttaa

SEQ ID NO: 76915 - DNA, 297 bp, Homo sapiens
ctcgtgatccgcccgcctcagccccccaaagtgctgggattacaggcgtgagccaccgaccccagcctaagatgtggttttccaatacaaagagaacaatgcaaaaggcttacaaggtaacacaacacacacacacacacacgaatacagagctctttgtgggaatcaaacgactataaaaaaaacttgtacttattataggattacatggaaaaaacaagtaatttccactcagatttgccctcaatccctccagagaaactacctcaaaacaaaataaacaagtgctttactaaa

SEQ ID NO: 76916 - DNA, 389 bp, Homo sapiens
atggtagagagacacttataatgcagtagttgaaaacctgcaaattggagtcatgctgtttggatttgaggaccagctctgcctacattggctgtggggtcttgaacaagtcacttaacttccctgtccatcaatgttcttatctgcaaaacaaaataatgacagtgtctggtaatgctgttggaggaaaaaataaaatagtgcctacatatggactctgtattttttttattatactttaagtgactctgtatgttttaaagtgattttagaaagctagatattgtgtattgaagttctattatgtggtattctcatgtactctatggaatctaacagtccattttctgtgtgcatttgcaatccatagagaaagagagagaagtgag

SEQ ID NO: 76917 - DNA, 382 bp, Homo sapiens
tgaatataaaagccctcagtatttaaaattgagaacattatttttccagtcctttaaaaaaccgtatctagtcaatattaagaataatgtttccaagtcataccctcatatcaggtatggcatgacgtcttccataatttgtttcattacagtgtaatatgaaaatctttgcacacagatgtgttatagcaaaaggaagaacacaaacggttccttcgggaagattttgtgctctcttgaattcaactgtctcagaaatcattaatcctgtgacttgggcagcataccacctggttttttagaaatcacttggatattggctgggcacagtggctcatgcctgtaatcccagcactttgggaggctgaggtgggcggatcac

SEQ ID NO: 76918 - DNA, 365 bp, Homo sapiens
atgggccatagtttgcctacctgtttaccctttgtttagagtctttctcttgccctactccctggccccaatctctgctaccgtggtaacgtgagctccgcaagggcaaggattttttcctattttgttcatggacttccaaaatgcctacaacaacatctgacacatagaccctcaacttattaaaataatagataagttaattatgttttgagtgttttttataagcagcatatagctgaggttttacaattcagtctactgatctcatctcaacagatatgtttaattaggttgcattcattgtgatttctagtatatttggaattatccctgtctggtttttgttttgtatttctttcctt

SEQ ID NO: 76919 - DNA, 646 bp, Homo sapiens
tgaagaaacattttaaggaaaaacagtggaaaagtatattaatctggaatcagtgaagaaaccaagaccaacacctcttactcattattcctttacatgcagaatagaggcatttatgcaaattgaactgcaggtttttcagcatatacacaatgtcttgtgcaacagaaaaacatgttggggaaatattcctcagtggagagtcgttctcatgctgacggggagaacgaaagtgacaggggtttcctcataagttttgtatgaaatatctctacaaacctcaattagttctactctacactttcactatcatcaacactgagactatcctgtctcacctacaaatgtggaaactttacattgttcgatttttcagcagactttgttttattaaatttttattagtgttaagaatgctaaatttatgtttcaattttatttccaaatttctatcttgttatttgtacaacaaagtaataaggatggttgtcacaaaaacaaaactatgccttctcttttttttcaatcaccagtagtatttttgagaagacttgtgaacacttaaggaaatgactattaaagtcttatttttatttttttcaaggaaagatggattcaaataaattattctgtttttgcttttatg

SEQ ID NO: 76920 - DNA, 578 bp, Homo sapiens
tgaagagacagggtctcactcagtcaccaggcaggagtgcagcagtgccatcacagctcactgcagctttgaattcctggctcaagcgatcctccaacctcagccataggcatgcaccaccatgctaggccttttagtagagacaggatctcaccatgttgctcaggctggtctccaacccctgggctcaagtgatcctcctgccttggcctcccaaagtgggaggattacaagtgttatccaccatgctggacaggaatatttttaaataatgaaaccaagttcctttcgctttgtaagttaatgcatgtattgatggtgagtagagaacaatgacacaatctctagagagacataggtgttcggcctggctcaatcactagccttatagtctcacaggaaaatatgaacttcatcaaaatagctaattattaccacatcatggatctttatggtcattttcaaatagacaaaattacaaagttcaatatataaatgccattggcctaatatcccattttataggattaactatttttcaaggagtcatgaacacaatttcaaattctccattcaga

SEQ ID NO: 76921 - DNA, 422 bp, Homo sapiens
caacacagtgagacatatctacaaaaaattaaaaattggctggacatggtggtggttcacctgtagtacaagctactcaggaggtcgatgtgggaggattgcttgaggctgagaggttgagggctgcagtgagccatgagtgccactgcactcagcctgggcaacagagtaaaaccctgtctcaaaaaaaataaaataaaatcggaaaaattctgaattcctttacatttggctccaaaagttttgcataagggattgtggaccctttatctttggataaaaagatttgttttatccattcaacgcacattgtgtttagtgctaaggaaaaaatgattaagacatggtttcttccctggaagagtgcacagtggagtagagtgagtgacagaggagttgcaccctattcaggatttgagttc

SEQ ID NO: 76922 - DNA, 507 bp, Homo sapiens
taaaagttgaaaaaatttcctccattctaatttctactactgcaaagattgataggtacaacccgtataaacaaaagctcttttagagcctcagtaattttcaagaatgggaggggacaaaaatgttggagaactctttgctaaagcagtgaagtctcctattagccactgtgaccaagtgaggcattatccagcattagcattctttctcagattattcacccaccctaggcttccatgtgaccctgaaataagggacttcacttccaagtttggccgaagatgctatcagggaatccaggattctgattatggtaacatacccttcccacctccttttcctgttcttcctcctaatggaaaggacatgggctatgaagcaagcagaccttgatctcagcctcggccctgcataaagtaagaaatagtaatgcctagccttccttagcaggattgtttggaggattaaataaagtcatgaagacaaatctgtaaagtgcttacaaa

SEQ ID NO: 76923 - DNA, 126 bp, Homo sapiens
tggagcaggctgggagtggtggtttatgcctattatcccactgctttgggaggctgtggtgggaggtttgtctgaggccaggagttcaagaccagcctggacaacagagcgagaccctgtttctta

SEQ ID NO: 76924 - DNA, 423 bp, Homo sapiens
actccccttggtgacttcctctactcacatgggtttagctacaaatcagatgttcattattcctaagtgtgaacccctagccctggctttccttgcaagttcagacctacacagaagacgatcacagctgacgggtccactgttgatctggtctcaccagctggaatcacagtatcttcttccctgtttctaatcctgtgtgtctgttcaccacaccctaccacatttatcccccagtgtttctggaattacttcctccttctccataaagtgaccatccaagctcactttatttcaagccctcatcatctgttgctggacatcaccatgacctcaggcgatgccagggtcttcatgagcatggaaccaaatcaacatggaagaacaggtcatgaggagccaggtcacctcagccatggagct

SEQ ID NO: 76925 - DNA, 760 bp, Homo sapiens
agcctgtagactcagctactcgggaggttgaggcaggagaatggcgtgaacccaggaggcggagcttgcagtgagccgagatcacaccactgcactccagcctgggtgacagagcaagactccgtctaaaaaaaaaaaatagtaagaaagaaggaaagacacaaagacagaaagaaggaaggaaagaaagcaagctgttttccccctgccttgcccctgctcaccctttgaattccttttcctgggcaaagccaagaaccctcgtgggctaaaaccccgctttggggcttaaagtttgcaaaatcctcccattaatctattgggaccagttgccacttaggagcattctttgataacttttacaaaacatcttttgtggtttttgaaatgttttcattttgtagatcattagcccttcttttttgaactggaatacatttcacgggaattttcaaatttaaagtctgtgcaatgttacataaaatacctttgattattaaaagccatctgttttgctataacttcccttttttgttctaaagtttgtctatttctgctatttgtttttttaccatagaaatattgatttccttaagttttcaaagaaccaagttattaataatttctctaagaactagtctcaagcttgctatacaatcctatggttgatagactgtggctttcttgttgatttccatttgttgttcatttcctccaattttccttttttaaaaattataattattgtttggattattta

SEQ ID NO: 76926 - DNA, 920 bp, Homo sapiens
agttcaaagtgaactgaagcttttacatctgaagaagtgatgaagactcaggagttggctgaggaaagtcagcactacgagggaaggaaagtgaaccaggcagatggaacaacgtatgagaagggacagacagaaggtgcattcagggaccttagagaagggtggctggagaggacagcaggggccagatcacgaacttcgtgtgtacacatttgagacttaatcctaaagcgattagaagccacggcttctaattcacaaattcttttgccacagaagaggcagaaatcacttcattttaatacctaccaataacctataggatggtcagttcaaattattctcaggtccacagcaactgacctaggatactatggggttgatcccataagaacaggaggaaagagctgctttccccacaactcccattaccactccctgctggcccaagatcaccaggaaattgatcccaggaggaaatacagaacgtttgggaagagcaggtccaactctggctcttgggccgctaacatcttaatagtcaagttggttatattgtgccattacattaccagttataatttacacaaattgtccttctctggcttggtctgtctcctcccctcctcagtgcagaagtacttttgctctcagggacggatcccagtggcctgatgctccatcctccctccttgcccctctgccacaggccctgtcccacaaaggattagaagaacaccccttgttaaattccaggagtcagcaaagagtggacaccttgttttaaacattcttataccaggtaggcagtattctggcaagagtataacaaaagcctctacagttaagttaaacccgcaaataaactggctccctagttgaaatgtgcaagacagccttaggagcatgttaagatgaca

SEQ ID NO: 76927 - DNA, 270 bp, Homo sapiens
agaagcaaaattaggacttaataacattttctgaaaactacaacatttgcatattagaacctatgaacaaaatacgcattgggttttatttgggattccaagataattttagtcataaagtttaggaacagattattccattgctttactatttctctgagcatttaaaaaatgttatctcgttaaatctttataacaacctagtgaaataaggcagcaaagtcctcactttgttgaagaagacattgagcctaagagaagcaagttgcc

SEQ ID NO: 76928 - DNA, 2496 bp, Homo sapiens
aatatggttaaaatttgacaagataatcctgaagtttgtaatgacaagtctggagacaatataaatgcctttcagtggggaggacgattttaagtttatttatatgtttactattgaatatgtgcagtctgaaatgaatggtgcatctccatttgtttttcaagatagattaaaaatccaaggacagaagaacattgtgaataataagctcccatttgttggcgatagtaggtggagtgatagaagaggctgtgggtacataaacaggtgatactagtcaagagcaggtcaaatggaaagaatgaagacatgtttggaggctactggaataattccaagtaaaagttgctaaaggacatgtactaggataatgacataatgctttgtaaaaaacaaatctgaaaaaattataggtgaatgtaatgtacacaaagctatctgaacattgcagattatgggaagagaggagtcaaagatgatgattccaggtttcaaatctggtgacaatatgtggttcatttctcatctgccctcccctcctatgtgtactttgctgttccttctcttataagtggggtaatgctaaagttttcttcatcccttgctttccccactctctttcttccacattctctttcttcttcgtggtttcagctgtcatctctttttggatgactcccacatttttacctctggttctgatctctttctcagcctctggtccttcatatcccttgcttgcttgggatgttatcatgttatgatcatggtcttagtgtaatcagacatctgttcaattccagccactgttgggagatatatgtcaccttggaaaagttccttaacttctataagggtcaatgaccccatttataaatgggcatatgaatactacttatctttcaagggtgttaagagcactgaatgaataatgatcttctaaaaacagtacataaactgggctcattctccttggtatgaggtgaaatgaaagaaatttagataatattatatctattcacctatcttctgtctttcttgtttttggcatataatctattatgaaccatcatttattggaaaggactgtctgaagtatagctcagaaggacacatcagaaggtgtggggctcgtccttatggatggagaagtggggctatattggtgtggggaatgaaaggatgagacaggacaaaatgtagaaatagattaaatatgagagtcaaggaagcattaaattatgacttagctgatatatagaataatatgttaccctttagagatacaggattttttgtagaagtttttgcagaaaagtgaaggaattgatatttattacgttgactgtaccttgtgtggtgcatttgttgcaactgatgaaacgatactgatacatttttatattaatactaaaatacatagtttgcattagggttcatactttgtggtgtacattctgcgggttttgacgaaggtatggtggcatatattcattgttactgtatcatgtagaatagttttagtgccctaaaaatcccctttgcgtcacctctttcattttcccctctccctgaacaccaggcaatcactaatctttttctgtgtccacatttttgccttttccagaatgtcatgtagttagaatcatctagtgtgcggtcttttcagagtggcttctttcacttagtaatatccttttaagattcctcaagtctttccatggcttgatagctaatttctttttattactgaatgatattcctttgtatgacgtaccacaattcatttatccattctcctgctgaaggtcagattgcttctaagttttcatagttatgaaaacttgtattttaagattaaaatctggaagtttttattgatattaggcattcgtttcttagggctgctataataacagagtaccacaaactgggtagcttaaaacaacagaaatttattctttcatagttctggagcctagacatcagaaatcaaggtgttagcagggttggcacctgccaaccaagagagctttgagggagaatctattccatacctttctcctagctgctcatgagggttagccatctttgatgttccttggattgtaaatgcatcagtccaatctctgcttccctcttcatggggcattctccctgtttcttcacattgctgtcttcttgtgaggataccagtcatattgaattaggggcccaccctacaccagtatgacctcatcttaactaattatatctgcaacaaccctatttccaaattaggtcacattctaaggcactggtggttagacttcaacaacgttattagagggcacagttcaacccatagcatgaagtgatgctttctagaccattcttctttagatagtcatcctttttgttattgttgaatcatggatggtgatgtaacgttttccagctttggctagttgtggtttcagctgaaaaaccaaaatgtccctgactgtgttatataaa

SEQ ID NO: 76929 - DNA, 6757 bp, Homo sapiens
gcccggccgacgcggctttgtctcctttgttcccggcggtggcagcgccgcgcgggaggggcgggcagcgggcgcagttttccgcccctcggtctccgggtaacagctgcggctccaccagacccggggagaggccgctgcgcgcggagcccgagcccggagcggccgacgcccgcctcggcgcgcacatcccgcggggcccggccgggtggtgactcccacacgggtcatgctgttgtctcctgatccagccggccctgccaggtgaccatgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcagagcccgcttgtctccccagaccctcctgcaagaggtgatggagactcagcagagcttgagggccctcccgcccccctcatcctcccgtccagcctcgactaccagtatgacacccccgggctctgggagctggaagaggcgaccttgggggcaagctcctgcccctgtgtggagagcgttcagggctccacgttgatgccggtccatgtggagcgggaaatccggctgctaggcaggaacctgcaccttttccaggatggcccaggagacaatgagtgtgtgatggagctggagggcctcgaggtggtggttgaggcccgggtcgagtgtgagccacctccagatacccagtgccatgtcacctgccagcagcaccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccctggggcttttcctgtggcagcccaggtgggcttgggggtgggcacctctcttctggctctgggtgtcatcatcattgtcctcatgtacaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttgagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaaaacaaggtcacagatctataggaacccaggagccacggcctgctgttgcttcagcctggcctgggcagccctggaagctcggaggagaggccaccttcttaggtgcctgtagtgactgacaagcagagttagtggaaggtgactcccagtctcctggtggctctggcctcggccctgctggatccacctcctagacccggggcctcaaggctcatggggtagtacccagcctgctccccgagtccagcgaccctgtgacaccggtctgcagggagttggggactaagggcttccagagagtggctggaagagactccaggcccctggggagactgtactgttcctgaacactggccttggccacactgggattcggagaggaaggaggagagccccatgcttcctgtctgcctcctccaccatccctgacctcagttgagctgcctctggccttgttgctgctgccacatcctaggtctaagagttgaacgcctctcctaggccactacaaactgacccctcagcagggctggctgccacagggctgccctgcctcataggtagccatggtgagggctatctgctgcaggggggtcttggggagagtggtgactccattgacccagcttttcattaaaggataacacactgca

SEQ ID NO: 76930 - DNA, 6723 bp, Homo sapiens
gcccggccgacgcggctttgtctcctttgttcccggcggtggcagcgccgcgcgggaggggcgggcagcgggcgcagttttccgcccctcggtctccgggtaacagctgcggctccaccagacccggggagaggccgctgcgcgcggagcccgagcccggagcggccgacgcccgcctcggcgcgcacatcccgcggggcccggccgggtggtgactcccacacgggtcatgctgttgtctcctgatccagccggccctgccaggtgaccatgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcaggtgatggagactcagcagagcttgagggccctcccgcccccctcatcctcccgtccagcctcgactaccagtatgacacccccgggctctgggagctggaagaggcgaccttgggggcaagctcctgcccctgtgtggagagcgttcagggctccacgttgatgccggtccatgtggagcgggaaatccggctgctaggcaggaacctgcaccttttccaggatggcccaggagacaatgagtgtgtgatggagctggagggcctcgaggtggtggttgaggcccgggtcgagtgtgagccacctccagatacccagtgccatgtcacctgccagcagcaccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccctggggcttttcctgtggcagcccaggtgggcttgggggtgggcacctctcttctggctctgggtgtcatcatcattgtcctcatgtacaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttgagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaaaacaaggtcacagatctataggaacccaggagccacggcctgctgttgcttcagcctggcctgggcagccctggaagctcggaggagaggccaccttcttaggtgcctgtagtgactgacaagcagagttagtggaaggtgactcccagtctcctggtggctctggcctcggccctgctggatccacctcctagacccggggcctcaaggctcatggggtagtacccagcctgctccccgagtccagcgaccctgtgacaccggtctgcagggagttggggactaagggcttccagagagtggctggaagagactccaggcccctggggagactgtactgttcctgaacactggccttggccacactgggattcggagaggaaggaggagagccccatgcttcctgtctgcctcctccaccatccctgacctcagttgagctgcctctggccttgttgctgctgccacatcctaggtctaagagttgaacgcctctcctaggccactacaaactgacccctcagcagggctggctgccacagggctgccctgcctcataggtagccatggtgagggctatctgctgcaggggggtcttggggagagtggtgactccattgacccagcttttcattaaaggataacacactgca

SEQ ID NO: 76931 - DNA, 7260 bp, Homo sapiens
gcccggccgacgcggctttgtctcctttgttcccggcggtggcagcgccgcgcgggaggggcgggcagcgggcgcagttttccgcccctcggtctccgggtaacagctgcggctccaccagacccggggagaggccgctgcgcgcggagcccgagcccggagcggccgacgcccgcctcggcgcgcacatcccgcggggcccggccgggtggtgactcccacacgggtcatgctgttgtctcctgatccagccggccctgccaggtgaccatgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcaggtgatggagactcagcagagcttgagggccctcccgcccccctcatcctcccgtccagcctcgactaccagtatgacacccccgggctctgggagctggaagaggcgaccttgggggcaagctcctgcccctgtgtggagagcgttcagggctccacgttgatgccggtccatgtggagcgggaaatccggctgctaggcaggaacctgcaccttttccaggatggcccaggagacaatgagtgtgtgatggagctggagggcctcgaggtggtggttgaggcccgggtcgagtgtgagccacctccagatacccagtgccatgtcacctgccagcagcaccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccctggggcttttcctgtggcagcccaggtgggcttgggggtgggcacctctcttctggctctgggtgtcatcatcattgtcctcatgtacaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggtgagggggcagaggtggacagggctcctgtccagggagggtcaggccctccaaacttctaagccctcagccaccatgcagctcggacacttgtgccagagcagagactcctgctcagcctgtcctcagtccccttaagcccatgtcctgtccccttccccagtgtgcgtcatgtcccatacacctctgccacctgctggggggccctaactgcctgtgctctcctaggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttggtgagggcgtggagagcccctggggacctgagccactgttgggcctgggctggccccggaccaactctgcagggacaactcatcactcagggtggggaggatgctgggaggcaggcagaagctggctttggaacatctttcttggacagcctctcatctggggagggggtccctgctcttggtctttggagaggttgagtaaggctgccccatgatggaggggctggtgtccctgtggaggaggagatgggctccactatgggaagggtatcttccagccctgcacccagttctgccttgcccttgcagagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaaaacaaggtcacagatctataggaacccaggagccacggcctgctgttgcttcagcctggcctgggcagccctggaagctcggaggagaggccaccttcttaggtgcctgtagtgactgacaagcagagttagtggaaggtgactcccagtctcctggtggctctggcctcggccctgctggatccacctcctagacccggggcctcaaggctcatggggtagtacccagcctgctccccgagtccagcgaccctgtgacaccggtctgcagggagttggggactaagggcttccagagagtggctggaagagactccaggcccctggggagactgtactgttcctgaacactggccttggccacactgggattcggagaggaaggaggagagccccatgcttcctgtctgcctcctccaccatccctgacctcagttgagctgcctctggccttgttgctgctgccacatcctaggtctaagagttgaacgcctctcctaggccactacaaactgacccctcagcagggctggctgccacagggctgccctgcctcataggtagccatggtgagggctatctgctgcaggggggtcttggggagagtggtgactccattgacccagcttttcattaaaggataacacactgca

SEQ ID NO: 76932 - DNA, 6669 bp, Homo sapiens
gcccggccgacgcggctttgtctcctttgttcccggcggtggcagcgccgcgcgggaggggcgggcagcgggcgcagttttccgcccctcggtctccgggtaacagctgcggctccaccagacccggggagaggccgctgcgcgcggagcccgagcccggagcggccgacgcccgcctcggcgcgcacatcccgcggggcccggccgggtggtgactcccacacgggtcatgctgttgtctcctgatccagccggccctgccaggtgaccatgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcaggtgatggagactcagcagagcttgagggccctcccgcccccctcatcctcccgtccagcctcgactaccagtatgacacccccgggctctgggagctggaagaggcgaccttgggggcaagctcctgcccctgtgtggagagcgttcagggctccacgttgatgccggtccatgtggagcgggaaatccggctgctaggcaggaacctgcaccttttccaggatggcccaggagacaatgagtgtgtgatggagctggagggcctcgaggtggtggttgaggcccgggtcgagtgtgagccacctccagatacccagtgccatgtcacctgccagcagcaccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccctggggcttttcctgtggcagcccaggtgggcttgggggtgggcacctctcttctggctctgggtgtcatcatcattgtcctcatgtacaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttgagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaacctggcctgggcagccctggaagctcggaggagaggccaccttcttaggtgcctgtagtgactgacaagcagagttagtggaaggtgactcccagtctcctggtggctctggcctcggccctgctggatccacctcctagacccggggcctcaaggctcatggggtagtacccagcctgctccccgagtccagcgaccctgtgacaccggtctgcagggagttggggactaagggcttccagagagtggctggaagagactccaggcccctggggagactgtactgttcctgaacactggccttggccacactgggattcggagaggaaggaggagagccccatgcttcctgtctgcctcctccaccatccctgacctcagttgagctgcctctggccttgttgctgctgccacatcctaggtctaagagttgaacgcctctcctaggccactacaaactgacccctcagcagggctggctgccacagggctgccctgcctcataggtagccatggtgagggctatctgctgcaggggggtcttggggagagtggtgactccattgacccagcttttcattaaaggataacacactgca

SEQ ID NO: 76933 - DNA, 3797 bp, Homo sapiens
tctctgtcaatcttatggagcatgggaaggggaagaccacctgacagtagggcagggagaggggctgccaggtaagcttgaggggcccttgatgcagctgggcacccccttagcctgccctgtgcctacagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggaggaggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccctggggcttttcctgtggcagcccaggtgggcttgggggtgggcacctctcttctggctctgggtgtcatcatcattgtcctcatgtacaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttgagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaaaacaaggtcacagatctataggaacccaggagccacggcctgctgttgcttcagcctggcctgggcagccctggaagctcggaggagaggccaccttcttaggtgcctgtagtgactgacaagcagagttagtggaaggtgactcccagtctcctggtggctctggcctcggccctgctggatccacctcctagacccggggcctcaaggctcatggggtagtacccagcctgctccccgagtccagcgaccctgtgacaccggtctgcagggagttggggactaagggcttccagagagtggctggaagagactccaggcccctggggagactgtactgttcctgaacactggccttggccacactgggattcggagaggaaggaggagagccccatgcttcctgtctgcctcctccaccatccctgacctcagttgagctgcctctggccttgttgctgctgccacatcctaggtctaagagttgaacgcctctcctaggccactacaaactgacccctcagcagggctggctgccacagggctgccctgcctcataggtagccatggtgagggctatctgctgcaggggggtcttggggagagtggtgactccattgacccagcttttcattaaaggataacacactgca

SEQ ID NO: 76934 - DNA, 7444 bp, Homo sapiens
  misc_feature (2652)..(2652): n is a, c, g, or t
gcccggccgacgcggctttgtctcctttgttcccggcggtggcagcgccgcgcgggaggggcgggcagcgggcgcagttttccgcccctcggtctccgggtaacagctgcggctccaccagacccggggagaggccgctgcgcgcggagcccgagcccggagcggccgacgcccgcctcggcgcgcacatcccgcggggcccggccgggtggtgactcccacacgggtcatgctgttgtctcctgatccagccggccctgccaggtgaccatgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcagagcccgcttgtctccccagaccctcctgcaagaggtggacccagcccctccccacccacagcccccaaagccctggccacccctgctcctgacacccttcccgtggagcctggggctccctccacagccacagcttcggacatctcacctggggctagtccttccctgctcagcccctgggggccatgggcaggttctggctccatatcttcccctggctccacagggtcgcctctccatgaggagccctcccctcccagcccccaaaatggacctggaaccgctgtccctgcccccactgacttcagaccctcagccacacctgaggacctcttggcctccccgctgtcaccntcagaggtagcagcagtgccccctgcagaccctggccccgaggctcttcatcccacagtgcccctggacctgccccctgccactgttcctgccaccactttcccaggggccatgggctccgtgaagcccgccctggactggctcacgagagaaggcggcgagctgcccgaggcggacgagtggacggggggtgacgcacccgccttctccacttccaccctcctctcaggtgatggagactcagcagagcttgagggccctcccgcccccctcatcctcccgtccagcctcgactaccagtatgacacccccgggctctgggagctggaagaggcgaccttgggggcaagctcctgcccctgtgtggagagcgttcagggctccacgttgatgccggtccatgtggagcgggaaatccggctgctaggcaggaacctgcaccttttccaggatggcccaggagacaatgagtgtgtgatggagctggagggcctcgaggtggtggttgaggcccgggtcgagtgtgagccacctccagatacccagtgccatgtcacctgccagcagcaccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaagtaggacacccttgggtacccccacactctccccttgccccataccacaccctggggacagccagagcaggtgccagaggaggctcttcccatctttgcttggcccctcgtcaacctgcctgtcttccttccagtttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggaggaggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccctggggcttttcctgtggcagcccaggtgggcttgggggtgggcacctctcttctggctctgggtgtcatcatcattgtcctcatgtacaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttgagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaaaacaaggtcacagatctataggaacccaggagccacggcctgctgttgcttcagcctggcctgggcagccctggaagctcggaggagaggccaccttcttaggtgcctgtagtgactgacaagcagagttagtggaaggtgactcccagtctcctggtggctctggcctcggccctgctggatccacctcctagacccggggcctcaaggctcatggggtagtacccagcctgctccccgagtccagcgaccctgtgacaccggtctgcagggagttggggactaagggcttccagagagtggctggaagagactccaggcccctggggagactgtactgttcctgaacactggccttggccacactgggattcggagaggaaggaggagagccccatgcttcctgtctgcctcctccaccatccctgacctcagttgagctgcctctggccttgttgctgctgccacatcctaggtctaagagttgaacgcctctcctaggccactacaaactgacccctcagcagggctggctgccacagggctgccctgcctcataggtagccatggtgagggctatctgctgcaggggggtcttggggagagtggtgactccattgacccagcttttcattaaaggataacacactgca

SEQ ID NO: 76935 - DNA, 2786 bp, Homo sapiens
ggtccctctcaagacctgaaacacttcaggatttatttccccactctaacccccagatccatttatgagaagtgagtgaggatggcagaagcaggggcatgggtgtgtgtgacttgcttgggacgggacaggctgaatcgtactgggctaggcttgagcttggctggcatggctgcattggactgtgctggatgaggccggggtgtgcctggggattgtcaggcaggcctgggcgagtaggactcatctggccatcctctcctgaccctggggctgagcaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttgagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaaaacaaggtcacagatctataggaacccaggagccacggcctgctgttgcttcagcctggcctgggcagccctggaagctcggaggagaggccaccttcttaggtgcctgtagtgactgacaagcagagttagtggaaggtgactcccagtctcctggtggctctggcctcggccctgctggatccacctcctagacccggggcctcaaggctcatggggtagtacccagcctgctccccgagtccagcgaccctgtgacaccggtctgcagggagttggggactaagggcttccagagagtggctggaagagactccaggcccctggggagactgtactgttcctgaacactggccttggccacactgggattcggagaggaaggaggagagccccatgcttcctgtctgcctcctccaccatccctgacctcagttgagctgcctctggccttgttgctgctgccacatcctaggtctaagagttgaacgcctctcctaggccactacaaactgacccctcagcagggctggctgccacagggctgccctgcctcataggtagccatggtgagggctatctgctgcaggggggtcttggggagagtggtgactccattgacccagcttttcattaaaggataacacactgca

SEQ ID NO: 76936 - DNA, 2739 bp, Homo sapiens
cctcacagaccctgtcagtcctagaggatggatgggggcagaagcaggggcatgggtgtgtgtgacttgcttgggacgggacaggctgaatcgtactgggctaggcttgagcttggctggcatggctgcattggactgtgctggatgaggccggggtgtgcctggggattgtcaggcaggcctgggcgagtaggactcatctggccatcctctcctgaccctggggctgagcaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttgagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaaaacaaggtcacagatctataggaacccaggagccacggcctgctgttgcttcagcctggcctgggcagccctggaagctcggaggagaggccaccttcttaggtgcctgtagtgactgacaagcagagttagtggaaggtgactcccagtctcctggtggctctggcctcggccctgctggatccacctcctagacccggggcctcaaggctcatggggtagtacccagcctgctccccgagtccagcgaccctgtgacaccggtctgcagggagttggggactaagggcttccagagagtggctggaagagactccaggcccctggggagactgtactgttcctgaacactggccttggccacactgggattcggagaggaaggaggagagccccatgcttcctgtctgcctcctccaccatccctgacctcagttgagctgcctctggccttgttgctgctgccacatcctaggtctaagagttgaacgcctctcctaggccactacaaactgacccctcagcagggctggctgccacagggctgccctgcctcataggtagccatggtgagggctatctgctgcaggggggtcttggggagagtggtgactccattgacccagcttttcattaaaggataacacactgca

SEQ ID NO: 76937 - DNA, 6166 bp, Homo sapiens
gcccggccgacgcggctttgtctcctttgttcccggcggtggcagcgccgcgcgggaggggcgggcagcgggcgcagttttccgcccctcggtctccgggtaacagctgcggctccaccagacccggggagaggccgctgcgcgcggagcccgagcccggagcggccgacgcccgcctcggcgcgcacatcccgcggggcccggccgggtggtgactcccacacgggtcatgctgttgtctcctgatccagccggccctgccaggtgaccatgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcaggtgatggagactcagcagagcttgagggccctcccgcccccctcatcctcccgtccagcctcgactaccagtatgacacccccgggctctgggagctggaagaggcgaccttgggggcaagctcctgcccctgtgtggagagcgttcagggctccacgttgatgccggtccatgtggagcgggaaatccggctgctaggcaggaacctgcaccttttccaggatggcccaggagacaatgagtgtgtgatggagctggagggcctcgaggtggtggttgaggcccgggtcgagtgtgagccacctccagatacccagtgccatgtcacctgccagcagcaccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccctggggcttttcctgtggcagcccaggtgggcttgggggtgggcacctctcttctggctctgggtgtcatcatcattgtcctcatgtacaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttgagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggtgaccacaagccacaaggaaagaagacgaagtttgaatagcttctgtccctctgctttcccttttccatttgaaagaaaggactctggggtttttactgttacctgatcaatggcagagcctcctgagtagctgggaggatcctgtagagtcacacct

SEQ ID NO: 76938 - DNA, 2157 bp, Homo sapiens
agttgctgctgttagtcagatctagaggatcccacttgcatgtaccggcttgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttgagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaaaacaaggtcacagatctataggaacccaggagccacggcctgctgttgcttcagcctggcctgggcagccctggaagctcggaggagaggccaccttcttaggtgcctgtagtgactgacaagcagagttagtggaaggtgactcccagtctcctggtggctctggcctcggccctgctggatccacctcctagacccggggcctcaaggctcatggggtagtacccagcctgctccccgagtccagcgaccctgtgacaccggtctgcagggagttggggactaagggcttccagagagtggctggaagagactccaggcccctggggagactgtactgttcctgaacactggccttggccacactgggattcggagaggaaggaggagagccccatgcttcctgtctgcctcctccaccatccctgacctcagttgagctgcctctggccttgttgctgctgccacatcctaggtctaagagttgaacgcctctcctaggccactacaaactgacccctcagcagggctggctgccacagggctgccctgcctcataggtagccatggtgagggctatctgctgcaggggggtcttggggagagtggtgactccattgacccagcttttcattaaaggataacacactgca

SEQ ID NO: 76939 - DNA, 5261 bp, Homo sapiens
  misc_feature (5073)..(5076): n is a, c, g, or t
  misc_feature (5150)..(5150): n is a, c, g, or t
  misc_feature (5160)..(5160): n is a, c, g, or t
  misc_feature (5195)..(5195): n is a, c, g, or t
  misc_feature (5225)..(5225): n is a, c, g, or t
gcccggccgacgcggctttgtctcctttgttcccggcggtggcagcgccgcgcgggaggggcgggcagcgggcgcagttttccgcccctcggtctccgggtaacagctgcggctccaccagacccggggagaggccgctgcgcgcggagcccgagcccggagcggccgacgcccgcctcggcgcgcacatcccgcggggcccggccgggtggtgactcccacacgggtcatgctgttgtctcctgatccagccggccctgccaggtgaccatgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcaggtgatggagactcagcagagcttgagggccctcccgcccccctcatcctcccgtccagcctcgactaccagtatgacacccccgggctctgggagctggaagaggcgaccttgggggcaagctcctgcccctgtgtggagagcgttcagggctccacgttgatgccggtccatgtggagcgggaaatccggctgctaggcaggaacctgcaccttttccaggatggcccaggagacaatgagtgtgtgatggagctggagggcctcgaggtggtggttgaggcccgggtcgagtgtgagccacctccagatacccagtgccatgtcacctgccagcagcaccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccctggggcttttcctgtggcagcccaggtgggcttgggggtgggcacctctcttctggctctgggtgtcatcatcattgtcctcatgtacaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcnnnncctgccaggtgaccatgcctgctctgggcccagctcttctccaggctctctgggccgggtgggtcctcaccctncagccccttncaccaactgcattcactcccaatggcacgtatctncagcacctggcaagggaccccacctcaggnaccctctacctgggggctaccaactttctgttccag

SEQ ID NO: 76940 - DNA, 5196 bp, Homo sapiens
gcccggccgacgcggctttgtctcctttgttcccggcggtggcagcgccgcgcgggaggggcgggcagcgggcgcagttttccgcccctcggtctccgggtaacagctgcggctccaccagacccggggagaggccgctgcgcgcggagcccgagcccggagcggccgacgcccgcctcggcgcgcacatcccgcggggcccggccgggtggtgactcccacacgggtcatgctgttgtctcctgatccagccggccctgccaggtgaccatgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcaggtgatggagactcagcagagcttgagggccctcccgcccccctcatcctcccgtccagcctcgactaccagtatgacacccccgggctctgggagctggaagaggcgaccttgggggcaagctcctgcccctgtgtggagagcgttcagggctccacgttgatgccggtccatgtggagcgggaaatccggctgctaggcaggaacctgcaccttttccaggatggcccaggagacaatgagtgtgtgatggagctggagggcctcgaggtggtggttgaggcccgggtcgagtgtgagccacctccagatacccagtgccatgtcacctgccagcagcaccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccctggggcttttcctgtggcagcccaggtgggcttgggggtgggcacctctcttctggctctgggtgtcatcatcattgtcctcatgtacaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatcctaggtctaagagttgaacgcctctcctaggccactacaaactgacccctcagcagggctggctgccacagggctgccctgcctcataggtagccatggtgagggctatctgctgcaggggggtcttggggagagtggtgactccattgacccagcttttcattaaaggataacacactgca

SEQ ID NO: 76941 - DNA, 4934 bp, Homo sapiens
gcccggccgacgcggctttgtctcctttgttcccggcggtggcagcgccgcgcgggaggggcgggcagcgggcgcagttttccgcccctcggtctccgggtaacagctgcggctccaccagacccggggagaggccgctgcgcgcggagcccgagcccggagcggccgacgcccgcctcggcgcgcacatcccgcggggcccggccgggtggtgactcccacacgggtcatgctgttgtctcctgatccagccggccctgccaggtgaccatgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcaggtgatggagactcagcagagcttgagggccctcccgcccccctcatcctcccgtccagcctcgactaccagtatgacacccccgggctctgggagctggaagaggcgaccttgggggcaagctcctgcccctgtgtggagagcgttcagggctccacgttgatgccggtccatgtggagcgggaaatccggctgctaggcaggaacctgcaccttttccaggatggcccaggagacaatgagtgtgtgatggagctggagggcctcgaggtggtggttgaggcccgggtcgagtgtgagccacctccagatacccagtgccatgtcacctgccagcagcaccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccctggggcttttcctgtggcagcccaggtgggcttgggggtgggcacctctcttctggctctgggtgtcatcatcattgtcctcatgtacaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggactccgtaggggagcctctgtacatgctctttcgagggattaagcaccaagtggataaggggccagtggacagtggaccgaagggcctacgggccattgacatgacttaccaaaaaacagataatgagaatcaagacaagcagccagagactaattattagcatcatccctctactataaaaaaaccaaatcaacgaaaatctataaagctgtaccc

SEQ ID NO: 76942 - DNA, 839 bp, Homo sapiens
ggctgactagaggacccgcctaagtggaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaaaacaaggtcacagatctataggaacccaggagccacggcctgctgttgcttcagcctggcctgggcagccctggaagctcggaggagaggccaccttcttaggtgcctgtagtgactgacaagcagagttagtggaaggtgactcccagtctcctggtggctctggcctcggccctgctggatccacctcctagacccggggcctcaaggctcatggggtagtacccagcctgctccccgagtccagcgaccctgtgacaccggtctgcagggagttggggactaagggcttccagagagtggctggaagagactccaggcccctggggagactgtactgttcctgaacactggccttggccacactgggattcggagaggaaggaggagagccccatgcttcctgtctgcctcctccaccatccctgacctcagttgagctgcctctggccttgttgctgctgccacatcctaggtctaagagttgaacgcctctcctaggccactacaaactgacccctcagcagggctggctgccacagggctgccctgcctcataggtagccatggtgagggctatctgctgcaggggggtcttggggagagtggtgactccattgacccagcttttcattaaaggataacacactgca

SEQ ID NO: 76943 - DNA, 4365 bp, Homo sapiens
  misc_feature (2652)..(2652): n is a, c, g, or t
gcccggccgacgcggctttgtctcctttgttcccggcggtggcagcgccgcgcgggaggggcgggcagcgggcgcagttttccgcccctcggtctccgggtaacagctgcggctccaccagacccggggagaggccgctgcgcgcggagcccgagcccggagcggccgacgcccgcctcggcgcgcacatcccgcggggcccggccgggtggtgactcccacacgggtcatgctgttgtctcctgatccagccggccctgccaggtgaccatgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcagagcccgcttgtctccccagaccctcctgcaagaggtggacccagcccctccccacccacagcccccaaagccctggccacccctgctcctgacacccttcccgtggagcctggggctccctccacagccacagcttcggacatctcacctggggctagtccttccctgctcagcccctgggggccatgggcaggttctggctccatatcttcccctggctccacagggtcgcctctccatgaggagccctcccctcccagcccccaaaatggacctggaaccgctgtccctgcccccactgacttcagaccctcagccacacctgaggacctcttggcctccccgctgtcaccntcagaggtagcagcagtgccccctgcagaccctggccccgaggctcttcatcccacagtgcccctggacctgccccctgccactgttcctgccaccactttcccaggggccatgggctccgtgaagcccgccctggactggctcacgagagaaggcggcgagctgcccgaggcggacgagtggacggggggtgacgcacccgccttctccacttccaccctcctctcaggtgatggagactcagcagagcttgagggccctcccgcccccctcatcctcccgtccagcctcgactaccagtatgacacccccgggctctgggagctggaagaggcgaccttgggggcaagctcctgcccctgtgtggagagcgttcagggctccacgttgatgccggtccatgtggagcgggaaatccggctgctaggcaggaacctgcaccttttccaggatggcccaggagacaatgagtgtgtgatggagctggagggcctcgaggtggtggttgaggcccgggtcgagtgtgagccacctccagatacccagtgccatgtcacctgccagcagcaccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcactgtgattcctctaactggaactatttcaatgatgtcattatttccctaccaacttcctttcagggcttgctgcgcgttt

SEQ ID NO: 76944 - DNA, 2196 bp, Homo sapiens
gcccggccgacgcggctttgtctcctttgttcccggcggtggcagcgccgcgcgggaggggcgggcagcgggcgcagttttccgcccctcggtctccgggtaacagctgcggctccaccagacccggggagaggccgctgcgcgcggagcccgagcccggagcggccgacgcccgcctcggcgcgcacatcccgcggggcccggccgggtggtgactcccacacgggtcatgctgttgtctcctgatccagccggccctgccaggtgaccatgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggtgaatgatcagataggcagggccctggtggggagggctctgggcatcaaggtctgggtagagatcttggatcctgatgtcggacatgccagataccacatggcctcacacaagtcacttcttttaggagctcagtttccccatctatttctaactcaggccagagggtgtttggggaggcctgagggctgttgattgctggtgcctgcccacattgggtgtcccataaatgtgagccctggtctgctgcccactagccccaacagtgtgtcc

SEQ ID NO: 76945 - DNA, 2112 bp, Homo sapiens
gcccggccgacgcggctttgtctcctttgttcccggcggtggcagcgccgcgcgggaggggcgggcagcgggcgcagttttccgcccctcggtctccgggtaacagctgcggctccaccagacccggggagaggccgctgcgcgcggagcccgagcccggagcggccgacgcccgcctcggcgcgcacatcccgcggggcccggccgggtggtgactcccacacgggtcatgctgttgtctcctgatccagccggccctgccaggtgaccatgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccggtggactacgtaccagtgtggagaggtaccga

SEQ ID NO: 76946 - DNA, 352 bp, Homo sapiens
cccctgccacggcaccatgccctccgagaggcacctgactctttgcctgagttcacggtcagtgggcaggtccctggccgggctgggcattgacctgggccaaacccttgctcacaggtggctcctgacacaggtgcagatggggaacttgcgcttctccctgggtcacgtgcagtatgacggcgagagccctggggcttttcctgtggcagcccaggtgggcttgggggtgggcacctctcttctggctctgggtgtcatcatcattgtcctcatgtacaggtgggtgcagccagatgtggctgggctggggcaggtcgtgggatctggctggactgggaagggacagacc

SEQ ID NO: 76947 - DNA, 495 bp, Homo sapiens
ggagggtcaggccctccaaacttctaagccctcagccaccatgcagctcggacacttgtgccagagcagagactcctgctcagcctgtcctcagtccccttaagcccatgtcctgtccccttccccagtgtgcgtcatgtcccatacacctctgccacctgctggggggccctaactgcctgtgctctcctaggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctggtgagggtgtgcaagtgtgtggcctgcagtctgagtgcggtgagggcgagggtggagagtgtgtgggtgtgtggggtctggacaccagcttctgatgtggtacctggatgtagagctgggttgacctctggctggctcctggagagagcccatca

SEQ ID NO: 76948 - DNA, 452 bp, Homo sapiens
cagtatggctgtgtgtggtgtgagggggagcgtccacgttgtgtgacccgggaggcctgtggtgaggctgaggctgtggccacccagtgcccagcgcccctcatccactcggtttgttgaaaggctggccatcccttcctcagtgctgcccttagagggagggtgtgggggcccaaaggtgggaggttggggctgcctttccagttgagtagaggtgagcagtccttgtcctggaacaggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcaggtaagctggctgcacccagcaggagcacggcgcagcctggggcctccgcggttggcgttgc

SEQ ID NO: 76949 - DNA, 7310 bp, Homo sapiens
  misc_feature (2652)..(2652): n is a, c, g, or t
gcccggccgacgcggctttgtctcctttgttcccggcggtggcagcgccgcgcgggaggggcgggcagcgggcgcagttttccgcccctcggtctccgggtaacagctgcggctccaccagacccggggagaggccgctgcgcgcggagcccgagcccggagcggccgacgcccgcctcggcgcgcacatcccgcggggcccggccgggtggtgactcccacacgggtcatgctgttgtctcctgatccagccggccctgccaggtgaccatgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcagagcccgcttgtctccccagaccctcctgcaagaggtggacccagcccctccccacccacagcccccaaagccctggccacccctgctcctgacacccttcccgtggagcctggggctccctccacagccacagcttcggacatctcacctggggctagtccttccctgctcagcccctgggggccatgggcaggttctggctccatatcttcccctggctccacagggtcgcctctccatgaggagccctcccctcccagcccccaaaatggacctggaaccgctgtccctgcccccactgacttcagaccctcagccacacctgaggacctcttggcctccccgctgtcaccntcagaggtagcagcagtgccccctgcagaccctggccccgaggctcttcatcccacagtgcccctggacctgccccctgccactgttcctgccaccactttcccaggggccatgggctccgtgaagcccgccctggactggctcacgagagaaggcggcgagctgcccgaggcggacgagtggacggggggtgacgcacccgccttctccacttccaccctcctctcaggtgatggagactcagcagagcttgagggccctcccgcccccctcatcctcccgtccagcctcgactaccagtatgacacccccgggctctgggagctggaagaggcgaccttgggggcaagctcctgcccctgtgtggagagcgttcagggctccacgttgatgccggtccatgtggagcgggaaatccggctgctaggcaggaacctgcaccttttccaggatggcccaggagacaatgagtgtgtgatggagctggagggcctcgaggtggtggttgaggcccgggtcgagtgtgagccacctccagatacccagtgccatgtcacctgccagcagcaccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggaggaggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccctggggcttttcctgtggcagcccaggtgggcttgggggtgggcacctctcttctggctctgggtgtcatcatcattgtcctcatgtacaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttgagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaaaacaaggtcacagatctataggaacccaggagccacggcctgctgttgcttcagcctggcctgggcagccctggaagctcggaggagaggccaccttcttaggtgcctgtagtgactgacaagcagagttagtggaaggtgactcccagtctcctggtggctctggcctcggccctgctggatccacctcctagacccggggcctcaaggctcatggggtagtacccagcctgctccccgagtccagcgaccctgtgacaccggtctgcagggagttggggactaagggcttccagagagtggctggaagagactccaggcccctggggagactgtactgttcctgaacactggccttggccacactgggattcggagaggaaggaggagagccccatgcttcctgtctgcctcctccaccatccctgacctcagttgagctgcctctggccttgttgctgctgccacatcctaggtctaagagttgaacgcctctcctaggccactacaaactgacccctcagcagggctggctgccacagggctgccctgcctcataggtagccatggtgagggctatctgctgcaggggggtcttggggagagtggtgactccattgacccagcttttcattaaaggataacacactgca

SEQ ID NO: 76950 - DNA, 7558 bp, Homo sapiens
  misc_feature (2652)..(2652): n is a, c, g, or t
gcccggccgacgcggctttgtctcctttgttcccggcggtggcagcgccgcgcgggaggggcgggcagcgggcgcagttttccgcccctcggtctccgggtaacagctgcggctccaccagacccggggagaggccgctgcgcgcggagcccgagcccggagcggccgacgcccgcctcggcgcgcacatcccgcggggcccggccgggtggtgactcccacacgggtcatgctgttgtctcctgatccagccggccctgccaggtgaccatgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcagagcccgcttgtctccccagaccctcctgcaagaggtggacccagcccctccccacccacagcccccaaagccctggccacccctgctcctgacacccttcccgtggagcctggggctccctccacagccacagcttcggacatctcacctggggctagtccttccctgctcagcccctgggggccatgggcaggttctggctccatatcttcccctggctccacagggtcgcctctccatgaggagccctcccctcccagcccccaaaatggacctggaaccgctgtccctgcccccactgacttcagaccctcagccacacctgaggacctcttggcctccccgctgtcaccntcagaggtagcagcagtgccccctgcagaccctggccccgaggctcttcatcccacagtgcccctggacctgccccctgccactgttcctgccaccactttcccaggggccatgggctccgtgaagcccgccctggactggctcacgagagaaggcggcgagctgcccgaggcggacgagtggacggggggtgacgcacccgccttctccacttccaccctcctctcaggtgatggagactcagcagagcttgagggccctcccgcccccctcatcctcccgtccagcctcgactaccagtatgacacccccgggctctgggagctggaagaggcgaccttgggggcaagctcctgcccctgtgtggagagcgttcagggctccacgttgatgccggtccatgtggagcgggaaatccggctgctaggcaggaacctgcaccttttccaggatggcccaggagacaatgagtgtgtgatggagctggagggcctcgaggtggtggttgaggcccgggtcgagtgtgagccacctccagatacccagtgccatgtcacctgccagcagcaccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggaggaggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccctggggcttttcctgtggcagcccaggtgggcttgggggtgggcacctctcttctggctctgggtgtcatcatcattgtcctcatgtacaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttgagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaaaacaaggtcacagatctataggaacccaggagccacggcctgctgttgcttcagcctggcctgggcagccctggaagctcggaggagaggccaccttcttaggtgcctgtagtgactgacaagcagagttagtggaaggtgactcccagtctcctggtggctctggcctcggccctgctggatccacctcctagacccggggcctcaaggctcatggggtagtacccagcctgctccccgagtccagcgaccctgtgacaccggtctgcagggagttggggactaagggcttccagagagtggctggaagagactccaggcccctggggagactgtactgttcctgaacactggccttggccacactgggattcggagaggaaggaggagagccccatgcttcctgtctgcctcctccaccatccctgacctcagttgagctgcctctggccttgttgctgctgccacatcctaggtctaagagttgaacgcctctcctaggccactacaaactgacccctcagcagggctggctgccacagggctgccctgcctcataggtagccatggtgagggctatctgctgcaggggggtcttggggagagtggtgactccattgacccagcttttcattaaaggataacacactgcaaaaaaaaataaataaaaaaaaaaaatattcgagacgccccgggccatcgaaaaacactcaaagacaaacagttcgagagcaccagccaaccaagagagacacaagcggacagaccggtacaaggacaacgcgcgacaaaacaagacagaggaaccaccaaatacaaacgccggcggaaaacaagcgatacgaaaaagcaacagagaccaaggaagcgcgaaaaacggaggaagcgacacattaaaccg

SEQ ID NO: 76951 - DNA, 7032 bp, Homo sapiens
gcccggccgacgcggctttgtctcctttgttcccggcggtggcagcgccgcgcgggaggggcgggcagcgggcgcagttttccgcccctcggtctccgggtaacagctgcggctccaccagacccggggagaggccgctgcgcgcggagcccgagcccggagcggccgacgcccgcctcggcgcgcacatcccgcggggcccggccgggtggtgactcccacacgggtcatgctgttgtctcctgatccagccggccctgccaggtgaccatgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcaggtgatggagactcagcagagcttgagggccctcccgcccccctcatcctcccgtccagcctcgactaccagtatgacacccccgggctctgggagctggaagaggcgaccttgggggcaagctcctgcccctgtgtggagagcgttcagggctccacgttgatgccggtccatgtggagcgggaaatccggctgctaggcaggaacctgcaccttttccaggatggcccaggagacaatgagtgtgtgatggagctggagggcctcgaggtggtggttgaggcccgggtcgagtgtgagccacctccagatacccagtgccatgtcacctgccagcagcaccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccctggggcttttcctgtggcagcccaggtgggcttgggggtgggcacctctcttctggctctgggtgtcatcatcattgtcctcatgtacaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttggtgagggcgtggagagcccctggggacctgagccactgttgggcctgggctggccccggaccaactctgcagggacaactcatcactcagggtggggaggatgctgggaggcaggcagaagctggctttggaacatctttcttggacagcctctcatctggggagggggtccctgctcttggtctttggagaggttgagtaaggctgccccatgatggaggggctggtgtccctgtggaggaggagatgggctccactatgggaagggtatcttccagccctgcacccagttctgccttgcccttgcagagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaaaacaaggtcacagatctataggaacccaggagccacggcctgctgttgcttcagcctggcctgggcagccctggaagctcggaggagaggccaccttcttaggtgcctgtagtgactgacaagcagagttagtggaaggtgactcccagtctcctggtggctctggcctcggccctgctggatccacctcctagacccggggcctcaaggctcatggggtagtacccagcctgctccccgagtccagcgaccctgtgacaccggtctgcagggagttggggactaagggcttccagagagtggctggaagagactccaggcccctggggagactgtactgttcctgaacactggccttggccacactgggattcggagaggaaggaggagagccccatgcttcctgtctgcctcctccaccatccctgacctcagttgagctgcctctggccttgttgctgctgccacatcctaggtctaagagttgaacgcctctcctaggccactacaaactgacccctcagcagggctggctgccacagggctgccctgcctcataggtagccatggtgagggctatctgctgcaggggggtcttggggagagtggtgactccattgacccagcttttcattaaaggataacacactgca

SEQ ID NO: 76952 - DNA, 5701 bp, Homo sapiens
  misc_feature (1043)..(1043): n is a, c, g, or t
taacatgatagatcgagcgcttacctgcagctctctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcagagcccgcttgtctccccagaccctcctgcaagaggtggacccagcccctccccacccacagcccccaaagccctggccacccctgctcctgacacccttcccgtggagcctggggctccctccacagccacagcttcggacatctcacctggggctagtccttccctgctcagcccctgggggccatgggcaggttctggctccatatcttcccctggctccacagggtcgcctctccatgaggagccctcccctcccagcccccaaaatggacctggaaccgctgtccctgcccccactgacttcagaccctcagccacacctgaggacctcttggcctccccgctgtcaccntcagaggtagcagcagtgccccctgcagaccctggccccgaggctcttcatcccacagtgcccctggacctgccccctgccactgttcctgccaccactttcccaggggccatgggctccgtgaagcccgccctggactggctcacgagagaaggcggcgagctgcccgaggcggacgagtggacggggggtgacgcacccgccttctccacttccaccctcctctcaggtgatggagactcagcagagcttgagggccctcccgcccccctcatcctcccgtccagcctcgactaccagtatgacacccccgggctctgggagctggaagaggcgaccttgggggcaagctcctgcccctgtgtggagagcgttcagggctccacgttgatgccggtccatgtggagcgggaaatccggctgctaggcaggaacctgcaccttttccaggatggcccaggagacaatgagtgtgtgatggagctggagggcctcgaggtggtggttgaggcccgggtcgagtgtgagccacctccagatacccagtgccatgtcacctgccagcagcaccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggaggaggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccctggggcttttcctgtggcagcccaggtgggcttgggggtgggcacctctcttctggctctgggtgtcatcatcattgtcctcatgtacaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttgagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaaaacaaggtcacagatctataggaacccaggagccacggcctgctgttgcttcagcctggcctgggcagccctggaagctcggaggagaggccaccttcttaggtgcctgtagtgactgacaagcagagttagtggaaggtgactcccagtctcctggtggctctggcctcggccctgctggatccacctcctagacccggggcctcaaggctcatggggtagtacccagcctgctccccgagtccagcgaccctgtgacaccggtctgcagggagttggggactaagggcttccagagagtggctggaagagactccaggcccctggggagactgtactgttcctgaacactggccttggccacactgggattcggagaggaaggaggagagccccatgcttcctgtctgcctcctccaccatccctgacctcagttgagctgcctctggccttgttgctgctgccacatcctaggtctaagagttgaacgcctctcctaggccactacaaactgacccctcagcagggctggctgccacagggctgccctgcctcataggtagccatggtgagggctatctgctgcaggggggtcttggggagagtggtgactccattgacccagcttttcattaaaggataacacactgca

SEQ ID NO: 76953 - DNA, 3368 bp, Homo sapiens
gagctcggtaccctatccgtgtccggggttggggctgagctgacctagccgggactgggctgtgctttaggtccaggtaacataagccatcttacgttacgtaagctcacggtctgtttcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggaggaggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccctggggcttttcctgtggcagcccaggtgggcttgggggtgggcacctctcttctggctctgggtgtcatcatcattgtcctcatgtacaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttgagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaaaacaaggtcacagatctataggaacccaggagccacggcctgctgttgcttcagcctggcctgggcagccctggaagctcggaggagaggccaccttcttaggtgcctgtagtgactgacaagcagagttagtggaaggtgactcccagtctcctggtggctctggcctcggccctgctggatccacctcctagacccggggcctcaaggctcatggggtagtacccagcctgctccccgagtccagcgaccctgtgacaccggtctgcagggagttggggactaagggcttccagagagtggctggaagagactccaggcccctggggagactgtactgttcctgaacactggccttggccacactgggattcggagaggaaggaggagagccccatgcttcctgtctgcctcctccaccatccctgacctcagttgagctgcctctggccttgttgctgctgccacatcctaggtctaagagttgaacgcctctcctaggccactacaaactgacccctcagcagggctggctgccacagggctgccctgcctcataggtagccatggtgagggctatctgctgcaggggggtcttggggagagtggtgactccattgacccagcttttcattaaaggataacacactgca

SEQ ID NO: 76954 - DNA, 2996 bp, Homo sapiens
gccagatgtggctgggctggggcaggtcgtgggatctggctggactgggaagggacagaccgggccaggagtcaggaaacattctctgtaaatggccagagagtaaatattttcgctttgcaggccaagtggtctctgttcaacaactcagctttgccactgtggcacaaaggcagccagggacgacatggaaacacatgaaagtggctgtgttctaacaaatctttataaaaataggttgtgggatggatttggcctggttgtggttggctgatctctaggctaaactgtgctgggctagacggggcatgggtgtgtgtgacttgcttgggacgggacaggctgaatcgtactgggctaggcttgagcttggctggcatggctgcattggactgtgctggatgaggccggggtgtgcctggggattgtcaggcaggcctgggcgagtaggactcatctggccatcctctcctgaccctggggctgagcaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttgagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaaaacaaggtcacagatctataggaacccaggagccacggcctgctgttgcttcagcctggcctgggcagccctggaagctcggaggagaggccaccttcttaggtgcctgtagtgactgacaagcagagttagtggaaggtgactcccagtctcctggtggctctggcctcggccctgctggatccacctcctagacccggggcctcaaggctcatggggtagtacccagcctgctccccgagtccagcgaccctgtgacaccggtctgcagggagttggggactaagggcttccagagagtggctggaagagactccaggcccctggggagactgtactgttcctgaacactggccttggccacactgggattcggagaggaaggaggagagccccatgcttcctgtctgcctcctccaccatccctgacctcagttgagctgcctctggccttgttgctgctgccacatcctaggtctaagagttgaacgcctctcctaggccactacaaactgacccctcagcagggctggctgccacagggctgccctgcctcataggtagccatggtgagggctatctgctgcaggggggtcttggggagagtggtgactccattgacccagcttttcattaaaggataacacactgca

SEQ ID NO: 76955 - DNA, 2530 bp, Homo sapiens
ccccttgctagagctcaccttggcagagctccccttgccagagctccccttggagctccccttggtagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttgagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaaaacaaggtcacagatctataggaacccaggagccacggcctgctgttgcttcagcctggcctgggcagccctggaagctcggaggagaggccaccttcttaggtgcctgtagtgactgacaagcagagttagtggaaggtgactcccagtctcctggtggctctggcctcggccctgctggatccacctcctagacccggggcctcaaggctcatggggtagtacccagcctgctccccgagtccagcgaccctgtgacaccggtctgcagggagttggggactaagggcttccagagagtggctggaagagactccaggcccctggggagactgtactgttcctgaacactggccttggccacactgggattcggagaggaaggaggagagccccatgcttcctgtctgcctcctccaccatccctgacctcagttgagctgcctctggccttgttgctgctgccacatcctaggtctaagagttgaacgcctctcctaggccactacaaactgacccctcagcagggctggctgccacagggctgccctgcctcataggtagccatggtgagggctatctgctgcaggggggtcttggggagagtggtgactccattgacccagcttttcattaaaggataacacactgca

SEQ ID NO: 76956 - DNA, 6016 bp, Homo sapiens
gcccggccgacgcggctttgtctcctttgttcccggcggtggcagcgccgcgcgggaggggcgggcagcgggcgcagttttccgcccctcggtctccgggtaacagctgcggctccaccagacccggggagaggccgctgcgcgcggagcccgagcccggagcggccgacgcccgcctcggcgcgcacatcccgcggggcccggccgggtggtgactcccacacgggtcatgctgttgtctcctgatccagccggccctgccaggtgaccatgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcaggtgatggagactcagcagagcttgagggccctcccgcccccctcatcctcccgtccagcctcgactaccagtatgacacccccgggctctgggagctggaagaggcgaccttgggggcaagctcctgcccctgtgtggagagcgttcagggctccacgttgatgccggtccatgtggagcgggaaatccggctgctaggcaggaacctgcaccttttccaggatggcccaggagacaatgagtgtgtgatggagctggagggcctcgaggtggtggttgaggcccgggtcgagtgtgagccacctccagatacccagtgccatgtcacctgccagcagcaccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctgcagccactcaaccctgaggaccccaccatgccattccggcacaagcctgggagtgtgttctccgtggagggggagaacctggaccttgcaatgtccaaggggtggtggctatgataggggatggcccctgtgtggtgaagacgctgacgcggcaccacctgtactgcgagccccccgtggagcagcccctgccacggcaccatgccctccgagaggcacctgactctttgcctgagttcacggtgcagatggggaacttgcgcttctccctgggtcacgtgcagtatgacggcgagagccctggggcttttcctgtggcagcccaggtgggcttgggggtgggcacctctcttctggctctgggtgtcatcatcattgtcctcatgtacaggaggaagagcaagcaggccctgagggactataagaaggttcagatccagctggagaatctggagagcagtgtgcgggaccgctgcaagaaggaattcacagacctcatgactgagatgaccgatctcaccagtgacctcctgggcagcggcatccccttcctcgactacaaggtgtatgcggagaggatcttcttccctgggcaccgcgagtcgcccttgcaccgggacctgggtgtgcctgagagcagacggcccactgtggagcaagggctggggcagctctctaacctgctcaacagcaagctcttcctcaccaagttcatccacacgctggagagccagcgcaccttttcagctcgggaccgtgcctacgtggcatctctgctcaccgtggcactgcatgggaagcttgagtatttcactgacatcctccgcactctgctcagtgacctggttgcccagtatgtggccaagaaccccaagctgatgctgcgcaggacagagactgtggtggagaagctgctcaccaactggatgtccatctgtctgtataccttcgtgagggactccgtaggggagcctctgtacatgctctttcgagggattaagcaccaagtggataaggggccagtggacagtgtgacaggcaaggccaaatacaccttgaacgacaaccgcctgctcagagaggatgtggagtaccgtcccctgaccttgaatgcactattggctgtggggcctggggcaggagaggcccagggcgtgcccgtgaaggtcctagactgtgacaccatctcccaggcaaaggagaagatgctggaccagctttataaaggagtgcctctcacccagcggccagaccctcgcacccttgatgttgagtggcggtctggggtggccgggcacctcattctttctgacgaggatgtcacttctgaggtccagggtctgtggaggcgcctgaacacactgcagcattacaaggtcccagatggagcaactgtggccctcgtcccctgcctcaccaagcatgtgctccgggaaaaccaggattatgtccctggagagcggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctgggtaaggcctccctctgcttcttgggttgggcataggcctcctgccacaacggtccttcccccttcacactgcccctttgcagggaagcccttgggaacctcagca

SEQ ID NO: 76957 - DNA, 1467 bp, Homo sapiens
ggaggggtgacagctgtgggctcttggcacagggaccccaatgctggaggatgtagatgaggggggcatccggccctggcacctggtgaagccaagtgatgagccggagccgcccaggcctcggaggggcagccttcggggcggggagcgtgagcgcgccaaggccatccctgagatctacctgacccgcctgctgtccatgaagggcaccctgcagaagttcgtggatgacctgttccaggtgattctcagcaccagccgccccgtgccgctcgctgtgaagtacttctttgacctgctggatgagcaggcccagcagcatggcatctccgaccaggacaccatccacatctggaagaccaacagcttgcctctgaggttctggatcaatataataaaaaacccgcagtttgtgttcgacgtgcaaacatctgataacatggatgcggtgctccttgtcattgcacagaccttcatggacgcctgcaccctggccgaccacaagctgggccgggactccccgatcaacaaacttctgtatgcacgggacattccccggtacaagcggatggtggaaaggtactatgcagacatcagacagactgtcccagccagcgaccaagagatgaactctgtcctggctgaactgtcctggaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaaaacaaggtcacagatctataggaacccaggagccacggcctgctgttgcttcagcctggcctgggcagccctggaagctcggaggagaggccaccttcttaggtgcctgtagtgactgacaagcagagttagtggaaggtgactcccagtctcctggtggctctggcctcggccctgctggatccacctcctagacccggggcctcaaggctcatggggtagtacccagcctgctccccgagtccagcgaccctgtgacaccggtctgcagggagttggggactaagggcttccagagagtggctggaagagactccaggcccctggggagactgtactgttcctgaacactggccttggccacactgggattcggagaggaaggaggagagccccatgcttcctgtctgcctcctccaccatccctgacctcagttgagctgcctctggccttgttgctgctgccacatcctaggtctaagagttgaacgcctctcctaggccactacaaactgacccctcagcagggctggctgccacagggctgccctgcctcataggtagccatggtgagggctatctgctgcaggggggtcttggggagagtggtgactccattgacccagcttttcattaaaggataacacactgca

SEQ ID NO: 76958 - DNA, 1079 bp, Homo sapiens
aaccccagaccttgctgaagcaggtagacctgggctgtcttcctaccaaggaggcccccttgctctaccctgttctgtccccatctggcacacctggcctggggtccctgggccatggaggggactctgcttcccactgtagtgcccatcccattctctacctctcaggtccccttctcccccagcccttccctggggtcctgggctgcctcctgtggctctctgcacccctcgtctctctcacctttcatttggcctcttccctagaactactccggagacctcggggcgcgagtggccctgcatgaactctacaagtacatcaacaagtactatgaccagatcatcactgccctggaggaggatggcacggcccagaagatgcagctgggctatcggctccagcagattgcagctgctgtggaaaacaaggtcacagatctataggaacccaggagccacggcctgctgttgcttcagcctggcctgggcagccctggaagctcggaggagaggccaccttcttaggtgcctgtagtgactgacaagcagagttagtggaaggtgactcccagtctcctggtggctctggcctcggccctgctggatccacctcctagacccggggcctcaaggctcatggggtagtacccagcctgctccccgagtccagcgaccctgtgacaccggtctgcagggagttggggactaagggcttccagagagtggctggaagagactccaggcccctggggagactgtactgttcctgaacactggccttggccacactgggattcggagaggaaggaggagagccccatgcttcctgtctgcctcctccaccatccctgacctcagttgagctgcctctggccttgttgctgctgccacatcctaggtctaagagttgaacgcctctcctaggccactacaaactgacccctcagcagggctggctgccacagggctgccctgcctcataggtagccatggtgagggctatctgctgcaggggggtcttggggagagtggtgactccattgacccagcttttcattaaaggataacacactgca

SEQ ID NO: 76959 - DNA, 4302 bp, Homo sapiens
  misc_feature (2652)..(2652): n is a, c, g, or t
gcccggccgacgcggctttgtctcctttgttcccggcggtggcagcgccgcgcgggaggggcgggcagcgggcgcagttttccgcccctcggtctccgggtaacagctgcggctccaccagacccggggagaggccgctgcgcgcggagcccgagcccggagcggccgacgcccgcctcggcgcgcacatcccgcggggcccggccgggtggtgactcccacacgggtcatgctgttgtctcctgatccagccggccctgccaggtgaccatgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcagagcccgcttgtctccccagaccctcctgcaagaggtggacccagcccctccccacccacagcccccaaagccctggccacccctgctcctgacacccttcccgtggagcctggggctccctccacagccacagcttcggacatctcacctggggctagtccttccctgctcagcccctgggggccatgggcaggttctggctccatatcttcccctggctccacagggtcgcctctccatgaggagccctcccctcccagcccccaaaatggacctggaaccgctgtccctgcccccactgacttcagaccctcagccacacctgaggacctcttggcctccccgctgtcaccntcagaggtagcagcagtgccccctgcagaccctggccccgaggctcttcatcccacagtgcccctggacctgccccctgccactgttcctgccaccactttcccaggggccatgggctccgtgaagcccgccctggactggctcacgagagaaggcggcgagctgcccgaggcggacgagtggacggggggtgacgcacccgccttctccacttccaccctcctctcaggtgatggagactcagcagagcttgagggccctcccgcccccctcatcctcccgtccagcctcgactaccagtatgacacccccgggctctgggagctggaagaggcgaccttgggggcaagctcctgcccctgtgtggagagcgttcagggctccacgttgatgccggtccatgtggagcgggaaatccggctgctaggcaggaacctgcaccttttccaggatggcccaggagacaatgagtgtgtgatggagctggagggcctcgaggtggtggttgaggcccgggtcgagtgtgagccacctccagatacccagtgccatgtcacctgccagcagcaccagctcagctatgaggctctgcagccggagctccgtgtggggctgtttctgcgtcgggccggccgtctgcgtgtggacagtgctgaggggctgcatgtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcagcctcgtgtgcatcaccggggccagtggggaggaggtggccggcgccacagcggtggaggtgccgggaagaggacgtggtgtctcagaacacgactttgcctaccaggatccgaaggtccattccatcttcccggcccgcggccccagagctgggggcacccgtctcaccctgaatggctccaagctcctgactgggcggctggaggacatccgagtggtggttggagaccagccttgtcacttgctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaatttagagagccgtgccatgcaactcctcccagctcaccacgccacccctgctggtaccgagctcaa

SEQ ID NO: 76960 - DNA, 2548 bp, Homo sapiens
gcccggccgacgcggctttgtctcctttgttcccggcggtggcagcgccgcgcgggaggggcgggcagcgggcgcagttttccgcccctcggtctccgggtaacagctgcggctccaccagacccggggagaggccgctgcgcgcggagcccgagcccggagcggccgacgcccgcctcggcgcgcacatcccgcggggcccggccgggtggtgactcccacacgggtcatgctgttgtctcctgatccagccggccctgccaggtgaccatgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgcctgatgagtgcccccaggcccagcctaccaacaacccgaatcagctgctcctggtgagcccaggggccctggtggtatgcgggagcgtgcaccagggggtctgtgaacagcggcgcctggggcagctcgagcagctgctgctgcggccagagcggcctggggacacacaatatgtggctgccaatgatcctgcggtcagcacggtggggctggtagcccagggcttggcaggggagcccctcctgtttgtggggcgaggatacaccagcaggggtgtggggggtggcattccacccatcacaacccgggccctgtggccgcccgacccccaagctgccttctcctatgaggagacagccaagctggcagtgggccgcctctccgagtacagccaccacttcgtgagtgcctttgcacgtggggccagcgcctacttcctgttcctgcggcgggacctgcaggctcagtctagagcttttcgtgcctatgtatctcgagtgtgtctccgggaccagcactactactcctatgtggagttgcctctggcctgcgaaggtggccgctacgggctgatccaggctgcagctgtggccacgtccagggaggtggcgcatggggaggtgctctttgcagctttctcctcggctgcaccccccactgtgggccggcccccatcggcggctgctggggcatctggagcctctgccctctgtgccttccccctggatgaggtggaccggcttgctaatcgcacgcgagatgcctgctacacccgggagggtcgtgctgaggatgggaccgaggtggcctacatcgagtatgatgtcaattctgactgtgcacagctgccagtggacaccctggatgcttatccctgtggctcagaccacacgcccagccccatggccagccgggtcccgctggaagccacaccaattctggagtggccagggattcagctaacagctgtggcagtcaccatggaagatggacacaccatcgctttcctgggtgatagtcaagggcagctgcacagggtctacttgggcccagggagcgatggccacccatactccacacagagcatccagcaggggtctgcagtgagcagagacctcacctttgatgggacctttgagcacctgtatgtcatgacccagagcacacttctgaaggttcctgtggcttcctgtgctcagcacctggactgtgcatcttgccttgctcacagggacccatactgtgggtggtgcgtgctccttggcaggtgcagtcgccgttctgagtgctcgaggggccagggcccagagcagtggctatggagcttccagcctgagctgggctgtctgcaagtggcagccatgagtcctgccaacatcagccgagaggagacgagggaggttttcctatcagtgccagacctgccacccctgtggccaggggagtcatattcctgccactttggggaacatcagagtcctgccctgctgactggttctggtgtgatgtgcccctccccagaccctagtgaggccccagtgctgccgagaggagccgactacgtatccgtgagcgtggagctcagatttggcgctgttgtgatcgccaaaacttccctctctttctatgactgtgtggcggtcactgaactccgcccatctgcgcagtgccaggcctgtgtgagcagccgctgggggtgtaactggtgtgtctggcagcacctgtgcacccacaaggcctcgtgtgatgctgggcccatggttgcaagccatcaggtgagtgtgactttgggctgggccataccgggggggttgggggtcccagtgtgagagtttttctcatggcccggggtctgtctgcctatgtgaggctctgtcctgagcaccagagccgctgtatgtgacggactccctggagaacagccgccgatacatcccgcctgttttgggagagggcatttgtagctgagaggcaggggatgtctggccttcatgccccacctcggcacagacacccctggagcct

SEQ ID NO: 76961 - DNA, 421 bp, Homo sapiens
atcctggacatagtgcctatctaagaagcctggtcctcctctgctcaccccctaggttaggaggagcatcttggcaatgccacagtcctatcccttaccagtggccccagggtgctctggcggccacgtgagccccactctctcgacctctcttcctgccaggtgaccatgcctgctctgggcccagctcttctccaggctctctgggccgggtgggtcctcaccctccagccccttccaccaactgcattcactcccaatggcacgtatctgcagcacctggcaagggaccccacctcaggcaccctctacctgggggctaccaacttcctgttccagctgagccctgggctgcagctggaggccacagtgtccaccggccctgtgctagacagcagggactgcctgccacctgtgatgc

SEQ ID NO: 76962 - DNA, 902 bp, Homo sapiens
tctgtgcattgtaggatgtttagcggcatccctagattctacccattagatgccagttgtccccctcagtttacaaccaaaattatttccaaattaccaaatgtctgctggaaggaaaatcactcccagttgagaaccattgatgtaagcagtgatcatcagtgccgccttttttgttttttgttttaaaaccttaaaatctgtgaaaatgccttcctaaaaccattaaatagtttttctgcaacttcataattgatggcttaaactgatggcactagaactaaactgatcaatagtaacatcacagagagataacccaaagagtgtgtaccttttaatttgatagaattagaagtagtatacaataccaactgcaaaatagtaagtattcttgccaaagaactaaatctgaatcaaatcaggcctctaggtctaacttcttctctatggaaaatacaggaggacatgtgaaatgacaccagaggagtataaccagcaaaattcaggatatggaaaattctacagaacaaaaggcctggtatcatcaacaaataaatagaaaaaaagagaaggagaccaaacaagagttaacaaactttttctgtaaagggtgccagataaaagtagtttaggctttgcagaccatatagactctgtcacaaatgcaaaagcagtcgtagacagtacattaacaaatgagcatggctatgtctggtaaaagtttatttacaaagccaggtgtgaaggccagtttgtttacatgtggctataaataaactctgtaaaggcaggttggagtttgctgaccctgaattaaaagatgcttaaaaagacatccaaatgtattgtgccactgcacttcagcctgggcgacagaacaagactccgtctcaaaaaaaaaa

SEQ ID NO: 76963 - DNA, 4116 bp, Homo sapiens
attaattctggctccacttgttgctcggcccaggttggggagaggacggagggtggccgcagcgggttcctgagtgaattacccaggagggactgagcacagcaccaactagagaggggtcagggggtgcgggactcgagcgagcaggaaggaggcagcgcctggcaccagggctttgactcaacagaattgagacacgtttgtaatcgctggcgtgccccgcgcacaggatcccagcgaaaatcagatttcctggtgaggttgcgtgggtggattaatttggaaaaagaaactgcctatatcttgccatcaaaaaactcacggaggagaagcgcagtcaatcaacagtaaacttaagagaccccggatgcttccgttgtttaaacttgtatgcttgaaaattatctgagaggcaataaacatctgctcctttcttccctctccagaagtccattggaatattaagcccaggagttgctttggggatggctggaagtgcaatgtcttccaagttcttcctagtggctttggccatatttttctccttcgcccaggttgtaattgaagccaattcttggtggtcgctaggtatgaataaccctgttcagatgtcagaagtatatattataggagcacagcctctctgcagccaactggcaggactttctcaaggacagaagaaactgtgccacttgtatcaggaccacatgcagtacatcggagaaggcgcgaagacaggcatcaaagaatgccagtatcaattccgacatcgaaggtggaactgcagcactgtggataacacctctgtttttggcagggtgatgcagataggcagccgcgagacggccttcacatacgccgtgagcgcagcaggggtggtgaacgccatgagccgggcgtgccgcgagggcgagctgtccacctgcggctgcagccgcgccgcgcgccccaaggacctgccgcgggactggctctggggcggctgcggcgacaacatcgactatggctaccgctttgccaaggagttcgtggacgcccgcgagcgggagcgcatccacgccaagggctcctacgagagtgctcgcatcctcatgaacctgcacaacaacgaggccggccgcaggacggtgtacaacctggctgatgtggcctgcaagtgccatggggtgtccggctcatgtagcctgaagacatgctggctgcagctggcagacttccgcaaggtgggtgatgccctgaaggagaagtacgacagcgcggcggccatgcggctcaacagccggggcaagttggtacaggtcaacagccgcttcaactcgcccaccacacaagacctggtctacatcgaccccagccctgactactgcgtgcgcaatgagagcaccggctcgctgggcacgcagggccgcctgtgcaacaagacgtcggagggcatggatggctgcgagctcatgtgctgcggccgtgggtacgaccagttcaagaccgtgcagacggagcgctgccactgcaagttccactggtgctgctacgtcaagtgcaagaagtgcacggagatcgtggaccagtttgtgtgcaagtagtgggtgccacccagcactcagccccgctcccaggacccgcttatttatagaaagtacagtgattctggtttttggtttttagaaatattttttatttttccccaagaattgcaaccggaaccattttttttcctgttaccatctaagaactctgtggtttattattaatattataattattatttggcaataatgggggtgggaaccacgaaaaatatttattttgtggatctttgaaaaggtaatacaagacttcttttggatagtatagaatgaagggggaaataacacataccctaacttagctgtgtgggacatggtacacatccagaaggtaaagaaatacattttctttttctcaaatatgccatcatatgggatgggtaggttccagttgaaagagggtggtagaaatctattcacaattcagcttctatgaccaaaatgagttgtaaattctctggtgcaagataaaaggtcttgggaaaacaaaacaaaacaaaacaaacctcccttccccagcagggctgctagcttgctttctgcattttcaaaatgataatttacaatggaaggacaagaatgtcatattctcaaggaaaaaaggtatatcacatgtctcattctcctcaaatattccatttgcagacagaccgtcatattctaatagctcatgaaatttgggcagcagggaggaaagtccccagaaattaaaaaatttaaaactcttatgtcaagatgttgatttgaagctgttataagaattgggattccagatttgtaaaaagacccccaatgattctggacactagattttttgtttggggaggttggcttgaacataaatgaaatatcctgtattttcttagggatacttggttagtaaattataatagtagaaataatacatgaatcccattcacaggtttctcagcccaagcaacaaggtaattgcgtgccattcagcactgcaccagagcagacaacctatttgaggaaaaacagtgaaatccaccttcctcttcacactgagccctctctgattcctccgtgttgtgatgtgatgctggccacgtttccaaacggcagctccactgggtcccctttggttgtaggacaggaaatgaaacattaggagctctgcttggaaaacagttcactacttagggatttttgtttcctaaaacttttattttgaggagcagtagttttctatgttttaatgacagaacttggctaatggaattcacagaggtgttgcagcgtatcactgttatgatcctgtgtttagattatccactcatgcttctcctattgtactgcaggtgtaccttaaaactgttcccagtgtacttgaacagttgcatttataaggggggaaatgtggtttaatggtgcctgatatctcaaagtcttttgtacataacatatatatatatatacatatatataaatataaatataaatatatctcattgcagccagtgatttagatttacagcttactctggggttatctctctgtctagagcattgttgtccttcactgcagtccagttgggattattccaaaagttttttgagtcttgagcttgggctgtggccccgctgtgatcataccctgagcacgacgaagcaacctcgtttctgaggaagaagcttgagttctgactcactgaaatgcgtgttgggttgaagatatctttttttcttttctgcctcacccctttgtctccaacctccatttctgttcactttgtggagagggcattacttgttcgttatagacatggacgttaagagatattcaaaactcagaagcatcagcaatgtttctcttttcttagttcattctgcagaatggaaacccatgcctattagaaatgacagtacttattaattgagtccctaaggaatattcagcccactacatagatagctttttttttttttttttttttttaataaggacacctctttccaaacaggccatcaaatatgttcttatctcagacttacgttgttttaaaagtttggaaagatacacatcttttcatacccccccttaggaggttgggctttcatatcacctcagccaactgtggctcttaatttattgcataatgatatccacatcagccaactgtggctctttaatttattgcataatgatattcacatcccctcagttgcagtgaattgtgagcaaaagatcttgaaagcaaaaagcactaattagtttaaaatgtcacttttttggtttttattatacaaaaaccatgaagtactttttttatttgctaaatcagattgttcctttttagtgactcatgtttatgaagagagttgagtttaacaatcctagcttttaaaagaaactatttaatgtaaaatattctacatgtcattcagatattatgtatatcttctagcctttattctgtacttttaatgtacatatttctgtcttgcgtgatttgtatatttcactggtttaaaaaacaaacatcgaaaggcttattccaaatggaag

SEQ ID NO: 76964 - DNA, 1105 bp, Homo sapiens
attaattctggctccacttgttgctcggcccaggttggggagaggacggagggtggccgcagcgggttcctgagtgaattacccaggagggactgagcacagcaccaactagagaggggtcagggggtgcgggactcgagcgagcaggaaggaggcagcgcctggcaccagggctttgactcaacagaattgagacacgtttgtaatcgctggcgtgccccgcgcacaggatcccagcgaaaatcagatttcctggtgaggttgcgtgggtggattaatttggaaaaagaaactgcctatatcttgccatcaaaaaactcacggaggagaagcgcagtcaatcaacagtaaacttaagagaccccggatgcttccgttgtttaaacttgtatgcttgaaaattatctgagaggcaataaacatctgctcctttcttccctctccagaagtccattggaatattaagcccaggagttgctttggggatggctggaagtgcaatgtcttccaagttcttcctagtggctttggccatatttttctccttcgcccaggttgtaattgaagccaattcttggtggtcgctaggtatgaataaccctgttcagatgtcagaagtatatattataggagcacagcctctctgcagccaactggcaggactttctcaaggacagaagaaactgtgccacttgtatcaggaccacatgcagtacatcggagaaggcgcgaagacaggcatcaaagaatgccagtatcaattccgacatcgaaggtggaactgcagcactgtggataacacctctgtttttggcagggtgatgcagataggtaggaaaacatttaaaatatttttttaaaacattaactttttttcctagaagaaatccttagcatttacttcatgcttgatagaaagcatgaaggaggatgccttccagctcgggtggtggcttgggcatttttgtcattatagcaaatgatgttaattcctgtccctacacctgatgataagttttggattttaatcaaatcaggaggcaagtatcacagacaccttcatttttgcaaacacttaatttttctataaagcattttgtttaaa

SEQ ID NO: 76965 - DNA, 194 bp, Homo sapiens
ctgcactccaacctgggtgacagagcaaaactctgtctcaaaaaaataaataaataataaaaggtagatgatcctgggtgggcctggcttaatcaggtgaaagccacgaaggaagggactgggccttcctaaatagagagagcacctcctgctggccatggggcagaaagccatgctgtgaggggaggggcggt

SEQ ID NO: 76966 - DNA, 475 bp, Homo sapiens
aaagtagttgtgtctaaaataataaacacattataactacacacacagtcacacacacacacactcacacacacatacacacaaacaggcataccttctagatattgcgagtttgattccagaccactgtgacaaagccaatattgcaataaaacaagttacataaatattttagttttccagtgcatataaaaattatgcttatactatactattgtctattaaatgtgcaatagcattatgtctaaaaataaaatatacaaatctgaattaaaatattttattgctaaaagatgctaatgattattagagccttgaatgagttacagtctttttgctgatgaagagtcttacctcagtgcggatagctgctgattgatcaagttggtggctgctgaaaggtggggtggctttggcatctcttaaaataaaataacaataaagtttgctgtattgattgactcttcctttcaca

SEQ ID NO: 76967 - DNA, 2278 bp, Homo sapiens
cgctgcggcgcctggcgctccgcgggcgtccgggtggacagcgccaggggcacagggctgacatctcagggctaattccctcctccagtgcgtaaatccaggcttaagccgccgcagggtgtgagcctcccctcccccacccgaacgccgcagctgcacggggcacgacagccttcgcagaggtgcagccacaccccggcctaacgctgctgctcccgccgctactggagtggtggggaggggtgagtggactccaggaatcctcggaagggcgggggcggaggcagggggcccctctagccgctacttcgaaacagcactccttgttctcgatggtccccgcgcgactgtcttagctcacgacacttccggttccttttaaaggcccccaaggctgtgcaacgcggagcgtgagaggaaggtataaagggtagcgagagggcgggaccgaggaggaaagggaaaaaaaaaaaactagggggataggggtggggggacgcgcgaagggcgcgctctcgcgtcacgtgaccgggacgcgccgttcttccgtcggccattttaggtggtccgcggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggtttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaattttttgtatcaagtccctgaatggaagtatgacgttgggtccctctgaagtttaattctggagttctcattaaaagaaatttgctttcatggttttatttcttaattgctatgcttcagaatcaatttgggtttatgccctttcccccagtattgtagagcaagtcttgtgttaaaagcccagtgtgacagtgtcatgatgtagtagtgtcttactggttttttaataaatccttttgtat

SEQ ID NO: 76968 - DNA, 1774 bp, Homo sapiens
cctcccccccccacccccccccaaacttacgggctaggtacgaggctgggtgttaatcggccgaggcggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggtttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaattttttgtatcaagtccctgaatggaagtatgacgttgggtccctctgaagtttaattctggagttctcattaaaagaaatttgctttcatggttttatttcttaattgctatgcttcagaatcaatttgggtttatgccctttcccccagtattgtagagcaagtcttgtgttaaaagcccagtgtgacagtgtcatgatgtagtagtgtcttactggttttttaataaatccttttgtat

SEQ ID NO: 76969 - DNA, 2074 bp, Homo sapiens
cgctgcggcgcctggcgctccgcgggcgtccgggtggacagcgccaggggcacagggctgacatctcagggctaattccctcctccagtgcgtaaatccaggcttaagccgccgcagggtgtgagcctcccctcccccacccgaacgccgcagctgcacggggcacgacagccttcgcagaggtgcagccacaccccggcctaacgctgctgctcccgccgctactggagtggtggggaggggtgagtggactccaggaatcctcggaagggcgggggcggaggcagggggcccctctagccgctacttcgaaacagcactccttgttctcgatggtccccgcgcgactgtcttagctcacgacacttccggttccttttaaaggcccccaaggctgtgcaacgcggagcgtgagaggaaggtataaagggtagcgagagggcgggaccgaggaggaaagggaaaaaaaaaaaactagggggataggggtggggggacgcgcgaagggcgcgctctcgcgtcacgtgaccgggacgcgccgttcttccgtcggccattttaggtggtccgcggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaagggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggtttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaattttttgtatcaagtccctgaatggaagtatgacgttgggtccctctgaagtttaattctggagttctcattaaaagaaatttgctttcatggttttatttcttaattgctatgcttcagaatcaatttgggtttatgccctttcccccagtattgtagagcaagtcttgtgttaaaagcccagtgtgacagtgtcatgatgtagtagtgtcttactggttttttaataaatccttttgtat

SEQ ID NO: 76970 - DNA, 2038 bp, Homo sapiens
cgctgcggcgcctggcgctccgcgggcgtccgggtggacagcgccaggggcacagggctgacatctcagggctaattccctcctccagtgcgtaaatccaggcttaagccgccgcagggtgtgagcctcccctcccccacccgaacgccgcagctgcacggggcacgacagccttcgcagaggtgcagccacaccccggcctaacgctgctgctcccgccgctactggagtggtggggaggggtgagtggactccaggaatcctcggaagggcgggggcggaggcagggggcccctctagccgctacttcgaaacagcactccttgttctcgatggtccccgcgcgactgtcttagctcacgacacttccggttccttttaaaggcccccaaggctgtgcaacgcggagcgtgagaggaaggtataaagggtagcgagagggcgggaccgaggaggaaagggaaaaaaaaaaaactagggggataggggtggggggacgcgcgaagggcgcgctctcgcgtcacgtgaccgggacgcgccgttcttccgtcggccattttaggtggtccgcggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtgtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggtttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaattttttgtatcaagtccctgaatggaagtatgacgttgggtccctctgaagtttaattctggagttctcattaaaagaaatttgctttcatggttttatttcttaattgctatgcttcagaatcaatttgggtttatgccctttcccccagtattgtagagcaagtcttgtgttaaaagcccagtgtgacagtgtcatgatgtagtagtgtcttactggttttttaataaatccttttgtat

SEQ ID NO: 76971 - DNA, 1995 bp, Homo sapiens
cgctgcggcgcctggcgctccgcgggcgtccgggtggacagcgccaggggcacagggctgacatctcagggctaattccctcctccagtgcgtaaatccaggcttaagccgccgcagggtgtgagcctcccctcccccacccgaacgccgcagctgcacggggcacgacagccttcgcagaggtgcagccacaccccggcctaacgctgctgctcccgccgctactggagtggtggggaggggtgagtggactccaggaatcctcggaagggcgggggcggaggcagggggcccctctagccgctacttcgaaacagcactccttgttctcgatggtccccgcgcgactgtcttagctcacgacacttccggttccttttaaaggcccccaaggctgtgcaacgcggagcgtgagaggaaggtataaagggtagcgagagggcgggaccgaggaggaaagggaaaaaaaaaaaactagggggataggggtggggggacgcgcgaagggcgcgctctcgcgtcacgtgaccgggacgcgccgttcttccgtcggccattttaggtggtccgcggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacgggtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggtttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaattttttgtatcaagtccctgaatggaagtatgacgttgggtccctctgaagtttaattctggagttctcattaaaagaaatttgctttcatggttttatttcttaattgctatgcttcagaatcaatttgggtttatgccctttcccccagtattgtagagcaagtcttgtgttaaaagcccagtgtgacagtgtcatgatgtagtagtgtcttactggttttttaataaatccttttgtat

SEQ ID NO: 76972 - DNA, 1009 bp, Homo sapiens
cgctgcggcgcctggcgctccgcgggcgtccgggtggacagcgccaggggcacagggctgacatctcagggctaattccctcctccagtgcgtaaatccaggcttaagccgccgcagggtgtgagcctcccctcccccacccgaacgccgcagctgcacggggcacgacagccttcgcagaggtgcagccacaccccggcctaacgctgctgctcccgccgctactggagtggtggggaggggtgagtggactccaggaatcctcggaagggcgggggcggaggcagggggcccctctagccgctacttcgaaacagcactccttgttctcgatggtccccgcgcgactgtcttagctcacgacacttccggttccttttaaaggcccccaaggctgtgcaacgcggagcgtgagaggaaggtataaagggtagcgagagggcgggaccgaggaggaaagggaaaaaaaaaaaactagggggataggggtggggggacgcgcgaagggcgcgctctcgcgtcacgtgaccgggacgcgccgttcttccgtcggccattttaggtggtccgcggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggccatgggtctcctcccaccgacttagccgccaggattttttcccgcctgtcgtggggtaccttttttctttccatgctgtcccctctttttcccttttt

SEQ ID NO: 76973 - DNA, 353 bp, Homo sapiens
cggcgggaagcggagccgggaccgggggcggaaccgcgtctggaggcaccgaagggggcagcgccgagtcggagggggcgaagattgacgccagtaagaacgaggaggatgaagggtgagtaaggggcatcccaggatagtcaggcccaactagtccccctccccctctttattcccccgccattaggcctggttcccgctctcagcccgttctccgggcccccatgcagcctccttgcactggtctccctttttctatgttgggttccccggaccttcatttccttcttcctttgcctgcttatcgcccccctcccccatcacacacgtttccacctttagccgtcaccatg

SEQ ID NO: 76974 - DNA, 2576 bp, Homo sapiens
ggaattccggaattccgaatgcgtcggaatgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaagggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggtttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaattcctcagaggcaggagaaggcttggagctacccccaaactcaatccactgttggcagctgagcgtgtagtagggtggtcctagccatacagaaccacttctctgtctccctcctcttccctggttcgtccagccccagtccatcagggaccacctgggcagcctcccagagatgggatcgggttggggctaagggcatcgggtctgtcgcagccaggggtgcaggaggatcgctgtgctgtgagccgttcagctggctcccgacgaaggaggcacggaaccagacagcgcggcgagggcgagagcgctgcaggcaaggcgtaggccccgcggcggatcttgccgaagagcaggacaggctccgagtcctggaaggggtagtggccggccagcatggtgaagagcgccacgcccaggctccagacatcggctgccttgcccgagtatgaggcccgtgagctgagtatctcaggtcccacgtaggctggcgacgcgtgcttgtccacagggaatcatctggcccagtcagcacgcaggagtcctccaggttctccagcaccagcttcttcctgggacatggggagaaacagaagggtcaggtcctacccagaacccccatgctatcacccttgtggcacccactttccaagtcgctgctggcctttgacagacacaagccagtcctgtgatgtctgatcctgttttacagatacccaagcccaggctcagagaggttaagtcatttaaggccacagagcaattaaatttaaactaaaattctgaaaggaatacatttttcaacagagtccttggggagggggctgatggggctgagagggttaagcctctcttaaaccagctacaaacttagggtccaggcaggtaataagatgagagaaacaggaagtgtgcctgacatctcagcacaagcgctacctaaaaagggtacacaacgcattctagggtttaccaagtgcctgctgtgttcctggcccttgacccagctcattacctggctcacctcattctatctagctacagcctgcaaggaagacaccattttacagctgtagagcatgggcctgggatgggaacgctggctggcagatactcagagccagtgctgtgacccaccctctcagttcccaagatggccccacattcccattgttttccccaagagaagccaggaattgtattttaatgaaaaggtccccatttaaaaaatattggcaaaccagtttatataaaaaacacaaacaggtaagcagggcaaaaaaaaaagtgtgtaaggctgggcgcggtgctcatgcccggtaatcctagcactttgggagcgcgaggcagggggatcacttgagttcaggagttcaagaccagcctgggcaacacggtaaaaacctatctctacaaaaaatacgaaaattagcaggcatggtgattcgcacctgtagtcccagctacttgggaggctgatcttgaactcctgaactcaagtgatccccctgcctcggccggaattc

SEQ ID NO: 76975 - DNA, 2131 bp, Homo sapiens
cgctgcggcgcctggcgctccgcgggcgtccgggtggacagcgccaggggcacagggctgacatctcagggctaattccctcctccagtgcgtaaatccaggcttaagccgccgcagggtgtgagcctcccctcccccacccgaacgccgcagctgcacggggcacgacagccttcgcagaggtgcagccacaccccggcctaacgctgctgctcccgccgctactggagtggtggggaggggtgagtggactccaggaatcctcggaagggcgggggcggaggcagggggcccctctagccgctacttcgaaacagcactccttgttctcgatggtccccgcgcgactgtcttagctcacgacacttccggttccttttaaaggcccccaaggctgtgcaacgcggagcgtgagaggaaggtataaagggtagcgagagggcgggaccgaggaggaaagggaaaaaaaaaaaactagggggataggggtggggggacgcgcgaagggcgcgctctcgcgtcacgtgaccgggacgcgccgttcttccgtcggccattttaggtggtccgcggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggtttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaattttttgtatcaagtccctgaatggaagtatgacgttgggtccctctgaagtttaattctggagttctcattaaaagaaatttgctttcatggttttatttcttaattgctatgcttcagaatcaatttgggtttatgccctttcccccagtattgtagagcaagtcttgtgttaaaagcccagtgtgacagtgtcatgatgtagtagtgtcttactggttttttaataaatccttttgtat

SEQ ID NO: 76976 - DNA, 1711 bp, Homo sapiens
cctcccccccccacccccccccaaacttacgggctaggtacgaggctgggtgttaatcggccgaggctgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggtttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaattttttgtatcaagtccctgaatggaagtatgacgttgggtccctctgaagtttaattctggagttctcattaaaagaaatttgctttcatggttttatttcttaattgctatgcttcagaatcaatttgggtttatgccctttcccccagtattgtagagcaagtcttgtgttaaaagcccagtgtgacagtgtcatgatgtagtagtgtcttactggttttttaataaatccttttgtat

SEQ ID NO: 76977 - DNA, 2084 bp, Homo sapiens
cgctgcggcgcctggcgctccgcgggcgtccgggtggacagcgccaggggcacagggctgacatctcagggctaattccctcctccagtgcgtaaatccaggcttaagccgccgcagggtgtgagcctcccctcccccacccgaacgccgcagctgcacggggcacgacagccttcgcagaggtgcagccacaccccggcctaacgctgctgctcccgccgctactggagtggtggggaggggtgagtggactccaggaatcctcggaagggcgggggcggaggcagggggcccctctagccgctacttcgaaacagcactccttgttctcgatggtccccgcgcgactgtcttagctcacgacacttccggttccttttaaaggcccccaaggctgtgcaacgcggagcgtgagaggaaggtataaagggtagcgagagggcgggaccgaggaggaaagggaaaaaaaaaaaactagggggataggggtggggggacgcgcgaagggcgcgctctcgcgtcacgtgaccgggacgcgccgttcttccgtcggccattttaggtggtccgcggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggtttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaattttttgtatcaagtccctgaatggaagtatgacgttgggtccctctgaagtttaattctggagttctcattaaaagaaatttgctttcatggttttatttcttaattgctatgcttcagaatcaatttgggtttatgccctttcccccagtattgtagagcaagtcttgtgttaaaagcccagtgtgacagtgtcatgatgtagtagtgtcttactggttttttaataaatccttttgtat

SEQ ID NO: 76978 - DNA, 1578 bp, Homo sapiens
cgctgcggcgcctggcgctccgcgggcgtccgggtggacagcgccaggggcacagggctgacatctcagggctaattccctcctccagtgcgtaaatccaggcttaagccgccgcagggtgtgagcctcccctcccccacccgaacgccgcagctgcacggggcacgacagccttcgcagaggtgcagccacaccccggcctaacgctgctgctcccgccgctactggagtggtggggaggggtgagtggactccaggaatcctcggaagggcgggggcggaggcagggggcccctctagccgctacttcgaaacagcactccttgttctcgatggtccccgcgcgactgtcttagctcacgacacttccggttccttttaaaggcccccaaggctgtgcaacgcggagcgtgagaggaaggtataaagggtagcgagagggcgggaccgaggaggaaagggaaaaaaaaaaaactagggggataggggtggggggacgcgcgaagggcgcgctctcgcgtcacgtgaccgggacgcgccgttcttccgtcggccattttaggtggtccgcggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtcgccgccgccgcctctccttagtcgccgccatgacgaccgtgtacacctcgcaggtgcgccagaattaccaccaggactcagaggccgccatcaaccgccagatcaaacctggagctctaggacctcctacgtcaacctgttccatggtcttactacttttggacctgcgatgcatgtggcttcgaacgaactttggccaatacttccttcacccaatctcatgaggagcagggaacatgctgagaaccctgatgaaggctgccgaaccaacgaggtggcgaatctcccttcggggtactcagaaccagaccggtgactgactgggagagccggctgaatgcatggcgtggtgcatacacttgggaccactgtgaaccagcccctacggaactgcaccaatggcccttgccaaagtgaccccccatcgcggtgtctacgtggaagcaccttactccttcctgtcagtgtgaaagcctccaagagattgggtgcacagttgcaccatgttgccacacgctctcgcccccgaaacggcttgcgggaatcttctgcgagaacaccctgttgcacgtgatttacgacacgaatcgcatattaccccagagcgggagcaaccgtcgtacg

SEQ ID NO: 76979 - DNA, 477 bp, Homo sapiens
ggttgaactacttaagcttaatttgttaaactccggtaagtacctagcccacatgatttgactcagagattctcttttgtccacagacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatggctggtttcaaagctgtggaattcaaaggataaattaatgaagaaaacaagcggagctgaagaagaaagtacaatatggtgctgtcttcctaatgaaataaattcactaaatggacattaa

SEQ ID NO: 76980 - DNA, 609 bp, Homo sapiens
ggttgaactacttaagcttaatttgttaaactccggtaagtacctagcccacatgatttgactcagagattctcttttgtccacagacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatgggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattggtaagtgtagacttctgttatgattatctgtggtgtgtatcctgaaggaagatagagggagattccaggtaatgacaatttttcctaaaatgaagtcttt

SEQ ID NO: 76981 - DNA, 2574 bp, Homo sapiens
ggttgaactacttaagcttaatttgttaaactccggtaagtacctagcccacatgatttgactcagagattctcttttgtccacagacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatggctatttggagatccaattcaggaagcaacacattggagaatggctactttctatcaagaaataaagagaaccacagtcaacccacacaatcatctttagaagacagtgtgactcctaccaaagctgtcaaaaccacaggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatcagggcagccaagcttgagtttttattttttatttatttatttttttgagatagggtctcactttgttacccaggctggagtgcagtggcacaatctcgactcactgcagctatctctcgcctcagcccctcaagtagctgggactacaggtgcatgccaccatgccaggctaatttttggtgttttttgtagagactgggttttgccatgttgaccaagctggtctctaactcctgggcttaagtgatctgcccgccttggcctcccaaagtgctgggattacagatgtgagccaccacacctggccccaagcttgaattttcattctgccattgacttggcatttaccttgggtaagccataagcgaatcttaatttctggctctatcagagttgtttcatgctcaacaatgccattgaagtgcacggtgtgttgccacgatttgaccctcaacttctagcagtatatcagttatgaactgagggtgaaatatatttctgaatagctaaatgaagaaatgggaaaaaatcttcaccacagtcagagcaattttattattttcatcagtatgatcataattatgattatcatcttagtaaaaagcaggaactcctactttttctttatcaattaaatagctcagagagtacatctgccatatctctaatagaatcttttttttttttttttttttgagacagagtttcgctcttgttgcccaggctggagtgcaacggcacgatctcggctcaccgcaacctccgccccctgggttcaagcaattctcctgcctcagcctcccaagtagctgggattacagtcaggcaccaccacacccggctaattttgtatttttttagtagagacagggtttctccatgtcggtcagggtagtcccgaactcctgacctcaagtgatctgcctgcctcggcctcccaagtgctgggattacaggcgtgagccactgcacccagcctagaatcttgtataatatgtaattgtagggaaactgctctcataggaaagttttctgctttttaaatacaaaaatacataaaaatacataaaatctgatgatgaatataaaaaagtaaccaacctcattggaacaagtattaacattttggaatatgttttattagttttgtgatgtactgttttacaatttttaccatttttttcagtaattactgtaaaatggtattattggaatgaaactatatttcctcatgtgctgatttgtcttatttttttcatactttcccactggtgctatttttatttccaatggatatttctgtattactagggaggcatttacagtcctctaatgttgattaatatgtgaaaagaaattgtaccaattttactaaattatgcagtttaaaatggatgattttatgttatgtggatttcatttcaataaaaaaaaactcttatca

SEQ ID NO: 76982 - DNA, 2607 bp, Homo sapiens
  misc_feature (4)..(4): n is a, c, g, or t
cggntgaactacttaagcttaatttgttaaactccggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatgggtactgggcagtttctcaaggatctctcatttttaaataacagaagaaagctatttggagatccaattcaggaagcaacacattggagaatggctactttctatcaagaaataaagagaaccacagtcaacccacacaatcatctttagaagacagtgtgactcctaccaaagctgtcaaaaccacaggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgagtctcactctgttgcccaagctagagtgcagtgaagccgcgacatcccaggctcaagtgatcctcccacctcagcttcctgagtagggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatcagggcagccaagcttgagtttttattttttatttatttatttttttgagatagggtctcactttgttacccaggctggagtgcagtggcacaatctcgactcactgcagctatctctcgcctcagcccctcaagtagctgggactacaggtgcatgccaccatgccaggctaatttttggtgttttttgtagagactgggttttgccatgttgaccaagctggtctctaactcctgggcttaagtgatctgcccgccttggcctcccaaagtgctgggattacagatgtgagccaccacacctggccccaagcttgaattttcattctgccattgacttggcatttaccttgggtaagccataagcgaatcttaatttctggctctatcagagttgtttcatgctcaacaatgccattgaagtgcacggtgtgttgccacgatttgaccctcaacttctagcagtatatcagttatgaactgagggtgaaatatatttctgaatagctaaatgaagaaatgggaaaaaatcttcaccacagtcagagcaattttattattttcatcagtatgatcataattatgattatcatcttagtaaaaagcaggaactcctactttttctttatcaattaaatagctcagagagtacatctgccatatctctaatagaatcttttttttttttttttttttgagacagagtttcgctcttgttgcccaggctggagtgcaacggcacgatctcggctcaccgcaacctccgccccctgggttcaagcaattctcctgcctcagcctcccaagtagctgggattacagtcaggcaccaccacacccggctaattttgtatttttttagtagagacagggtttctccatgtcggtcagggtagtcccgaactcctgacctcaagtgatctgcctgcctcggcctcccaagtgctgggattacaggcgtgagccactgcacccagcctagaatcttgtataatatgtaattgtagggaaactgctctcataggaaagttttctgctttttaaatacaaaaatacataaaaatacataaaatctgatgatgaatataaaaaagtaaccaacctcattggaacaagtattaacattttggaatatgttttattagttttgtgatgtactgttttacaatttttaccatttttttcagtaattactgtaaaatggtattattggaatgaaactatatttcctcatgtgctgatttgtcttatttttttcatactttcccactggtgctatttttatttccaatggatatttctgtattactagggaggcatttacagtcctctaatgttgattaatatgtgaaaagaaattgtaccaattttactaaattatgcagtttaaaatggatgattttatgttatgtggatttcatttcaataaaaaaaaactcttatca

SEQ ID NO: 76983 - DNA, 2351 bp, Homo sapiens
  misc_feature (4)..(4): n is a, c, g, or t
cggntgaactacttaagcttaatttgttaaactccggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatggctatttggagatccaattcaggaagcaacacattggagaatggctactttctatcaagaaataaagagaaccacagtcaacccacacaatcatctttagaagacagtgtgactcctaccaaagctgtcaaaaccacaggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatcagggcagccaagcttgagtttttattttttatttatttatttttttgagatagggtctcactttgttacccaggctggagtgcagtggcacaatctcgactcactgcagctatctctcgcctcagcccctcaagtagctgggactacaggtgcatgccaccatgccaggctaatttttggtgttttttgtagagactgggttttgccatgttgaccaagctggtctctaactcctgggcttaagtgatctgcccgccttggcctcccaaagtgctgggattacagatgtgagccaccacacctggccccaagcttgaattttcattctgccattgacttggcatttaccttgggtaagccataagcgaatcttaatttctggctctatcagagttgtttcatgctcaacaatgccattgaagtgcacggtgtgttgccacgatttgaccctcaacttctagcagtatatcagttatgaactgagggtgaaatatatttctgaatagctaaatgaagaaatgggaaaaaatcttcaccacagtcagagcaattttattattttcatcagtatgatcataattatgattatcatcttagtaaaaagcaggaactcctactttttctttatcaattaaatagctcagagagtacatctgccatatctctaatagaatcttttttttttttttttttttgagacagagtttcgctcttgttgcccaggctggagtgcaacggcacgatctcggctcaccgcaacctccgccccctgggttcaagcaattctcctgcctcagcctcccaagtagctgggattacagtcaggcaccaccacacccggctaattttgtatttttttagtagagacagggtttctccatgtcggtcagggtagtcccgaactcctgacctcaagtgatctgcctgcctcggcctcccaagtgctgggattacaggcgtgagccactgcacccagcctagaatcttgtataatatgtaattgtagggaaactgctctcataggaaagttttctgctttttaaatacaaaaatacataaaaatacataaaatctgatgatgaatataaaaaagtaaccaacctcattggaacaagtattaacattttggaatatgttttattagttttgtgatgtactgttttacaatttttaccatttttttcagtaattactgtaaaatggtattattggaatgaaactatatttcctcatgtgctgatttgtcttatttttttcatactttcccactggtgctatttttatttccaatggatatttctgtattactagggaggcatttacagtcctctaatgttgattaatatgtgaaaagaaattgtaccaattttactaaattatgcagtttaaaatggatgattttatgttatgtggatttcatttcaataaaaaaaaactcttatca

SEQ ID NO: 76984 - DNA, 2233 bp, Homo sapiens
  misc_feature (4)..(4): n is a, c, g, or t
cggntgaactacttaagcttaatttgttaaactccggggctctcaagaacaatggaatatcatcctgatttagaaaatttggatgaagatggatatactcaattacacttcgactctcaaagcaataccaggatagctgttgtttcagagaaaggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatcagggcagccaagcttgagtttttattttttatttatttatttttttgagatagggtctcactttgttacccaggctggagtgcagtggcacaatctcgactcactgcagctatctctcgcctcagcccctcaagtagctgggactacaggtgcatgccaccatgccaggctaatttttggtgttttttgtagagactgggttttgccatgttgaccaagctggtctctaactcctgggcttaagtgatctgcccgccttggcctcccaaagtgctgggattacagatgtgagccaccacacctggccccaagcttgaattttcattctgccattgacttggcatttaccttgggtaagccataagcgaatcttaatttctggctctatcagagttgtttcatgctcaacaatgccattgaagtgcacggtgtgttgccacgatttgaccctcaacttctagcagtatatcagttatgaactgagggtgaaatatatttctgaatagctaaatgaagaaatgggaaaaaatcttcaccacagtcagagcaattttattattttcatcagtatgatcataattatgattatcatcttagtaaaaagcaggaactcctactttttctttatcaattaaatagctcagagagtacatctgccatatctctaatagaatcttttttttttttttttttttgagacagagtttcgctcttgttgcccaggctggagtgcaacggcacgatctcggctcaccgcaacctccgccccctgggttcaagcaattctcctgcctcagcctcccaagtagctgggattacagtcaggcaccaccacacccggctaattttgtatttttttagtagagacagggtttctccatgtcggtcagggtagtcccgaactcctgacctcaagtgatctgcctgcctcggcctcccaagtgctgggattacaggcgtgagccactgcacccagcctagaatcttgtataatatgtaattgtagggaaactgctctcataggaaagttttctgctttttaaatacaaaaatacataaaaatacataaaatctgatgatgaatataaaaaagtaaccaacctcattggaacaagtattaacattttggaatatgttttattagttttgtgatgtactgttttacaatttttaccatttttttcagtaattactgtaaaatggtattattggaatgaaactatatttcctcatgtgctgatttgtcttatttttttcatactttcccactggtgctatttttatttccaatggatatttctgtattactagggaggcatttacagtcctctaatgttgattaatatgtgaaaagaaattgtaccaattttactaaattatgcagtttaaaatggatgattttatgttatgtggatttcatttcaataaaaaaaaactcttatca

SEQ ID NO: 76985 - DNA, 1142 bp, Homo sapiens
ggttgaactacttaagcttaatttgttaaactccggtaagtacctagcccacatgatttgactcagagattctcttttgtccacagacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatgggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgagtctcactctgttgcccaagctagagtgcagtgaagccgcgacatcccaggctcaagtgatcctcccacctcagcttcctgagtaggtaggactacagggtgcaccaccacactcgtctaatgtttttttgtatttttcatagagacgaggtttctccatatcatctgggctggtctcaaaatcctgggcacaagcgatctgcctacctcgatctcccagtgttgggattacaggtgtaagccaccatacttggccaaaattcatttttaatatctctataattataatcatagcatgccttaagcacataaagtgcatagtatatgcttttatttttaactaatttaaaaaactgtgtttcgccttaaaacaaatcctttcaaacatactccatgtatgcatgactacaataatcaggacactacccatttttgtgagtttgtatttcaatttttaaatatggtggaagtaaagtagaaaattcttctccttgtcatcataattatcaagaaaaatggcaacaatgataatatatgtttagaaattatttactctttgcaagatactgggaaaggcaaagagggttaaaacataaccctgctatcacaggacacatataatcttttaagta

SEQ ID NO: 76986 - DNA, 622 bp, Homo sapiens
  misc_feature (4)..(4): n is a, c, g, or t
cggntgaactacttaagcttaatttgttaaactccggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatgggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgggatttatagtaaaacaagtgtcttcccaacctgataattcattttggataggcctttctcggccccagactgaggtaccatggctctgggaggatggatcaacattctcttctaactttttaactagtttccttcttgctgcccaggcttgaagtgaacggcacgatacttgttcaccggaaacctggcccctgggtttaagcgatttttccggcc

SEQ ID NO: 76987 - DNA, 611 bp, Homo sapiens
tctccacagcaatatatcatctatttatcattaatcaataatgtattcttttattccaataacatttgggttttgggattttaattttcaaacacagcagaatgacattttttctgtcactattattattgttggtatgtgaagctatttggagatccaattcaggaagcaacacattggagaatggctactttctatcaagaaataaagagaaccacagtcaacccacacaatcatctttagaagacagtgtgactcctaccaaagctgtcaaaaccacaggcaagggcatagttaaaggacggaatcttgactcaagagggttaattcttggtgctgaagcctggggcaggggtgtaaagaaaaacacttagattcaatgattgtaaatttaaggcaaatacacatattagtattaccttagtgtaatgtatccctgtcatatatacaataaggtgaaattataagtaccctatgcagttggctggacagttctaaattggactttattaatttttaaaatcagtaactgatttatcactggctatgtgcttagatctacaggagatcatataatttgatacaaataaaagaaaagtgttctctcccct

SEQ ID NO: 76988 - DNA, 2436 bp, Homo sapiens
ggttgaactacttaagcttaatttgttaaactccggtaagtacctagcccacatgatttgactcagagattctcttttgtccacagacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatgggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatcagggcagccaagcttgagtttttattttttatttatttatttttttgagatagggtctcactttgttacccaggctggagtgcagtggcacaatctcgactcactgcagctatctctcgcctcagcccctcaagtagctgggactacaggtgcatgccaccatgccaggctaatttttggtgttttttgtagagactgggttttgccatgttgaccaagctggtctctaactcctgggcttaagtgatctgcccgccttggcctcccaaagtgctgggattacagatgtgagccaccacacctggccccaagcttgaattttcattctgccattgacttggcatttaccttgggtaagccataagcgaatcttaatttctggctctatcagagttgtttcatgctcaacaatgccattgaagtgcacggtgtgttgccacgatttgaccctcaacttctagcagtatatcagttatgaactgagggtgaaatatatttctgaatagctaaatgaagaaatgggaaaaaatcttcaccacagtcagagcaattttattattttcatcagtatgatcataattatgattatcatcttagtaaaaagcaggaactcctactttttctttatcaattaaatagctcagagagtacatctgccatatctctaatagaatcttttttttttttttttttttgagacagagtttcgctcttgttgcccaggctggagtgcaacggcacgatctcggctcaccgcaacctccgccccctgggttcaagcaattctcctgcctcagcctcccaagtagctgggattacagtcaggcaccaccacacccggctaattttgtatttttttagtagagacagggtttctccatgtcggtcagggtagtcccgaactcctgacctcaagtgatctgcctgcctcggcctcccaagtgctgggattacaggcgtgagccactgcacccagcctagaatcttgtataatatgtaattgtagggaaactgctctcataggaaagttttctgctttttaaatacaaaaatacataaaaatacataaaatctgatgatgaatataaaaaagtaaccaacctcattggaacaagtattaacattttggaatatgttttattagttttgtgatgtactgttttacaatttttaccatttttttcagtaattactgtaaaatggtattattggaatgaaactatatttcctcatgtgctgatttgtcttatttttttcatactttcccactggtgctatttttatttccaatggatatttctgtattactagggaggcatttacagtcctctaatgttgattaatatgtgaaaagaaattgtaccaattttactaaattatgcagtttaaaatggatgattttatgttatgtggatttcatttcaataaaaaaaaactcttatca

SEQ ID NO: 76989 - DNA, 1567 bp, Homo sapiens
  misc_feature (4)..(4): n is a, c, g, or t
cggntgaactacttaagcttaatttgttaaactccggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatggctatttggagatccaattcaggaagcaacacattggagaatggctactttctatcaagaaataaagagaaccacagtcaacccacacaatcatctttagaagacagtgtgactcctaccaaagctgtcaaaaccacaggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatcagggcagccaagcttgagtttttattttttatttatttatttttttgagatagggtctcactttgttacccagcctagaatcttgtataatatgtaattgtagggaaactgctctcataggaaagttttctgctttttaaatacaaaaatacataaaaatacataaaatctgatgatgaatataaaaaagtaaccaacctcattggaacaagtattaacattttggaatatgttttattagttttgtgatgtactgttttacaatttttaccatttttttcagtaattactgtaaaatggtattattggaatgaaactatatttcctcatgtgctgatttgtcttatttttttcatactttcccactggtgctatttttatttccaatggatatttctgtattactagggaggcatttacagtcctctaatgttgattaatatgtgaaaagaaattgtaccaattttactaaattatgcagtttaaaatggatgattttatgttatgtggatttcatttcaataaaaaaaaactcttatca

SEQ ID NO: 76990 - DNA, 2213 bp, Homo sapiens
  misc_feature (4)..(4): n is a, c, g, or t
cggntgaactacttaagcttaatttgttaaactccggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatgggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatcagggcagccaagcttgagtttttattttttatttatttatttttttgagatagggtctcactttgttacccaggctggagtgcagtggcacaatctcgactcactgcagctatctctcgcctcagcccctcaagtagctgggactacaggtgcatgccaccatgccaggctaatttttggtgttttttgtagagactgggttttgccatgttgaccaagctggtctctaactcctgggcttaagtgatctgcccgccttggcctcccaaagtgctgggattacagatgtgagccaccacacctggccccaagcttgaattttcattctgccattgacttggcatttaccttgggtaagccataagcgaatcttaatttctggctctatcagagttgtttcatgctcaacaatgccattgaagtgcacggtgtgttgccacgatttgaccctcaacttctagcagtatatcagttatgaactgagggtgaaatatatttctgaatagctaaatgaagaaatgggaaaaaatcttcaccacagtcagagcaattttattattttcatcagtatgatcataattatgattatcatcttagtaaaaagcaggaactcctactttttctttatcaattaaatagctcagagagtacatctgccatatctctaatagaatcttttttttttttttttttttgagacagagtttcgctcttgttgcccaggctggagtgcaacggcacgatctcggctcaccgcaacctccgccccctgggttcaagcaattctcctgcctcagcctcccaagtagctgggattacagtcaggcaccaccacacccggctaattttgtatttttttagtagagacagggtttctccatgtcggtcagggtagtcccgaactcctgacctcaagtgatctgcctgcctcggcctcccaagtgctgggattacaggcgtgagccactgcacccagcctagaatcttgtataatatgtaattgtagggaaactgctctcataggaaagttttctgctttttaaatacaaaaatacataaaaatacataaaatctgatgatgaatataaaaaagtaaccaacctcattggaacaagtattaacattttggaatatgttttattagttttgtgatgtactgttttacaatttttaccatttttttcagtaattactgtaaaatggtattattggaatgaaactatatttcctcatgtgctgatttgtcttatttttttcatactttcccactggtgctatttttatttccaatggatatttctgtattactagggaggcatttacagtcctctaatgttgattaatatgtgaaaagaaattgtaccaattttactaaattatgcagtttaaaatggatgattttatgttatgtggatttcatttcaataaaaaaaaactcttatca

SEQ ID NO: 76991 - DNA, 2513 bp, Homo sapiens
  misc_feature (4)..(4): n is a, c, g, or t
cggntgaactacttaagcttaatttgttaaactccggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatggctatttggagatccaattcaggaagcaacacattggagaatggctactttctatcaagaaataaagagaaccacagtcaacccacacaatcatctttagaagacagtgtgactcctaccaaagctgtcaaaaccacaggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgagtctcactctgttgcccaagctagagtgcagtgaagccgcgacatcccaggctcaagtgatcctcccacctcagcttcctgagtagggatttatagtaaaacaagccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatcagggcagccaagcttgagtttttattttttatttatttatttttttgagatagggtctcactttgttacccaggctggagtgcagtggcacaatctcgactcactgcagctatctctcgcctcagcccctcaagtagctgggactacaggtgcatgccaccatgccaggctaatttttggtgttttttgtagagactgggttttgccatgttgaccaagctggtctctaactcctgggcttaagtgatctgcccgccttggcctcccaaagtgctgggattacagatgtgagccaccacacctggccccaagcttgaattttcattctgccattgacttggcatttaccttgggtaagccataagcgaatcttaatttctggctctatcagagttgtttcatgctcaacaatgccattgaagtgcacggtgtgttgccacgatttgaccctcaacttctagcagtatatcagttatgaactgagggtgaaatatatttctgaatagctaaatgaagaaatgggaaaaaatcttcaccacagtcagagcaattttattattttcatcagtatgatcataattatgattatcatcttagtaaaaagcaggaactcctactttttctttatcaattaaatagctcagagagtacatctgccatatctctaatagaatcttttttttttttttttttttgagacagagtttcgctcttgttgcccaggctggagtgcaacggcacgatctcggctcaccgcaacctccgccccctgggttcaagcaattctcctgcctcagcctcccaagtagctgggattacagtcaggcaccaccacacccggctaattttgtatttttttagtagagacagggtttctccatgtcggtcagggtagtcccgaactcctgacctcaagtgatctgcctgcctcggcctcccaagtgctgggattacaggcgtgagccactgcacccagcctagaatcttgtataatatgtaattgtagggaaactgctctcataggaaagttttctgctttttaaatacaaaaatacataaaaatacataaaatctgatgatgaatataaaaaagtaaccaacctcattggaacaagtattaacattttggaatatgttttattagttttgtgatgtactgttttacaatttttaccatttttttcagtaattactgtaaaatggtattattggaatgaaactatatttcctcatgtgctgatttgtcttatttttttcatactttcccactggtgctatttttatttccaatggatatttctgtattactagggaggcatttacagtcctctaatgttgattaatatgtgaaaagaaattgtaccaattttactaaattatgcagtttaaaatggatgattttatgttatgtggatttcatttcaataaaaaaaaactcttatca

SEQ ID NO: 76992 - DNA, 569 bp, Homo sapiens
ggttgaactacttaagcttaatttgttaaactccggtaagtacctagcccacatgatttgactcagagattctcttttgtccacagacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatgggtgagtatttggtggaggagattaacaacagacaatttagtaagcaattattatgtgccaggcactcttttaagggcttgacatgcataatctactttaatttgtatataatctggttttatctgtattgggttggtgctgttaatgcccatttcacttataaagggtgagagagactgagaggttattttacctttccagggttataagct

SEQ ID NO: 76993 - DNA, 2081 bp, Homo sapiens
  misc_feature (4)..(4): n is a, c, g, or t
cggntgaactacttaagcttaatttgttaaactccggggctctcaagaacaatggaatatcatcctgatttagaaaatttggatgaagatggatatactcaattacacttcgactctcaaagcaataccaggatagctgttgtttcagagaaagggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatcagggcagccaagcttgagtttttattttttatttatttatttttttgagatagggtctcactttgttacccaggctggagtgcagtggcacaatctcgactcactgcagctatctctcgcctcagcccctcaagtagctgggactacaggtgcatgccaccatgccaggctaatttttggtgttttttgtagagactgggttttgccatgttgaccaagctggtctctaactcctgggcttaagtgatctgcccgccttggcctcccaaagtgctgggattacagatgtgagccaccacacctggccccaagcttgaattttcattctgccattgacttggcatttaccttgggtaagccataagcgaatcttaatttctggctctatcagagttgtttcatgctcaacaatgccattgaagtgcacggtgtgttgccacgatttgaccctcaacttctagcagtatatcagttatgaactgagggtgaaatatatttctgaatagctaaatgaagaaatgggaaaaaatcttcaccacagtcagagcaattttattattttcatcagtatgatcataattatgattatcatcttagtaaaaagcaggaactcctactttttctttatcaattaaatagctcagagagtacatctgccatatctctaatagaatcttttttttttttttttttttgagacagagtttcgctcttgttgcccaggctggagtgcaacggcacgatctcggctcaccgcaacctccgccccctgggttcaagcaattctcctgcctcagcctcccaagtagctgggattacagtcaggcaccaccacacccggctaattttgtatttttttagtagagacagggtttctccatgtcggtcagggtagtcccgaactcctgacctcaagtgatctgcctgcctcggcctcccaagtgctgggattacaggcgtgagccactgcacccagcctagaatcttgtataatatgtaattgtagggaaactgctctcataggaaagttttctgctttttaaatacaaaaatacataaaaatacataaaatctgatgatgaatataaaaaagtaaccaacctcattggaacaagtattaacattttggaatatgttttattagttttgtgatgtactgttttacaatttttaccatttttttcagtaattactgtaaaatggtattattggaatgaaactatatttcctcatgtgctgatttgtcttatttttttcatactttcccactggtgctatttttatttccaatggatatttctgtattactagggaggcatttacagtcctctaatgttgattaatatgtgaaaagaaattgtaccaattttactaaattatgcagtttaaaatggatgattttatgttatgtggatttcatttcaataaaaaaaaactcttatca

SEQ ID NO: 76994 - DNA, 450 bp, Homo sapiens
tgggatttcaacacactagagtattaatatacctgtaaaaggaaatggactattttctactgttgcataatctctaagagatattattttttaaagtaaggtataggacaacatgtacaataatgctacctttagtaagggtagaaaaaaatgaaaatgtgcattcatttgcttatattaaaagaataacgaatagaaagcaaacttaaaaactgattgaagagaacagatggaggagagaacgatagaagctagactttcctgaatgtaccttgctttgtggcttactttggaactattaaatgtgatatataattatgaaataacattttaaaaagttgagggaggaacttatcctttaaaagttgaaagtaatggccaggtgtggtggctcacgcctataatcccagcactttgcgaggcttgaggcaccccccccctccaccaaaa

SEQ ID NO: 76995 - DNA, 937 bp, Homo sapiens
cgcgtggccctcggcgccgccaccctagctggcgcagtcttgacactgcatccttccctcctagtgccttaccgagcgacagacgcggcgtgagggtttacttccactggtactccaagaaactgaggctagtcagacacaatctcagctcttctgttgtgctgttgtaacagtttacgctggccttttttttttctttttctttttctttttaaaatgttaatgcccgttgtctttcctgggctgtttgctagcggaaggatgccagggaagccagcaggagctaggagagagtccgtggatctcgaaagaaatatgggagacagatgcccggcgggtgcgtctggagatggggacggcgggagttgagttgtggcagtagttgagttgtaatttgtgggcggaggcccagagagactccccacccttcacccctgccccactctgtccccagttccgccatttgtgaggccagaggtttccggactgttggcctcgccaggcagccgtctcccgccccaggcggcatcccccagtccctcccgcctccacgagagcctggagctctcagcctcgcccggggctccactctctcctccggctccctgggctgttttgctctaacgatcttgccagatccctccctctgtagacaaccaccaacctctgtttgctgttgaattctctcctcacattacccaggtctgctcaagacatgattttggttttggtttctgagggttctagtgggcagaaggttggagggacacttatgagggtggccgggggtctgacgctgcactttggaaaaactcacacagttgaatttccaaagaaatctgccctttgccctctttgcacctttgatacattctggaagttttctcaggctttggacacttctggggatggaggtgtggagaagtggggagttccc

SEQ ID NO: 76996 - DNA, 410 bp, Homo sapiens
actgaagaaattaggctcgaagaggtcacatgacttagccatggtcacaaggcagaggcagagctagaactttatttttgcagtttggtttattgaaccaattaaaataaataatagcatggtaaagacaacaccgtatgaccttggaaaggaaacaaacctctctagtcatgcacagcagttctttctagcacgtggtcctagaaatttcattttttcttttttataattttttttatggcccaagaaatttcaaaacatgcttccccactttaccatgtggaggagaaatagatctgtgagaatgggtaggcaagaagagaagagaccatcctttaaatgatgtttattgtataaaagtaattatttggactttaaaaccactcaagaataaagttcgcatccagaaa

SEQ ID NO: 76997 - DNA, 403 bp, Homo sapiens
acaggaagacaatgggaatctgcccatcttagccagattagggggaagaaatctcccttgaaaatttttagccatagacctccccacagtcagctttaatctttgagcttatataaatatattttaaatgagcaaagttggtccttaggcagtaatacagaagcaaatagggacaaatctcaaccctgcagcataggatttctgtagctaacaccctacaaaagatgagctcacaatccaaaataatgaaacataaggaagcaatccacattgaatgacagtaacagacataaaaaatggtggaattggactcccccaaaactgcagataaaagagttatgtaaactaaaaataaatatatgcaatgttactaatgacataagaaaaaggaactgacctcatg

SEQ ID NO: 76998 - DNA, 877 bp, Homo sapiens
caatgggtattacagcactaaattacggcgaaatgtttaagacgcccagtaagggcgtaacggactccatttggaggattgggactgggcccccctggaggtagacggtaaaataagttcatatggcaaagagcccatcaccgctcaattggaacgcagtcaggcgtcttgcgaaacagtctggaatttaatcgcaatgatcctattattaaccagcggctcagatatattttgatcgcgaaactttaaacaaattcgggataaaaagaaaatcaatctcttgaaaaacatagatgaaaaactcacagaagcagccagagaattggggtactcgcttgaacagagaaccgtgaagatgaaacagagagataagaaagttgtgacaaagacctttcatggtgcaggcttggttgttccagtagataaaaatgatgttgggtaccgagagctccctgaaacagatgctgacctcaagagaatttgcaagacaatagttgaggctgcaagtgatgaggagagactaaaagcttttgctcccattcaggaaatgatgacttttgtgcagtttgctaatgatgaatgtgattatggcatggggcttgaattgggaatggatctcttttgctatggctcacattattttcataaagttgctggccagcttttacctcttgcatataatctgttgaagaggaatctgtttgcagaaattattgaggagcatctggcaaacagaagtcaagagaacatagaccaacttgctgcatgagtaaggtggctttgattggtgtacagtatttcaaaggactagtattaaacttgtgatttttgttttgtttttaaggaatacaaaaaataaacatttactaaaaacgtt

SEQ ID NO: 76999 - DNA, 785 bp, Homo sapiens
acgcgatagggggagggggtggagagtagggggttaggttgtggggtatgagttgggggggggaagtgggatcatcgggggggtgcaccggttcgtttccaatgtcctagaagagtggaagagggatgctctggggtgcggggcgtgggattgggggggccgtgataggaggggtggggagacagaatcgagacaagcagggaagggatgtgttagatgtgattggcgctcaggaggaaagtggataaggagaagattatgaatatgtggaagggggatagaaagggggggcagaagcttaacatataaagtgaaagggggtactcaatggataacaagtacgaatgggacagacagttccctgaaacatagctgacctcaagagaatttgcaagacaatagttgaggctgcaagtgatgaggagagactaaaagcttttgctcccattcaggaaatgatgacttttgtgcagtttgctaatgatgaatgtgattatggcatggggcttgaattgggaatggatctcttttgctatggctcacattattttcataaagttgctggccagcttttacctcttgcatataatctgttgaagaggaatctgtttgcagaaattattgaggagcatctggcaaacagaagtcaagagaacatagaccaacttgctgcatgagtaaggtggctttgattggtgtacagtatttcaaaggactagtattaaacttgtgatttttgttttgtttttaaggaatacaaaaaataaacatttactaaaaacgtt

SEQ ID NO: 77000 - DNA, 1486 bp, Homo sapiens
gttttactatgatcctcctgagttccagaaaatcattataagctttctttacctgaagatttctatcacttctggaagttctgtgaagaacttgatcctgaaaagccatctgattcactttctgcaagccttggacttcaattagttggtccttatgatatccttgctggaaaacataaaacgaagaaaaaatcaacaggcctgaattttaaccttcactggaggttttactatgatcctcctgagttccagaccattattattggagataataaaactcagtaccacatggggtatttcagggattctcctgatgaatttcctgtatatgttggtataaatgaagcaaagaaaaattgtataattgttccaaatggagataatgtatttgctgcagtcaaattatttttgacgaaaaaacttaaagaaataacggataaaaagaaaatcaatctcttgaaaaacatagatgaaaaactcacagaagcagccagagaattggggtactcgcttgaacagagaaccgtgaagatgaaacagagagataagaaagttgtgacaaagacctttcatggtgcaggcttggttgttccagtagataaaaatgatgttgggtaccgagagctccctgaaacagatgctgacctcaagagaatttgcaagacaatagttgaggctgcaagtgatgaggagagactaaaagcttttgctcccattcaggaaatgatgacttttgtgcagtttgctaatgatgaatgtgattatggcatggggcttgaattgggaatggatctcttttgctatggctcacattattttcataaagttgctggccagcttttacctcttgcatataatctgttgaagaggaatctgtttgcagaaattattgaggagcatctggcaaacagaagtcaagagaacatagaccaacttgctgcatgagtaaggtggctttgattggtgtacagtatttcaaaggactagtattaaacttgtgatttttgttttgtttttaaggaatacaaaaaataaacatttactaaaaacgttaaaaaaaaaacacacaacacaaaaaacaaaaaaaaaacaaagaaaaaaaaacaaaaggaacaaaaaaaatagaagacaaaagaaaaaaaacaaacgcagcaaacaacgaaccaagcgcgcaaagagaaggaaacagcgcgcacacacaacccgcaaccacggacggaagaaaaaagagatacacagagcaggaggggcggcgcaatagacaaaaccactgcgagcgacgcacgccaccgagcacgacaaaatcacgcatggctaagaagaaagacgacgaccacacggaggagagcgtcttacatcagagaaggcccgcgcgcggcagaaccaacccagagacgatgcaccaacacaaccgcgtgagtcactgcgaagacacccaactcggggagggatgcgagcacacacaacgctactaaggcgaccagac

SEQ ID NO: 77001 - DNA, 993 bp, Homo sapiens
gtgctgaagactactacccaaggtggcacaagttgtattagtacaaagtcttaggaggaaaaaccctctttataatcttcttacttttgaagactgattcattttctaactatgtagataatcttttatattattgatttctttcagctgacctcaagagaatttgcaagacaatagttgaggctgcaagtgatgaggagagactaaaagcttttgctcccattcaggaaatgatgacttttgtgcagtttgctaatgatgaatgtgattatggcatggggcttgaattgggaatggatctcttttgctatggctcacattattttcataaagttgctggccagcttttacctcttgcatataatctgttgaagaggaatctgtttgcagaaattattgaggagcatctggcaaacagaagtcaagagaacatagaccaacttgctgcatgagtaaggtggctttgattggtgtacagtatttcaaaggactagtattaaacttgtgatttttgttttgtttttaaggaatacaaaaaataaacatttactaaaaacgttaaaaaaaaaacacacaacacaaaaaacaaaaaaaaaacaaagaaaaaaaaacaaaaggaacaaaaaaaatagaagacaaaagaaaaaaaacaaacgcagcaaacaacgaaccaagcgcgcaaagagaaggaaacagcgcgcacacacaacccgcaaccacggacggaagaaaaaagagatacacagagcaggaggggcggcgcaatagacaaaaccactgcgagcgacgcacgccaccgagcacgacaaaatcacgcatggctaagaagaaagacgacgaccacacggaggagagcgtcttacatcagagaaggcccgcgcgcggcagaaccaacccagagacgatgcaccaacacaaccgcgtgagtcactgcgaagacacccaactcggggagggatgcgagcacacacaacgctactaaggcgaccagac

SEQ ID NO: 77002 - DNA, 361 bp, Homo sapiens
gtgtagctaaaatgattttggaagtagcctttgttaaacaagtgctttgttgatatattttctgctacttattaggatatctgctatattctctgcttaatgttatatttttatttttcagtattttcataaagttgctggccagcttttacctcttgcatataatctgttgaagaggaatctgtttgcagaaattattgaggagcatctggcaaacagaagtcaagagaacatagaccaacttgctgcatgagtaaggtggctttgattggtgtacagtatttcaaaggactagtattaaacttgtgatttttgttttgtttttaaggaatacaaaaaataaacatttactaaaaacgtt

SEQ ID NO: 77003 - DNA, 1211 bp, Homo sapiens
ggttggcggcgctcggaagcggcccgcggatcggggaattctgctggcgctgcagctgcagaatggtcggcggtggcgggaagcgcaggcccggcggggaggggccgcagtgtgaaaaaacaactgatgtgaagaaaagtaaattctgtgaagctgatgtctccagtgaccttcgaaaagaagtagaaaatcattataagctttctttacctgaagatttctatcacttctggaagttctgtgaagaacttgatcctgaaaagccatctgattcactttctgcaagccttggacttcaattagttggtccttatgatatccttgctggaaaacataaaacgaagaaaaaatcaacaggcctgaattttaaccttcactggaggttttactatgatcctcctgagttccagaccattattattggagataataaaactcagtaccacatggggtatttcagggattctcctgatgaatttcctgtatatgttggtataaatgaagcaaagaaaaattgtataattgttccaaatggagataatgtatttgctgcagtcaaattatttttgacgaaaaaacttaaagaaataacggataaaaagaaaatcaatctcttgaaaaacatagatgaaaaactcacagaagcagccagagaattggggtactcgcttgaacagagaaccgtgaagatgaaacagagagataagaaagttgtgacaaagacctttcatggtgcaggcttggttgttccagtagataaaaatgatgttgggtaccgagagctccctgaaacagatgctgacctcaagagaatttgcaagacaatagttgaggctgcaagtgatgaggagagactaaaagcttttgctcccattcaggaaatgatgacttttgtgcagtttgctaatgatgaatgtgattatggcatggggcttgaattgggaatggatctcttttgctatggctcacattattttcataaagttgctggccagcttttacctcttgcatataatctgttgaagaggaatctgtttgcagaaattattgaggagcatctggcaaacagaagtcaagagaacatagaccaacttgctgcatgagtaaggtggctttgattggtgtacagtatttcaaaggactagtattaaacttgtgatttttgttttgtttttaaggaatacaaaaaataaacatttactaaaaacgtt

SEQ ID NO: 77004 - DNA, 1644 bp, Homo sapiens
ggttggcggcgctcggaagcggcccgcggatcggggaattctgctggcgctgcagctgcagaatggtcggcggtggcgggaagcgcaggcccggcggggaggggccgcagtgtgaaaaaacaactgatgtgaagaaaagtaaattctgtgaagctgatgtctccagtgaccttcgaaaagaagtagaaaatcattataagctttctttacctgaagatttctatcacttctggaagttctgtgaagaacttgatcctgaaaagccatctgattcactttctgcaagccttggacttcaattagttggtccttatgatatccttgctggaaaacataaaacgaagaaaaaatcaacaggcctgaattttaaccttcactggaggttttactatgatcctcctgagttccagaccattattattggagataataaaactcagtaccacatggggtatttcagggattctcctgatgaatttcctgtatatgttggtataaatgaagcaaagaaaaattgtataattgttccaaatggagataatgtatttgctgcagtcaaattatttttgacgaaaaaacttaaagaaataacggataaaaagaaaatcaatctcttgaaaaacatagatgaaaaactcacagaagcagccagagaattggggtactcgcttgaacagagaaccgtgaagatgaaacagagagataagaaagttgtgacaaagacctttcatggtgcaggcttggttgttccagtagataaaaatgatgttgggtaccgagagctccctgaaacagatgctgacctcaagagaatttgcaagacaatagttgaggctgcaagtgatgaggagagactaaaagcttttgctcccattcaggaaatgatgacttttgtgcagtttgctaatgatgaatgtgattatggcatggggcttgaattgggaatggatctcttttgctatggctcacattattttcataaagttgctggccagcttttacctcttgcatataatctgttgaagaggaatctgtttgcagaaattattgaggagcatctggcaaacagaagtcaagagaacatagaccaacttgctgcatgagtaaggtggctttgattggtgtacagtatttcaaaggactagtattaaacttgtgatttttgttttgtttttaaggaatacaaaaaataaacatttactaaaaacgttaaaaaaaaaacacacaacacaaaaaacaaaaaaaaaacaaagaaaaaaaaacaaaaggaacaaaaaaaatagaagacaaaagaaaaaaaacaaacgcagcaaacaacgaaccaagcgcgcaaagagaaggaaacagcgcgcacacacaacccgcaaccacggacggaagaaaaaagagatacacagagcaggaggggcggcgcaatagacaaaaccactgcgagcgacgcacgccaccgagcacgacaaaatcacgcatggctaagaagaaagacgacgaccacacggaggagagcgtcttacatcagagaaggcccgcgcgcggcagaaccaacccagagacgatgcaccaacacaaccgcgtgagtcactgcgaagacacccaactcggggagggatgcgagcacacacaacgctactaaggcgaccagac

SEQ ID NO: 77005 - DNA, 606 bp, Homo sapiens
aagtgcatccaaggccctgggttctccagccctgccacaaccttgctctgtgacctccagcaagaccctgccccttctgggcgtgtgcgtagtatgagggaggacctagctcagtgccaagccccagcaggatgtctttcctcaaccgcagccacgggtctcagcccatggaagaataaacctccccctgtgaggctgttgtgacagttttgagaaaaggttcagactcagaggctgccagatgggaagggacccttgtgagtcagtgctgagccgccccacatcctggccttggcctggaagctttgtggtgtcctgcttgcaggagagggtagagagggtcacgtcccagccaccttcttggcactctcagaggtgtccatgggggaggccccagcgtggctaaagaagaccggaggcctcgctgggtggacagtccagtgggtaagagcggggccttggtggcagaggccctgaggtgaacccggctctgcctgtgactgagccaggccacttaacctccctgaactgcagtgtctgaggctgtcaaaggggattattcagagttttaactgaagaacagagatgtcagcctcttattctaag

SEQ ID NO: 77006 - DNA, 675 bp, Homo sapiens
tcagtgagctatgatcacaccgcgcattccaaccagggcgacagagtgaggcccatccccatatatatatatatatgatggattataaggtatcaaagattcaaagcctgtttgtcaagagaaaattttaaaactggagtctagttttggtaaagatatttgctgtttgaataaaatgaacaaagatttgacaaactatagttttctgcttttgtatatcttacgttgttttcagaaatttcttctgtgtaaagatatgtcaatatctttgaaagaatgttttgattgagtaggccataaattagtagtctagggcaagggtcagcatacttgagcccattgcttctttttataaatacaaatacagtttgttagagcatagcatgcatatacatttatatgttgttcatggcaaatttgaactacaacaggaaaatttagtcttgcagcagagactttatggtccacaaagcctaaaatatttactctctggctctttatagaaaaagttggcagacccctagtctaggaaacagataaaacttctcatatctggccaggtgcggtggctcatgcctgtaatcccggcactttgggaggctgagacaggcagatcatatgagcctcaggagttcaagacgagcttgggcaacatggcgaaaccccttctctaca

SEQ ID NO: 77007 - DNA, 513 bp, Homo sapiens
agtcctcaagctatcctcctgtcctggcttccccaaattgctgggatttatagggatgagctactgtggcagccaagaaaaatctttaaaaaattactatcttataactaagcttatacaatgaagacagcatattttattgtcttcccccttgtacacaaacttaaaaatcattttaagaactgataagaagatcgagagttctattttcaagatgtaatattgtaccaacaaaagctaaaaaattcaaatatgtatagtgtattactgaatggaagactaactcgattggcagagtttataggtaatagttttaatagtatgataaaatttattgtggtttatgttgaactctttttaaagatgatgagcattgattctttgttttccatatcctcgaatggtaatttctactgttgagtcattccaataaaagcattttggtcacatagtagtgattacttggcttgcctttcttgcttcttcatttttctgacctgttctctctgttca

SEQ ID NO: 77008 - DNA, 599 bp, Homo sapiens
  misc_feature (27)..(27): n is a, c, g, or t
ctaacacggagaaaccccgtctctacnaaaaacacacaaaaaattagccgggcgtggtggcgggtgcctgtagtcccagcactcgggaggctgacgcaggagaatggcgtgaacctgggaggcggagcttgcagtcagcggacatcgtgccactgcgctccagcctgggcgacagaacgagactcagtcaaaaataaaaaagccatgaagaataaatgtatatggtgatgacactaaaattcaggttctgtggaatttagattaatttcctagcaagaggcagttggcaatttttaaattgttttaaattgtttgaaactatatttaggctaagctttaaaaaataaatgaaaaagaatttttctatgattcgttaaaaaaaaaaaaaaaggccttggtttccaatcctcagtactacgttactactaagtatttaggtgccatgggaagaatcatttccctctcttggcctcacgggtttccatatatgcccaggaaactgagctagtctctaccagccataaacttatcatggaatattttttaaatttagataaatatgtaagtaaatctaggatgctggaatttcctctgagtgg

SEQ ID NO: 77009 - DNA, 429 bp, Homo sapiens
tggcatgtgcctgtagttccagctaattggaaggctgagacaggagaatttctggaaccctggaggtggaggttgcggtgagctgagattgcaccattgcactccagcctggacgacagagtgagattccatgtgaaaaaaaaaaaaatcatacgaagtatgttctcacatcattaagctagaaatcaaataacaaaaatatctaggaaatccctaaatatctagaaatcaaacaacacatgggccaagaaaaagtttcaagggaaattagaaaatatttccaattaaatgaaaatacaccataaaatttgtgggatgcaggtaaagcagtgcttagaggaaattcgtagcattaaatgcttttactggtaaaaaaagaaaggtcctcagtcaatagtctaaacttccaccttaggaaactacaaaatg

SEQ ID NO: 77010 - DNA, 864 bp, Homo sapiens
acgggccttctccttctgcgttccctctgctgacactggccgacccacctccttcaggaatgatatgtgcaagcacttagccttgtgccttactgacaacgccactgtaaaccccagaacactttcctcctgtctcttgctctgatacttctttcaccatctgctggtctccctctgcaagggttccagccaaggagaaccggcgatgggagaggcagggtgcctcaacctgctgggtcctcagcagcctgatggaggggccaccgcttctacagggttctcaccacacttgctgtttaaccaccatgagtgacaaaggcaaatgccacacagcaattctaagcccatcaggtgcatgagacaccaaacaccgctcacagacactgcggagggcacagactggctgtgtagcaggcactgcagtgcagaactgcccacacagtgtatgaggggccagggtttttgtttgatttgcattttattgtggtaaaaatacttaacatgagagctaccctcttaccacatttttaagcatataatacagtacaggttttaaggttggtaattttcatggaattcagaggccaacctctatattttggtgaaaactaacagttcttaatctgaactactcaacactaaaattttccacaaatggcagcttctgatcacttcagatgttccagtgattggtagcaattaaatggaaaattccaatctgagctggctccaagtatgccacaagtacaggatcagaagctatgaccactgtctgaccctcctcacagcagcaaagcaggaaacagcaaactcagtttgtaccaacggggcaatggggaatttcctgaggtcaaatcctccttg

SEQ ID NO: 77011 - DNA, 443 bp, Homo sapiens
cctatggttaatggtttctgcagaaaaggaccaattgatttctttctaaaacgttgcttcagggtgtagagacctttataggtcatgtttcaacttacagaaaatttttatagttcaaatataaattaagttcaatgtggaatttgtaatagaatttcaggtgaagtaaaatttccactttccttaggctgtttgcagtgcccagcaggccccatgatatcgagatggaagttctgttaaaggaggagattgatcagggatgggcagaataagggatatgcgcagctcaggctaatgatacaatgattgagatgtagaaagagggtcaggcatgggataacgcctgtaatcccactgccttgggaggccaagacaagagaatcgattgaggtcagaccagcctggtcaacagagtgaggacctaacctgtacaaaaaaaaaaa

SEQ ID NO: 77012 - DNA, 351 bp, Homo sapiens
tgatgttatctaaattttcttaatataatacatgggtaagaataaaagtacctgaaaattataaagaatattgagaaatgtgaatcaggcaccttacaaaattgacttgtaaaataatatacccttaaaatgtcatctattctatcctacttgtattattcagggttccctagaggaacagaactaataggatagatagatgtatatatgaaagggagtttattaaggagtattgactcacacaatcacaaggtgaagtcccacaataggctgtctgcaagctgaagagcaaggaagccagtccaagtcccaaaacctcaaaagtaaggaagctgatagagcagccttcgg

SEQ ID NO: 77013 - DNA, 782 bp, Homo sapiens
agcggagcttggacagccacgcgtgcgcccaggccaggcggagggactgccccgccctggtccagtgattgatcagcagtgattactgaggctttaatggtccgcttggatgggaattaattctgggatggataaataatgcatcgaggtttatgtagtccaaggcgagccgtccgtccggagccaggagaggtagccgagggagcctgacgggtgacgccagcggccacggggccccgaacgagcaggacatgaggggcgactaggcgcgaggacgagcaaaagcaagtggatgacagcatgaacggccctgcggggctggccggacggctgcaagaacatgctgagcccaaagatcaggcaggccaggagggcccgctccaaaagcctagtgatgggggagcagagccggagccctgggcggatgccgtgccctcacaggctgggccccgtgctgaaggcgggctggctgaagaagcagaggagcatcatgaagaactggcagcagcgctggtttgtgctgcgtggggatcagcttttctactacaaggacaaagatgagatcaagccccagggatttatttctctacaagggacacaggtgactgaacttcctccttggccccgaggacccagggaagcacctctttgagatcagcccaggtggtgccggggagcgggagaaggtgccggccaaccccgaggcgctcctgctcatggccagctcccagcgtgacatggaggactgggtgcaggccatccgccgagtcatctgggccccg

SEQ ID NO: 77014 - DNA, 395 bp, Homo sapiens
tgatttaaagaatcaaagacataattcacactttatttttcaaatcaccctttatcttagtctgttttagctataataaaaatatcataggctgggtggcttataaacaacaaaaatgtgtatttcacagttcgggaggctgagaagcacaagatcgaggcactggcatattcggtatttggtgagggcctgcttccttgttcataaatggctaccttcttgtatcctcacaaggcagatgggacaaggaagcattctggagcctcttttatgagggcactaatcccattcatgagagttcatttcttcatgacctaattacctcttaaaggccccacctccaaatatcatcacactgagaatccgatttccacatatgaggttttggggaaata

SEQ ID NO: 77015 - DNA, 915 bp, Homo sapiens
attcgttacctatttgttcttgtgtgttggtattatattttccacatcctcatgggccactaaattataatattttaacttcaaatgacgtctaacttggaatcacgtaatcaatattactttactgagtgtttatcttccctaaactgcttcatggaccacaaaagaagacctaaaaaacaacatctgatgctcagtttcaatggatcaatgagctgaacccaaaaatagccactctagaatattcatgagaggcctctcagtataactggaaacttcataccaagtttcactttcaaagaattcattttaaaacatgttctctgattttaaactcagttatttatatgatattaaagagactttaaccaacttgatggcaaacctaacaaaagatgtctaccaattattttaacttcatcaaaggttttaagggaaactatttaagacatattaacaacttcctattttgttccataggccccattcttaaaaggctcctcagggctttaatattccataatattaaaagggctttaatattccataataatttattttacgctttcttaataaccttttctcaaactccaggtgaatcatttctgcaatttgttactgtttgtagctcaacaaattattcatttgagctggctgagccacacgcataacatttttaattagagtgccacagttgacttcaaatccaaaatatcccaatccaaaattattctgtaggcttcggatttgctgccaggagtctaaaaagctaaaaatagcgaccaaactttcacatcacaaggcagaaaaaagcatttcaagaaagcgtacaggcttcaaatagatgcgtgaacagatcccaaaaggcaggcataggctgacaagacttcagatttgaccgtccccagtatactt

SEQ ID NO: 77016 - DNA, 487 bp, Homo sapiens
aaaacctatttaaagattgcaatatataatcatttttacagtatttgattaaacctgataggctttccagaaatgaaaaaaagtcagttctaaaaccaaagctgatatttagaaaatgtgaaaatgtaaatcagtgctatccatagtatagtttctctaaaactttatcttaaacagtcattttaaaagaatataactattcaaaaacgtaactgctatcttaagttttaaaataagttaaaacattttaaaatatgaatactgtagtttaaaagaaagaaactgggggaaggaaaagtagagaaatgccaattccaatgcaaggctttatttgccaagttttcttagaatgacttttaccaactgatgaattcctgaaacagaatgtataatggaaatacggaaacactgttgcctaaagtggcattattcactgctactgtgatgctactgtaatgtaataaattattaaattgttgcaaagtgc

SEQ ID NO: 77017 - DNA, 319 bp, Homo sapiens
cttcactgccgctgccctttgagacagggaacacacgtggagaaacctgtgaacaaaacccaagtgcaccagcccagctccatccacagcggacggccgccctccatccccctcggggccgcagcctgctgtgggtgagggtgacgagggggagcgctacacgctggctcctggctcccaacactgacttccccaggcaggttgggggcattgttccctgcaagcctcagtcccaagaacacagctctaccaggagcctgtcctgtgagaggcactgatgcacgtgggcctgtcttctaggcccttggtgtagctcgaa

SEQ ID NO: 77018 - DNA, 576 bp, Homo sapiens
aaatttagaaacagaatgatcagatgttcccgcagtttcatttgtgggtacctaccaaaaagaattagaagccaggagtggaagacagatttgtgtacacccatattcatagcagcattagtcacaacagccaaaatgtggaagcaacccaagggttcatggacagatgaatgaaaaagcacactgcagttcctttatacaatggaagactattcagccttaaaaaggcaggcacttctggccagtgcggtggctcacgcctgtaattgcggcgtcttggaagaccgaggtgggcggatcacctgaggtcaggaattcaagaccagcctggccatcttggtgaaaccctgtctctactgaaaatgcaaaaaatgagacgagcgtggtggggtgtgcctatagtcccaactactcgggaggctgaggcacaagaatggctggaacccgggaggcggaggttgcagtgagcccagattgtgccactgcactccagcctgtgcgacagagtgaggctccatggaaacacaaaacaaaacaaagtcaaacgaacaaacaaacaaaagacaaacaaaaaaa

SEQ ID NO: 77019 - DNA, 415 bp, Homo sapiens
tgctgggattacaggcgtgagcgaccgcgcccggaccatgctgtatccttatctgttgtctgttgttgtttgtttgttttggagcccagaaataacttctcacctatatgttcaaatgatttttcacatgagtgctaagaaagctcattggtggaaaagcagccttttcaagaaatggtgttggagaaacttgatttccacatgcaaaaaatgagacgagcgtggtggggtgtgcctatagtcccaactactcgggaggctgaggcacaagaatggctggaacccgggaggcggaggttgcagtgagcccagattgtgccactgcactccagcctgtgcgacagagtgaggctccatggaaacacaaaacaaaacaaagtcaaacgaacaaacaaacaaaagacaaacaaaaaaa

SEQ ID NO: 77020 - DNA, 362 bp, Homo sapiens
tactgctatggcttttgtagtagctgaaagtacaagttttccttctccatttccacttccttttttaaagtgaatgaacatttttaaaatataaattttaggataaattcataaatctccccaaaaaatgcaaaaggagttttacataggattactttgaacttacagataaactagggaaaatcaacatctttgtagaactgagatattccacacaagagctagggtgtttaaagcttcaccagttatcctgacgcaaaaccggggcagcaaagccttgctgtaaatatctggagctctgagaacgtcttgtgttgcttttgcttttgtgacttggtgatatctttgttgcaaaacaaaac

SEQ ID NO: 77021 - DNA, 532 bp, Homo sapiens
aaaaaaaaaaactagtactaccaatgaaataaatgcaacagagttggagagctcaagtcacgtattcatttattctacaaatactctctaaatggctactctgtaaccaagcattttatattgcttttttattgagagaggacatacatgtttagaattcacacagctcaagtatacagcttgaccaattcttacattagtgtccatccatgtaaccatcatccaatttaagatgtggaatatttctagcagctcagaaggttctcttgtgccttctccccgttcctaatcccctccaaaagatacccattattttgacttctatcactgtgggatagttttgcctgctcttgaattcacggacattcaaatcgactcatccagtacatactcctttgggtctggtctgtttcgttcaacattatgtccaggaaattcatccctttgcttatgtgcaactatagttcattctttttctttgatgcacagaatactatgccattcaatacacattgaacaatatgccacaatt

SEQ ID NO: 77022 - DNA, 724 bp, Homo sapiens
cctaaatcttgagtagtgtacggtaatgacgcttcttcctatatccactcttattatgttaaaacaaatgtatttgcgagtattggcattttagactttaaaaatgctgtatgatttcagatgaactctgctgtttagaagtaaccacagaaaagcaaagtcagtgtacactctgagtgaaaggaaatgtaatgtggataaaggcccgccacctcctcacattggtttatttactggcagctgatacgtttaactcatttccttgagcttatacaaaacatagaaaagcaaactgttaaagtagtcaataattatttgtctcagatcccagattctatgatccctgcttaaaagaaaatgttcactgcatgtaggttgatttcttatgttttgtagactcattgttatttttcaatccccaaaagtcttggcctaaaccatccctaggggagcagattaacctaccactacattgcacagggttggtgactcgacgtggtgaatgtgcacacgccctgcctggtccgccatgttccaaagaagatgatttaatggtagaacggatacctgctgctagacctgatggaatgttacctgtccgtgttacataatcaagtgcaatatactcagttctcatgcaggtgacattctaccatgaaacgcagaagataagccatgtttctgtattgtacatgtaaagaaaaataaaactgtttatgataaa

SEQ ID NO: 77023 - DNA, 1686 bp, Homo sapiens
gccgcgcccaggggagatggcgtgcaagtatccgctgcggtgttctggtgctagagtggagaggctggcaaagaagaaggcacacgcatggtgagaatccggcctgagccgaagcggagtttgctatggacagcaaccatcaaagtaattacaaactcagtaaaactgagaagaagttcttaaggaaacagattaaagccaagcatactttgctgagacatgaaggcattgagacagtatcctatgccactcagagcctggttgttgccaatggtggtttgggtaatggtgtgagtcggaaccagctgctcccggttttagagaaatgtggactggtggatgctctcttaatgccacctaacaagccgtactcatttgcaagatacagaactacagaagaatctaagagagcctatgttaccctcaatggaaaagaagtagtggatgatttaggacaaaagatcactctgtatttgaattttgtggaaaaagtgcagtggaaggagttgaggcctcaagccttaccaccaggactcatggtagtagaagaaataatttcttctgaggaggagaaaatgcttttggaaagtgttgattggacagaagatacagacaatcaaaactctcaaaaatccttaaaacacagaagagtaaagcattttggttatgagttccactatgagaacaacaatgtagataaagataagccattatctgggggtcttcctgacatttgtgaaagctttttggagaaatggttgaggaaaggttacattaaacataaacctgatcaaatgaccataaatcagtatgaacctgggcaagattgtcatggattttaagcacccagatggcattgcagtgccagttatgttgcctcgtcggagtttgctggtgatgacaggagaatctagatacctttggacccatggaatcacgtgcagaaaatttgatactgttcaagcatctgagagtcttaaaagtggaattatcaccagtgatgttggagacttaactttaagcaagaggggactacgaacatcatttacatttaggaaagtgaggcaaacaccttgtaactgtagagcgtagagtggcagctctccaagaaattgttcgactcctgagaccaggtgggaaggcactcatttatgtctgggcaatggaacaagaatataataagcagaagtccaagtatcttagaggaaacagaaatagccaaggaaagaaagaggagatgaacagtgatacctcagtgcagaggtcacttgtggagcaaatgcgtgacatgggcagtcgagactcggcatcttctgtcccccgcattaatgactctcaggaaggaggatgtaattcaaggcaagtttctaattccaagctgcctgttcatgttaacaggacttctttttattctcaagatgtactggttccctggcaccttaagggaaatcctgataaaggcaaacctgttgagccatttggtcccataggatcccaggacccaagtcctgtgtttcatcgttactaccatgtgttccgtgagggagaactggaaggtgcctgcaggactgtgagtgatgtcagaattctgcaaagctactacgatcaaggaaactggtgtgtgattcttcaaaaggcctgattatttacctgaacacatcatatataaagaagaaatgctcactt

SEQ ID NO: 77024 - DNA, 3573 bp, Homo sapiens
gccgcgcccaggggagatggcgtgcaagtatccgctgcggtgttctggtgctagagtggagaggctggcaaagaagaaggcacacgcatggtgagaatccggcctgagccgaagcggagtttgctatggacagcaaccatcaaagtaattacaaactcagtaaaactgagaagaagttcttaaggaaacagattaaagccaagcatactttgctgagacatgaaggcattgagacagtatcctatgccactcagagcctggttgttgccaatggtggtttgggtaatggtgtgagtcggaaccagctgctcccggttttagagaaatgtggactggtggatgctctcttaatgccacctaacaagccgtactcatttgcaagatacagaactacagaagaatctaagagagcctatgttaccctcaatggaaaagaagtagtggatgatttaggacaaaagatcactctgtatttgaattttgtggaaaaagtgcagtggaaggagttgaggcctcaagccttaccaccaggactcatggtagtagaagaaataatttcttctgaggaggagaaaatgcttttggaaagtgttgattggacagaagatacagacaatcaaaactctcaaaaatccttaaaacacagaagagtaaagcattttggttatgagttccactatgagaacaacaatgtagataaagataagccattatctgggggtcttcctgacatttgtgaaagctttttggagaaatggttgaggaaaggttacattaaacataaacctgatcaaatgaccataaatcagtatgaacctgggcaagattgtcatggattttaagcacccagatggcattgcagtgccagttatgttgcctcgtcggagtttgctggtgatgacaggagaatctagatacctttggacccatggaatcacgtgcagaaaatttgatactgttcaagcatctgagagtcttaaaagtggaattatcaccagtgatgttggagacttaactttaagcaagaggggactacgaacatcatttacatttaggaaagtgaggcaaacaccttgtaactgtagagcgtagagtggcagctctccaagaaattgttcgactcctgagaccaggtgggaaggcactcatttatgtctgggcaatggaacaagaatataataagcagaagtccaagtatcttagaggaaacagaaatagccaaggaaagaaagaggagatgaacagtgatacctcagtgcagaggtcacttgtggagcaaatgcgtgacatgggcagtcgagactcggcatcttctgtcccccgcattaatgactctcaggaaggaggatgtaattcaaggcaagtttctaattccaagctgcctgttcatgttaacaggacttctttttattctcaagatgtactggttccctggcaccttaagggaaatcctgataaaggcaaacctgttgagccatttggtcccataggatcccaggacccaagtcctgtgtttcatcgttactaccatgtgttccgtgagggagaactggaaggtgcctgcaggactgtgagtgatgtcagaattctgcaaagctactacgatcaaggaaactggtgtgtgattcttcaaaaggcctgattatttacctgaacacatcatatataaagaagaaatgctcacttaaaaaaaaagagagaataaattaattacccttttaattaaagagaaaacttgtgggaaagtaccaaaggaaagctgagaaaaatttggaagtagggattcattaggagacattcaaatgtctcctgttggctgacatcacagatgtggtgttggctcctcctacttccctaggagaggtggtttctaaaagtgattgaagcagtttgtgcagtgtttgtaattcttgggtaagagcccaggattttgaagataatagttttttagtaaagtgctactaaatgtagtaaatcatgtaggattttagggatgtaattatatgttaatacagaaaatagtcctggtcaatagaaaattgtctgaagttttacctatgatttttagctctgtaaaatcatagacaataaccattctatttccatgcctgactagcccagggctggacgtatagcgggtgtccaataacgtttagtcaatcagataatacccagaacttagtaggagtttcattcaaaaactattttttgaacccaaccatgtaccagttactattttaagtactgataatgaagcagtgaataagaaagagcaaagctcttgcccttatggtgcttacattctagacggggagacagacagcaggcaaatcaataaatagatactatgtgccagatagtgataaatgccatgaaaaacataaaatgagagacgattcaccttggagcaaaagattacttttaagtgactgaaataactactaatcctgactaatttattatcaagagttaattggtattccaaattcattgagcagggtgctaaaaacaacccaaatgtgctcctttaactcctttgtttaaatgacaaaagttagaatgtggtcactcagacctaactgtgcccttagagccaaagctgtggtgtcattattggttatttctagttgattcatagtttgtcccaatccaggttcaatcgggttatttttaagatctgtacaatattgcataatagtaacccagttaacttaccacttaggttagatttcctggaggaacaaaggtagaaattcaaccataggtcaaattatcacatagaaggaaaaggctttttttcaaagaaaaaattttttgaacactttactcccagtatgcattacttttgtagtagtaatgcttaagactgttttaaagaaaaattgctttctgtttaattaatgtttactgttattaatgctagtgatacttaatcttgaagcatcaagttttcagaaacctatagtgatcaataatgggtctcagatgagaggatgattatttttttcatggaatttcagtccaacatcctggtgtactggtccctctgggatgaatttataaggctcatgatataggaaaaggaatatagggctaaaaatagttttatttctgatataaattctggtacttgacaccaaagtttgaagtcaagtcatgccaataaattttaacatccaaatgaaatagatgattttctatgaagatgaaaaataccaaaattgactcaagaagggagagaaaatggaagatgttgaaaaatagcataggaattcagaactgggctctagaatcagatttcctgagagttgaattctagatctgccatttattagctgtgggattttgggcaaatttcttgactttctgtgcttcagttttcttagctgtaaaattggaagagttgttatgaaaattcactgaaagtatatttgtatacatcataggatagtgtaagaatatagtatggctttgagaaatgttcattattattactcccagaggagttttaggtattaagtgatgccaaatataatttgttaattgtataataaaaatctatattcttactga

SEQ ID NO: 77025 - DNA, 1219 bp, Homo sapiens
gtgatagccagaggaaagagactcccccctcatttccagagagtgataaagaagcctcacggctggagcaagagtacgtccatcaggtttatgaagagattgctgggcacttcagcagcacaagacataccccttggccgcacattgtggagtttttgaaggctttgccaagtggttcaatagtggctgatattggatgtggtaatggaaagtatcttggcatcaataaggagttatatatgattggttgtgatcgtagccaaaaccttgtggacatttgtagagagaggcaatttcaggcttttgtctgtgatgcattggcagtaccagtccgcagtgggtcttgtgatgcctgcatctccattgctgttattcatcattttgcaacagcagagcgtagagtggcagctctccaagaaattgttcgactcctgagaccaggtgggaaggcactcatttatgtctgggcaatggaacaagaatataataagcagaagtccaagtatcttagaggaaacagaaatagccaaggaaagaaagaggagatgaacagtgatacctcagtgcagaggtcacttgtggagcaaatgcgtgacatgggcagtcgagactcggcatcttctgtcccccgcattaatgactctcaggaaggaggatgtaattcaaggcaagtttctaattccaagctgcctgttcatgttaacaggacttctttttattctcaagatgtactggttccctggcaccttaagggaaatcctgataaaggcaaacctgttgagccatttggtcccataggatcccaggacccaagtcctgtgtttcatcgttactaccatgtgttccgtgagggagaactggaaggtgcctgcaggactgtgagtgatgtcagaattctgcaaagctactacgatcaaggaaactggtgtgtgattcttcaaaaggcctgattatttacctgaacacatcatatataaagaagaaatgctcacttaaaaaaaaagagagaataaattaattacccttttaattaaagagaaaacttgtgggaaagtaccaaaggaaagctgagaaaaatttggaagtagggattcattaggagacattcaaatgtctcctgttggctgacatcacagatgtggtgttggctcctcctacttccctaggagaggtggtatagggtggtatagggtgtataggtaatagggccggctcgtcg

SEQ ID NO: 77026 - DNA, 2881 bp, Homo sapiens
gtgatagccagaggaaagagactcccccctcatttccagagagtgataaagaagcctcacggctggagcaagagtacgtccatcaggtttatgaagagattgctgggcacttcagcagcacaagacataccccttggccgcacattgtggagtttttgaaggctttgccaagtggttcaatagtggctgatattggatgtggtaatggaaagtatcttggcatcaataaggagttatatatgattggttgtgatcgtagccaaaaccttgtggacatttgtagagagaggcaatttcaggcttttgtctgtgatgcattggcagtaccagtccgcagtgggtcttgtgatgcctgcatctccattgctgttattcatcattttgcaacagcagagcgtagagtggcagctctccaagaaattgttcgactcctgagaccaggtgggaaggcactcatttatgtctgggcaatggaacaagaatataataagcagaagtccaagtatcttagaggaaacagaaatagccaaggaaagaaagaggagatgaacagtgatacctcagtgcagaggtcacttgtggagcaaatgcgtgacatgggcagtcgagactcggcatcttctgtcccccgcattaatgactctcaggaaggaggatgtaattcaaggcaagtttctaattccaagctgcctgttcatgttaacaggacttctttttattctcaagatgtactggttccctggcaccttaagggaaatcctgataaaggcaaacctgttgagccatttggtcccataggatcccaggacccaagtcctgtgtttcatcgttactaccatgtgttccgtgagggagaactggaaggtgcctgcaggactgtgagtgatgtcagaattctgcaaagctactacgatcaaggaaactggtgtgtgattcttcaaaaggcctgattatttacctgaacacatcatatataaagaagaaatgctcacttaaaaaaaaagagagaataaattaattacccttttaattaaagagaaaacttgtgggaaagtaccaaaggaaagctgagaaaaatttggaagtagggattcattaggagacattcaaatgtctcctgttggctgacatcacagatgtggtgttggctcctcctacttccctaggagaggtggtttctaaaagtgattgaagcagtttgtgcagtgtttgtaattcttgggtaagagcccaggattttgaagataatagttttttagtaaagtgctactaaatgtagtaaatcatgtaggattttagggatgtaattatatgttaatacagaaaatagtcctggtcaatagaaaattgtctgaagttttacctatgatttttagctctgtaaaatcatagacaataaccattctatttccatgcctgactagcccagggctggacgtatagcgggtgtccaataacgtttagtcaatcagataatacccagaacttagtaggagtttcattcaaaaactattttttgaacccaaccatgtaccagttactattttaagtactgataatgaagcagtgaataagaaagagcaaagctcttgcccttatggtgcttacattctagacggggagacagacagcaggcaaatcaataaatagatactatgtgccagatagtgataaatgccatgaaaaacataaaatgagagacgattcaccttggagcaaaagattacttttaagtgactgaaataactactaatcctgactaatttattatcaagagttaattggtattccaaattcattgagcagggtgctaaaaacaacccaaatgtgctcctttaactcctttgtttaaatgacaaaagttagaatgtggtcactcagacctaactgtgcccttagagccaaagctgtggtgtcattattggttatttctagttgattcatagtttgtcccaatccaggttcaatcgggttatttttaagatctgtacaatattgcataatagtaacccagttaacttaccacttaggttagatttcctggaggaacaaaggtagaaattcaaccataggtcaaattatcacatagaaggaaaaggctttttttcaaagaaaaaattttttgaacactttactcccagtatgcattacttttgtagtagtaatgcttaagactgttttaaagaaaaattgctttctgtttaattaatgtttactgttattaatgctagtgatacttaatcttgaagcatcaagttttcagaaacctatagtgatcaataatgggtctcagatgagaggatgattatttttttcatggaatttcagtccaacatcctggtgtactggtccctctgggatgaatttataaggctcatgatataggaaaaggaatatagggctaaaaatagttttatttctgatataaattctggtacttgacaccaaagtttgaagtcaagtcatgccaataaattttaacatccaaatgaaatagatgattttctatgaagatgaaaaataccaaaattgactcaagaagggagagaaaatggaagatgttgaaaaatagcataggaattcagaactgggctctagaatcagatttcctgagagttgaattctagatctgccatttattagctgtgggattttgggcaaatttcttgactttctgtgcttcagttttcttagctgtaaaattggaagagttgttatgaaaattcactgaaagtatatttgtatacatcataggatagtgtaagaatatagtatggctttgagaaatgttcattattattactcccagaggagttttaggtattaagtgatgccaaatataatttgttaattgtataataaaaatctatattcttactga

SEQ ID NO: 77027 - DNA, 2545 bp, Homo sapiens
tgataagtcacgcagaggacgatcggtatcgacccgcccgcgcactagcacgtatagagcgtagagtggcagctctccaagaaattgttcgactcctgagaccaggtgggaaggcactcatttatgtctgggcaatggaacaagaatataataagcagaagtccaagtatcttagaggaaacagaaatagccaaggaaagaaagaggagatgaacagtgatacctcagtgcagaggtcacttgtggagcaaatgcgtgacatgggcagtcgagactcggcatcttctgtcccccgcattaatgactctcaggaaggaggatgtaattcaaggcaagtttctaattccaagctgcctgttcatgttaacaggacttctttttattctcaagatgtactggttccctggcaccttaagggaaatcctgataaaggcaaacctgttgagccatttggtcccataggatcccaggacccaagtcctgtgtttcatcgttactaccatgtgttccgtgagggagaactggaaggtgcctgcaggactgtgagtgatgtcagaattctgcaaagctactacgatcaaggaaactggtgtgtgattcttcaaaaggcctgattatttacctgaacacatcatatataaagaagaaatgctcacttaaaaaaaaagagagaataaattaattacccttttaattaaagagaaaacttgtgggaaagtaccaaaggaaagctgagaaaaatttggaagtagggattcattaggagacattcaaatgtctcctgttggctgacatcacagatgtggtgttggctcctcctacttccctaggagaggtggtttctaaaagtgattgaagcagtttgtgcagtgtttgtaattcttgggtaagagcccaggattttgaagataatagttttttagtaaagtgctactaaatgtagtaaatcatgtaggattttagggatgtaattatatgttaatacagaaaatagtcctggtcaatagaaaattgtctgaagttttacctatgatttttagctctgtaaaatcatagacaataaccattctatttccatgcctgactagcccagggctggacgtatagcgggtgtccaataacgtttagtcaatcagataatacccagaacttagtaggagtttcattcaaaaactattttttgaacccaaccatgtaccagttactattttaagtactgataatgaagcagtgaataagaaagagcaaagctcttgcccttatggtgcttacattctagacggggagacagacagcaggcaaatcaataaatagatactatgtgccagatagtgataaatgccatgaaaaacataaaatgagagacgattcaccttggagcaaaagattacttttaagtgactgaaataactactaatcctgactaatttattatcaagagttaattggtattccaaattcattgagcagggtgctaaaaacaacccaaatgtgctcctttaactcctttgtttaaatgacaaaagttagaatgtggtcactcagacctaactgtgcccttagagccaaagctgtggtgtcattattggttatttctagttgattcatagtttgtcccaatccaggttcaatcgggttatttttaagatctgtacaatattgcataatagtaacccagttaacttaccacttaggttagatttcctggaggaacaaaggtagaaattcaaccataggtcaaattatcacatagaaggaaaaggctttttttcaaagaaaaaattttttgaacactttactcccagtatgcattacttttgtagtagtaatgcttaagactgttttaaagaaaaattgctttctgtttaattaatgtttactgttattaatgctagtgatacttaatcttgaagcatcaagttttcagaaacctatagtgatcaataatgggtctcagatgagaggatgattatttttttcatggaatttcagtccaacatcctggtgtactggtccctctgggatgaatttataaggctcatgatataggaaaaggaatatagggctaaaaatagttttatttctgatataaattctggtacttgacaccaaagtttgaagtcaagtcatgccaataaattttaacatccaaatgaaatagatgattttctatgaagatgaaaaataccaaaattgactcaagaagggagagaaaatggaagatgttgaaaaatagcataggaattcagaactgggctctagaatcagatttcctgagagttgaattctagatctgccatttattagctgtgggattttgggcaaatttcttgactttctgtgcttcagttttcttagctgtaaaattggaagagttgttatgaaaattcactgaaagtatatttgtatacatcataggatagtgtaagaatatagtatggctttgagaaatgttcattattattactcccagaggagttttaggtattaagtgatgccaaatataatttgttaattgtataataaaaatctatattcttactga

SEQ ID NO: 77028 - DNA, 218 bp, Homo sapiens
tttttttctaatggaggggaggcatttttgtttttcagaaagtatagctatttatgggcctaatgttgtttaaaggaaataaagcctagaatgaaagatttatgtgtggtttggtatttccttaggaatgatatctgaaaccaaaggcctttttttttttaaaactgggaaacaattagtcttcttatgtagcagtagaattactatctttatagacg

SEQ ID NO: 77029 - DNA, 106 bp, Homo sapiens
ttcaaaggtgtatggaaatatgctttcactactcttggggaaataccttctagtgggatgttggtaggtacgtatttaataagctcttggtttgattgccaaaatg

SEQ ID NO: 77030 - DNA, 610 bp, Homo sapiens
tattattttaatccaagatacagctgaacaccatatcttagatctaaactctcatacaataagccttaaaatgtaactaatataaatctgggagttcatatgaccctgccttggtgggagtgacatattcaaaaaaccaacaatttgacaaaaaatataacctaaaaacaattcaagttgtatttggactgtgaacaccaatacggtattagtgttaatacatacatgcttgttaccttattacaatagcataaaatatcacaaagtagaaagagttctgggtagacaggagtcctgctgagtagctctgtgccctgggtgggggttatgaggaagggttcccaggtctgcttcctccaccctgaggtcaccattaaagttggaagatgacttaaaaatcagacagcatcaatccccttcaatagttttctatggtgtatgtgttcattaaattctgggtcattgaacggtcatggataaccttaatctctcttagcctcagtgtctactaacatagttcatattctgttaaagttatgagcattcgtattctaagatttgtattgaatatagatgatagattaaaattttagtgacaaatcttaaaaaa

SEQ ID NO: 77031 - DNA, 278 bp, Homo sapiens
ggtagcaaataactgctaggagggctgtgatgtctctcgatcagaatggatttgtcatgcttcatagaggaggttgggcttcatttagttattactggattctgataaactgagcagaggacacagtggcggaagcaagttgaatctcatctaaaagtaacatctgcttgattggaggtttttgtgaagtagtggaagcgtgatcttgactgtgttgtgcattgaaagctagactgaattgatagcacatgcagtaggtagctgacagtagtaagcta

SEQ ID NO: 77032 - DNA, 261 bp, Homo sapiens
tgctatgtattttaattccacatatatttgcaatccattaagacattataattattgtctcatataatcaattgtatttttgcttatccatatatttaacttttccattgcttttcatgccttcttacattttcatatttccacatggaattatttttcttctgcctggcccacatctgtgtttcttttaatgtagatctgctggtgacaccatctctgtttttatttgtatggaaatatctacttcaagtttaattttta

SEQ ID NO: 77033 - DNA, 535 bp, Homo sapiens
gttctggtgagatgcctattcattatgagaggacaagaacaagatggcattggtagaatcatgattttcatttttcctcatcaccatctctgtctcccagcccttgtacctctcagttttgaaactaagtcagctgtcttaggtgaaaaaattaattatcccaatgtaaatctccaaatgtgagggcttatctagtccctatgaagagaaatgccccaaaaaaagtggaaaactgtaaggggaaattataagaaaagagttatgactgcaataagaaaaaactaagaaaggaaaaagaaccatcagtaaagtttaattgtaagagttgacaccagtggatggaattcatctacaaagaagcaggcaactacacaacttttttttggtaccacgtcaacctctgcttcagtattggcaggacagaataatcccataactgctctggttcaacaagggagaaactaaagggggaaccaaagagatggaaaatttcaaaccaccatcccagaatctcttggaactcaaggtaattctg

SEQ ID NO: 77034 - DNA, 521 bp, Homo sapiens
tcagtccccaggcctccccaggcctcagtttccccatgtattagataggccatttggggacttgaagctctcagatacaggaacagcagtttggaggagctgagcaggtctggggtgtgactgacattcccaggtacctgaaggaggaactgcacatctccaggtgggacctgcagtccttcctggaaacttccatggctccccacacatgcaagttcaaagcctctctcctgaacctaggttcagagccccttctgcagtggtagttccaacctccctcccatgtccccactcacagctaagcttcgggcctggagcacctccaacctgctgatcagggcaagtcccaatgtggccttcaaggcatttgcacatgttcattgtgacactgttcgctgagcagtcactgtgtgctaggcgtatctgcagcatctggacagacgacactaaatgggtattgaaggattgaatgagggatcaataatgatatccagtttgattcagtggttccagaggttttt

SEQ ID NO: 77035 - DNA, 553 bp, Homo sapiens
ccttctccatgtccttcaatatgggacgtcccccaacagcactcaagtccaagatggagggagaattctccagaaccttcagaaagactaatccaggagagttcaggggcaccacccccagaagcaaattcactgcaaggtgccttatatttatgttctgaagaagaagctggaagcaagggtgtacttactggggctgtctgaatggaagcattcctccgtgttcatttaaaagaacgcttaatagtaacatctggactctaatgccagctagcttgtacctcatcagtgcttagagcctaacaactttggagcgatgtatgaactaatgctttaggaaacccactctagtgttctcttgtttggccctagactcaggcttaatttgtaagtggaatagaatctcccagcaagtatgacagaactgaaaagaaggagagcaacagctggctcggtccctgctctgagtatgtgtatatatgtgtttgtctctatgtgtgtgtatatacataaatatccattaaaatgtattagtagaaactagtttctcttt

SEQ ID NO: 77036 - DNA, 243 bp, Homo sapiens
actttcactgggagtgacatagagaatgataccaaggagagtcaggagacccacactcctgctccatctaggataagcttcatgtgggaacacctttttctgccagcccagctatctgcctccatcacaaactgactcagtaagactatgttatttaatcctgtgaattggtcagtaccattaacccacactacatgcatggattatgaagttagggaaatgaaaaaaaatttccacagtcta

SEQ ID NO: 77037 - DNA, 376 bp, Homo sapiens
aggctacagggtttattttattttatttttaagtcaataggcctgagtgttggtaaagactagatacccagcagtccttcttgcatttcttcttggggtgggggggcagaagggaatggagaggaaatgaaggcggattgctggtaagtgaggcaggaaggcagggagtttattatggaatgtcatcggtaagtttccccatgatttgatcccaagctggtgtggagtgaagggtaagctgttggctcaacagatagtgagaatcaaacttagtggagttgtagagcctgtttcctgcagcggacagcaagatgtacaagccgtccactgcaggaatgacgtgctgtaaaagggatgcagtgtcaagtgtagtcat

SEQ ID NO: 77038 - DNA, 408 bp, Homo sapiens
gagcggggtctacggttagctttaggtagctgggagcgggacaccaacgggctgcgaaggaagcagggacgttcagacagcctggggttcgcgttcccttccagctcagcggtctttggagctcctccttcccggagttctgatttctaaagggctatccagagttctggctcaggcttgaatgctgaagattgctcccggagtttctctccaggaaaaagttcgcggggacctcgggctgcagatgtttctcccaatccctctttagtctaccctcatgtagggccgagacctacagagcccttccctttccattttgttaggtcaccgccggcttctataataaagctgctttataactgaggactgtgcttggggttagcatgctatttttattttggatgttgc

SEQ ID NO: 77039 - DNA, 430 bp, Homo sapiens
  misc_feature (423)..(423): n is a, c, g, or t
atgtaattagttaagataaggtcatactggagtaggatgaacccctaagtccagcatgactggtgtccttacaaaagaggaaatttggacataagcacacagggagaacacccccatgtgaatataaaggcagagataggtgtggtgcttctacaagccaaagaacaccagatattgtcagcaaaccccaaaaagctaggggagaggcatggagcagattcttcacagcctcagaaggaaccagccttgctgataccttcatctctcctagcctctggaactatgagacaatgtctgttatataagccactcagtttgtggtagttgtttttctggtttgtttgtttttctgagacagagtctctctctgtcagccagccaagaatctgccactgcactccagccggggcgacagagcaaaanccgtctc

SEQ ID NO: 77040 - DNA, 384 bp, Homo sapiens
gccacagcacaaagaccacccgggatgcactaccgccactgagaacctcaaaaagacccggacgggtctgacgcctgcacacttggctccaggatagaacaccctcacagcaccgccaccctccaagcttccgttatctggaaggaaaatcaggacgaatgggctctgcaggcctgcctgccatagtaccaggctctctggaatgggggaagacacacaaaatcccccaaaacaccctcacccccgaagaacttcacgttctgttcagcaaaaaagacttgcccacacaactagaacttcaggacttaaagggaccagaaagatcatctagtccaaggctcagtccaaagtggaggtgagcagctcgccctaccatggtgccca

SEQ ID NO: 77041 - DNA, 352 bp, Homo sapiens
tgtgggagaatcacctgcaacagattatgactctacagcattttcctgaagaaagtataggaaaaaagttttaaatactgaacattgatttgctttataagtagacaccatctacaaattttgcttgtctttttaaacatacatatatatttaatatatttttatgtttttcactaaggctttattttctgaggccctttaattagtttcactaatcagagtaatttccagaagtgtaatcttggagagattactgtaataaatattaaatattgtggtggttaaaagtatgggatttacgctgggtgtggtggctcacgccggtaatcccagcactttgggaggctgagat

SEQ ID NO: 77042 - DNA, 447 bp, Homo sapiens
agaagaaaaacaaattttcctttgtttcatggtatgagtttatagattcctgctctctacacctagtgacttcaaatattctgttttatcagcagtggagtgaaggtcataaactgtctgagcagcctgagatagagccacctgggtgccatagtgatggccatggaataagccatgctaagcactagggcaaacctacataatggccatctgagttgcacagcaacggtcatgtctaatcctgagttatgagcctgttataatttgattaactgtctttgtcctgcctctgtatccctgctttcacgccactgtaagcctgcttcaagctaacccacccctttttaaaagtgtgtttaagtcaagtgctgtctttattctaggcccagtttttagacgttgagtccagtgggtctgagtgcactcaataaagatcctcctgtatac

SEQ ID NO: 77043 - DNA, 2941 bp, Homo sapiens
  misc_feature (2)..(3): n is a, c, g, or t
  misc_feature (222)..(222): n is a, c, g, or t
  misc_feature (565)..(565): n is a, c, g, or t
  misc_feature (567)..(567): n is a, c, g, or t
  misc_feature (581)..(581): n is a, c, g, or t
  misc_feature (759)..(759): n is a, c, g, or t
  misc_feature (969)..(969): n is a, c, g, or t
  misc_feature (1359)..(1359): n is a, c, g, or t
  misc_feature (1485)..(1485): n is a, c, g, or t
  misc_feature (1562)..(1562): n is a, c, g, or t
  misc_feature (1729)..(1729): n is a, c, g, or t
  misc_feature (1915)..(1915): n is a, c, g, or t
  misc_feature (1933)..(1933): n is a, c, g, or t
  misc_feature (1970)..(1970): n is a, c, g, or t
  misc_feature (2322)..(2322): n is a, c, g, or t
  misc_feature (2415)..(2415): n is a, c, g, or t
  misc_feature (2525)..(2525): n is a, c, g, or t
gnnatccagtgttgataatcagacattgaagtctccagctattattgtaaaactgtttcatgtttgaattctgtcagtttttgcttgagatattttgatggtatgttactaggtgagtaaatgtttatattttttacatcttcttgctgtattgaagtttttcatcaatatttaatgtctttctttttctcttacaacctttttttttaaatttaaagtctnttttgtctgatattagtatagccactcctgctttctttgtaattatttgcatggtatatcttttttcatccttccattttcaaactatttgtgtctttgggtcaagtgagtcttttatagatggcatatacttggatcatgtttttcttttcttatccatcctgccaatctttctttttgattggagagtttaattcatttacatttaaatatttattaataatgaataacttacttttgtcatttgctatttgttttctctatgccttatagcttccatgcctcttatttttgacataactgcacttttttgtgtttagttctttttacgtagtacattgtntntatacctttctcantttcttttgtaattctatattttttttgttacaatgggaattatcttaaagttacaacactgtaatctaatttataccagtttaacttcaataacacacaaaaactctgcttctttactacctctgtctccatctttttcagttattgatatctctaaatttcatctatatatattanatgacccaaaacataaactattaaatcctttaattgtatttgtatcttaaattatgtagaaagactcaatttgaagctttgaaccaaagttgcaataatactagcttttagacagctcatagtgtccccagattctacaggaccaattttcttaaatttttttctttctgtacttcagaatcagtaattctcattgtcctatcttcaagntcatgggttcttttgcctactcaattccacctttgaatccccatagtaaatttgtaatttcagttattgtaattttcggctccagaattttttggtttcttttgagttttctatatcttcattgatatttcaattttgttcatacattgttttcttgaatatattaacatcttcctttagttctttgaccatttttaaaatagctattttaaaggctttttctaatagatatgccaacaggtcttctacagacacagtctctgttgttctttttttccctttgaattggccatactttcctctatttctttgtatgccttctggctttcggttaagaactagacatttgaatctaattatgttgtaatttggaaataagattttccctgnttcacaactttttctgtttttttgttattgattttattgcttttgatattataaaatattgtagtaccaaaaatcagccagtctctttgctaaagcctagcaaggatcacctttgcttcagttccngataagctcctcatcttcatctgagaccacctcagcctgggcttcattgtactggacttcattttggtacacagacnttgtccatatcactatcagcattttggtcaaaacaaacaagtttctaggatgctccaaactttctcacatctgtttttcttctgagccctcgaaactgttcctactctgcctgttacccagatccaaagtcactcccacatttttgggtatcttaatatcagcaccncactctaccagtgccaatttactgtattagtctgttctcatgctgctataaagtactgcctgagatggagtaatttataaaggaaagaagtttaattgattcacagtttcatatggctgaggaggcctcaggaaacttacaatcatggcaaaaggggaagcaagcacatccttattcacatgatgncaggaaggagaagtgccnagcaaaagaggggaaagccccttataaaaccataagntcttgtgagaactcactatcaagagaaccgcagcatggagttaactgtccccatgatttaattacctcccactaggtccctcccacgacacatagggggattatagaaacttcaattcaaaatgagatttgggtgggtcacagccaaaccatatggcatatctgcttggagtaagcctgttatttagagagcattgaaaactagccagaaaggtttacttttaacttagttggctgtaagaaattattgaaatttttttcccgtaagaaaataatacgattgaaataaaagtgaaattcagaaatcaaatacagttatgaggtatatgcaatatgcaaactcaaattaaaantagtctagagatgttcaactttaaaccattgttttggcacattctatatatttaaacttaaagttaatacctcaaggtgggctattaattaanaaacagtatatatttattcaagtttgtgtatatattagaatctacagaaactatgtatgttataaaatgaagatgaaaacattctaaaatagaaagaaaaataaaaatgnccatatcctttgccccataaattctacttctatacttttaaccttaaaaataattcagaaaaaagataaacgcatgaagacatttatgtctgcattctttataataacaaaaattggggaaaaaaactccatgtcaagaaagtgggataagaaaaatagtgaagtattatactgccattagaataattatttggaagtctgtagaaacgtggacatgtttgatatggtaagtaaaatgagcacaatacgaaatagtatgcatactatgattgtgactttgtaaaatctttatgcatgtggaaggtaatctgcaaaacaaattcattgtgttagtgtagcgggatatggaatggctttatttatttaaatcttttctttaatattactttgtattttcaataaaaataaatcactgc

SEQ ID NO: 77044 - DNA, 332 bp, Homo sapiens
ctaaaaacacctagtaactgaatggcttttctttggagggtaatacattttaaaacatttagtgtgccacctactgctccacagtgactagagagcctctatttcttggtgacttgggactagatcagatgccaaatgtacaaagtttcttaagagttgagattatatcatctgaagtcatcttattttagccaaatctttttaatttcaccggcaaatctgtgaaggaaaacacttgatgttcaaaaagaatagtacattttaaaagctgcgattttaaacagttgttaatgttaaaaaaaaaaagcactagaggtatttttaaacataga

SEQ ID NO: 77045 - DNA, 2755 bp, Homo sapiens
  misc_feature (1)..(1): n is a, c, g, or t
  misc_feature (3)..(3): n is a, c, g, or t
  misc_feature (5)..(7): n is a, c, g, or t
  misc_feature (942)..(943): n is a, c, g, or t
  misc_feature (982)..(983): n is a, c, g, or t
  misc_feature (1311)..(1311): n is a, c, g, or t
  misc_feature (2256)..(2257): n is a, c, g, or t
  misc_feature (2749)..(2750): n is a, c, g, or t
  misc_feature (2754)..(2755): n is a, c, g, or t
nantnnngaagctttgttctttagctctttgcaataaatcttgctgctgctcactctttgggtccacactgcctttacgagctgtaacactcaccgcgaaggtctgcagcttcactcctgaagccagtgagaccacgaacccaccaggaggaacaaacaactccagatgtgctgccttaagagctgtaacactcaccgcgaaggtctgcagcttcagtcctaagccagcaagaccacgaacccaccagaaggaagaaactctgaacacatccaaacatcagaaggaacaaactctggacatgccgcctttaagaactgtgacactcaccacgagggtccgtggcttcattcttgaagtcagtgagaccaagaacccaccaattccagacacattttggcaaccacaaagggactatcacctattgccaagcggtgagactatcgccaagtggtgagaccatcgtctatcgctgagcagcaaaacaatcgcctatcgccaagcaaatcgaagccatcaagctacagatggtcttacaaatggaaccccaaatgagttcaactaacaacttctaccgaggacccctggaccgacccgctggcacttccactggcctagagagttcccccttgagacactacaactgcagggccccttcttcacttctatccagcaggaagtagctagagcagtcatcggccaaattcccaacagcagttggggtgtcctgtttagaggggggattgagaggtggcagtgtgctggcagccctcgcagccctcgctcactcttggctcctcctcggccttggcgcccactctggccatgcttaaggagcccttcagcctgccactgcactgtgggaacactggccaaggccagagccagctcactcagcttgtggggaagtgtggagggagaggcgcaggcgggaactggggctnnatgcggcgcttgcgggccagcgtgagttccggtggttgnnggcttggcgggccccagactcggagcggctggcctgccctgctggccccaggcagtgaggggcttagcacccaggccagcagctgtggatggtgcgctgagtctcccagcagtgctggcccaccccaccagcactgcactcgatttctcgccaggccttagctgcctccccgcaggcaggccttgggacctgcagcccaccatgcctgagtctcccctgctgccgccgtgggctcctgcgtggcccaagcctccccgacgagcactgccccctgctccccggtgcctggtcccatcgaccccaagggctgaggagtgcaggtgcatgntgcgggactggcaggcagctccacctgcggccccatgcaggaagccagctgggctcctgagtctggtggggacttggagaatttttatgtctagctaagggattgtaaatacaccaatcagcactctgtatctagctcaaggattgtaaatacaccaatcagcaccctgtgtctagctcagggtttgtcaatgcaccaatcggcactctgtatctagttaatctggtggggagttggagaatctttatgtctagctaagggattgtaaatacaccaatcagcactctgtatctagctcaaggtttgtaaacacaccaatcagaaccctgtgtctagctcagggtttgtgaatgcaccaatcagcactctgtatctagttaatctggtggggacttggagaatctttatgtctagctaagggattgtgaatgcaccaatcggcactctgtatctagctcaaggttgtaaatggaccaatcagcactctatgtctagctcagtgtttgtaaatacaccaatcgacactctatctagctaatctagtggggacgtggagaacttttgtgtctaactcagggattgtaaatgcaccaatcagaaccctgtcaaaatggaccaatagctctctgtaaaacagactgactttctgtaaaatggaccaatcagcaggatgtgggtggggccagataagagaagaaaagcaggctgcctgagccagcagtggcaacccgcttgggtccccttccacactgtggaagctttgttctttcgctctttgcaataaatcttgctgctgctcactctttgggtccacactgcctttatgagctgtaacactcaccgcgaaggtctgcagcttcatctgaagcagcgagacacgaacccaccaggaggaacaaacaactccgatgcgctgccttaagagctgtaacaccgcgaggtctnnagcttcactcctgagccagcaagaccacaaacccaccagaaggaagaaactcaggaaaacagccgaacatcagaaggaataaactctggacacaccacctttaagaactgtgacactcgctgcgagcgtctgtggcttcattcttgaagtcagtgagaccaagaacccaccaattctggacacaattgcactctagcctgggcaacaagagtgaaactcatctcgaaaaaaaaaagagtctggaagggccttctgagttgtaatattatgaacttaaattttgaggtcctgaagttttgttgcagtgtgaatgataagagtagtctttttttgatatcatctgtagaagacccaattttggggtttcagattaggaagggtttgatggtttttagtggactatgaaaaggttttttttggtgaaaatatattttggtataatgtactaaagtcttgtagtatttagtcataatagagtttaacagtggaagnnaatnn

SEQ ID NO: 77046 - DNA, 266 bp, Homo sapiens
taatggccacattggaataatttgagcaacaaaataaataatgatagtattggattataacccaaagaataaaatactcatgtctgtactaaagtaaataaacaaatgggagagaagaaacaaatattaacaaaatgattccaaataataaatgttgaagcagtgaaggaaatagaaagtcaccattagaacaccacagttgtaatcgtctcaggtgaatgctaaaattagtagatgaaacttgaaggagaaatagacatttgtat

SEQ ID NO: 77047 - DNA, 536 bp, Homo sapiens
acgggttatcaagccctggctctctattttctcagaaaaaaagcagcccttctgcccctaaaaaaagtctacaaagtcaatcgtgagaccagaccttgacctgttccgtttggcgctctggattgcggagcataccgaggagtcctggatggcagagcagatgcaacggcacccctgagctgccctcagggggtcctcagccttggaggaggcaggagacctgggctatggagccactcacaggccctactgagaacaacttggtgtccatcacagtcctcttcagaatgcccagaatatggggataagaaggtgaaaccggcatgtttattaacacaatggaatattctgtggccaaatcaaaggaagacgttgaggattctggtgacacctggaaacgtactgctaagggaaaaaagcaggaccacaatgttatgtggatattgactgcgactatatataatgccagcgtggacttctcagagatggaatttggaggaatgtaatacagatgcaaatagagttttccccacgtt

SEQ ID NO: 77048 - DNA, 451 bp, Homo sapiens
ctcctcttcctccacctctgccacagggctccagcttccctctgggggcaccactgttcttagatggcagagcagatgcaacggcacccctgagctgccctcagggggtcctcagccttggaggaggcaggagacctgggctatggagccactcacaggccctactgagaacaacttggtgtccatcacagtcctcttcagaatgcccagaatatggggataagaaggtgaaaccggcatgtttattaacacaatggaatattctgtggccaaatcaaaggaagacgttgaggattctggtgacacctggaaacgtactgctaagggaaaaaagcaggaccacaatgttatgtggatattgactgcgactatatataatgccagcgtggacttctcagagatggaatttggaggaatgtaatacagatgcaaatagagttttccccacgtt

SEQ ID NO: 77049 - DNA, 410 bp, Homo sapiens
tgaggctctttttaaaaattcttcataatgagttgcttgtgtggaaactcacattcgcatactttacccttccttgcgctgtattttcctccattccttattggaaacatgcaaagagctaaatggaaaacaaaccctgctccggggcgcattgtccccttaaacttggtcagtgggcatgtgaaagctcagacggtcatcttcctcatcatgttagctcctcctcagacacatacaggggacggatcaggcaaacatcatttggaacaatgtcagtctagagcgctcgacacttacaggattggtcaaggaaggaacggttgatgtctgggaatttgaaaacctgtgttgagcagacctgtagcctgggatagctctcgcctgtgcaggttggccccaggccgccttct

SEQ ID NO: 77050 - DNA, 2180 bp, Homo sapiens
aagtcacgaaggagaactacccgatggcgaagtacctttcctgtcacctaaggaagaacccttgaagaagaggaagaggaaagaaagacaagtcaggcatggctctcacccagctctctcttccgaatttgtaatgaaagatttactacacaaagggaagagtaatacaggagaagtattccaaacagtgatgttggaaagacaggaaagccaagacattgaaggatgttccttcagggaagtccagaaaaatacacatggccttgagtatcaatgcagagatgctgaaggaaattacaaaggagtgcttttgacccaagaaggcaatctcactcatggaagagatgaacatgataaaagagatgcaagaaacaagcttattaaaaatcagcttggattaagccttcagtcacatctgcctgaactgcagctttttcaatatgaagggaaaatttatgaatgtaatcaggttgagaagtctttcaacaataattcctcagtttcaccacctcaacaaatgccttataatgtcaaaacccacatttctaagaaatatctcaaagattttatctcttctttattactcacacaggggcaaaaagcaaataattggggaagcccttacaaatctgatggatgtggcatggtctttcctcaaaattcacaccttgcaagtcatcagagaagtcatactaaagagaaaccttacaaatgttatgagtgtggcaaagcctttagaacacgttcaaacctaactacccatcaggtgatccatactggcgaaaaacgttacaaatgtaatgagtgtggtaaggtctttagtcgaaattcacaactctcacaacatcagaaaattcacactggagagaaaccttataaatgtaacgaatgtggcaaggtcttcactcagaattcacaccttgtaagacatcgaggaattcatactggagagaaaccttacaagtgtaatgagtgtgggaaacctttagtatctgttcaagcctaactacccatcagacaatccatactggtgggaaaccttacaaatgtaacgtgtggaaagttctaaagtcagagttcaaaccttgcaagccatcacagaattcatagtggagagaaaccttacaaatgaaggtggtaacttttgcagttagaattcattcctttgacaacgtcagagaatttatgcctgagagattccttgaaaatgcaatgactggctgggtgcagtggctcatgcctgtaatcccaacactttgggagtccgaggcaggtggatcacctgaggtcaggagttcaagaccagcctgaccaacatggcgaaaccccatttctactaaaagtacacaattagctaggcctggtggcgtgcgcctgtaatcccagctatataggaggctgaggcaggagaatcacttgaacccaggaggcggaggttgcagtgagccaagatcgtgccaatgcactccatcctgggcaaaaagagcaaaactccatcttaaaggaaaaaaaaaaaatgcaatgactgtggcaaactcctcatgagttcaagtattaatagacatccaagagtccataataatgagaaatcacataaatgtactgtgtgtgacagaggctttattcaggcctcacagctttgcaggcattaaaatctacgtatttgatggaaccacacaaatgtaatgtgtaagagcatcctgaagctcttactctaagactgtaactgtaggtgaggattcatacaaagagtgactcagtctctagttctttgattcacttttaaaatgataaactgcacaataattacacgttccaatatggtaaaacttaagacattatatatttcaaaggtcaaaggacatttggaaatggctacttaccttcaggttataaaatcttttattccattgtttgaggtttctcaaaaaggctactgtttgtgactttcaacctgaactatggatctgtggctattttgcatccttaagcacctttcgtggtgcctatctgggaaagaaccacagtatggaaaggcttacttcattacatgaggatcatttttatccatgtttattgaagaaggaggactctgccttgtaaaattaaatattctctcaattgagagaccatggttttggggcagaaaataatgtaaaactatgatatcaatcatcata

SEQ ID NO: 77051 - DNA, 3664 bp, Homo sapiens
  misc_feature (19)..(19): n is a, c, g, or t
  misc_feature (335)..(335): n is a, c, g, or t
ggcacgagggcgggtgacnccgccgagcgaagaacccttgaagaagaggaagaggaaagaaagacaagtcaggcatggctctcacccagggacaggtgacattcagggatgtggctatagaattctctcaggaggagtggacatgcctggaccccgctcagaggactttgtacagggacgtgatgttggagaattataggaacctggcctccctgggaatctcttgttttgacctcagtattatctctatgttggagcaagggaaggagcctttcactttggagagccaagtacaaatagcaggaaacccagatggatgggaatggatcaaagcngtgatcacagctctctcttccgaatttgtaatgaaagatttactacacaaagggaagagtaatacaggagaagtattccaaacagtgatgttggaaagacaggaaagccaagacattgaaggatgttccttcagggaagtccagaaaaatacacatggccttgagtatcaatgcagagatgctgaaggaaattacaaaggagtgcttttgacccaagaaggcaatctcactcatggaagagatgaacatgataaaagagatgcaagaaacaagcttattaaaaatcagcttggattaagccttcagtcacatctgcctgaactgcagctttttcaatatgaagggaaaatttatgaatgtaatcaggttgagaagtctttcaacaataattcctcagtttcaccacctcaacaaatgccttataatgtcaaaacccacatttctaagaaatatctcaaagattttatctcttctttattactcacacaggggcaaaaagcaaataattggggaagcccttacaaatctgatggatgtggcatggtctttcctcaaaattcacaccttgcaagtcatcagagaagtcatactaaagagaaaccttacaaatgttatgagtgtggcaaagcctttagaacacgttcaaacctaactacccatcaggtgatccatactggcgaaaaacgttacaaatgtaatgagtgtggtaaggtctttagtcgaaattcacaactctcacaacatcagaaaattcacactggagagaaaccttataaatgtaacgaatgtggcaaggtcttcactcagaattcacaccttgtaagacatcgaggaattcatactggagagaaaccttacaagtgtaatgagtgtgggaaagcctttagagctcgttcaagcttagctatccatcaggcaacccacagtggagaaaaaccttacaaatgtaatgaatgtggcaaggtcttcactcaaaattcacaccttacaaatcactggagaattcacactggagagaaaccttacaagtgtaatgagtgcggcaaagcctttggtgttcgttcaagcctagctattcatctggtaattcacaccggagaaaagccttacaaatgtcatgaatgcggcaaggtctttaggcgtaattcacaccttgcaaggcatcagctaattcatactggagagaaaccttataagtgtaatgagtgtggcaaagcctttagagcacattcaaacctaactacccatcaggtcatccatactggagaaaagccttacaaatgtaatgaatgtggcaaggtcttcactcaaaattcacaccttgcaaatcatcaaagaattcatactggagtgaagccttatatgtgtaatgagtgcggcaaagccttcagtgtgtattcaagcctaactacccatcaggtcatccatactggagaaaaaccttacaaatgtaatgagtgtggcaaggtcttcactcagaattcacaccttgcaagacatcggggaattcatactggagagaaaccttataaatgtaatgaatgtggcaaggtctttaggcataattcatacctttcaaggcatcagcgaattcatactggagagaaaccttacaagtataatgagtatggcaaagcctttagtgaacattcaaacctaactacccatcaggtcatccatactggtgaaaaaccttacaaatgtaatgagtgtggcaaggtcttcactcagaattcacaccttgcaagacatcggagagttcatactggaggtaaaccttaccagtgtaatgaatgtggcaaagcctttagtcaaacatcaaagcttgcaaggcatcagagagttcatactggagagaaaccatatgagtgtaatcagtgtgggaaagcctttagtgtccgttcaagcctaactacccatcaggcaatccatactggaaaaaaaccttacaaatgcaatgagtgtgggaaggtcttcactcagaattcacaccttgcaagacatcggggaattcatactggagagaaaccttacaagtgtaatgagtgtggcaaagcctttagtcaaacttcaaaacttgcaaggcatcagagaattcataccggagagaaaccatatgagtgtgggaaaccctttagtatctgttcaagcctaactacccatcagacaatccatactggtgggaaaccttacaaatgtaacgtgtggaaagttctaaagtcagagttcaaaccttgcaagccatcacagaattcatagtggagagaaaccttacaaatgaaggtggtaacttttgcagttagaattcattcctttgacaacgtcagagaatttatgcctgagagattccttgaaaatgcaatgactggctgggtgcagtggctcatgcctgtaatcccaacactttgggagtccgaggcaggtggatcacctgaggtcaggagttcaagaccagcctgaccaacatggcgaaaccccatttctactaaaagtacacaattagctaggcctggtggcgtgcgcctgtaatcccagctatataggaggctgaggcaggagaatcacttgaacccaggaggcggaggttgcagtgagccaagatcgtgccaatgcactccatcctgggcaaaaagagcaaaactccatcttaaaggaaaaaaaaaaaatgcaatgactgtggcaaactcctcatgagttcaagtattaatagacatccaagagtccataataatgagaaatcacataaatgtactgtgtgtgacagaggctttattcaggcctcacagctttgcaggcattaaaatctacgtatttgatggaaccacacaaatgtaatgtgtaagagcatcctgaagctcttactctaagactgtaactgtaggtgaggattcatacaaagagtgactcagtctctagttctttgattcacttttaaaatgataaactgcacaataattacacgttccaatatggtaaaacttaagacattatatatttcaaaggtcaaaggacatttggaaatggctacttaccttcaggttataaaatcttttattccattgtttgaggtttctcaaaaaggctactgtttgtgactttcaacctgaactatggatctgtggctattttgcatccttaagcacctttcgtggtgcctatctgggaaagaaccacagtatggaaaggcttacttcattacatgaggatcatttttatccatgtttattgaagaaggaggactctgccttgtaaaattaaatattctctcaattgagagaccatggttttggggcagaaaataatgtaaaactatgatatcaatcatcata

SEQ ID NO: 77052 - DNA, 319 bp, Homo sapiens
agtactattctgccataaaaaaaagaatgagatcctatcacttgcaacatcttggatggaactggaggtcattatgttaagtgaaataagtcaggcacagaaagaaaaactttgcatattctcactcatttgtgagaactgaaaattaaaacaattgaactcacggaaatagagagtataatgatggtttccagagactgggaaaggtattgggtggggggcagggaatggggaaggttaataagtacaatgcaatgaatacgatctagtattttacagcacaaaagggtggctatggtcaacaataatttatagtaca

SEQ ID NO: 77053 - DNA, 670 bp, Homo sapiens
atgatcttgagtactttgtcctttaggtgtcttgcaaatatcctttctcacggtctttttattctgttgggccttttgataaacagaagtttatcaatgtagtcagttttattaatttattgatattaaagttatattcttttacagtatcttctaacagttttagaatttttttctttcacatttaagttttcagtctacttagatcttatttttttttaagatctttaccttttccatctggatgccgttatcccagagctacttattgagacattcagtcttcactgatgtgccctatcttatatcatacatactgatatgtgtggatctatttctgaacactctattctgttccattggcctgtttatccttgggctaacacaacactgtcttaatagcagcagctttataatcattgttatctgacaaagcatctcctctcatcttgttcaataggattgcctttgcctacacctttgcatattctgtgcattgtcttgtgccacaaaaacaaaaaataaagatgttgagattttcattggattgaccatgtgaaataatttggagaatattggcatatttccattatgttttttttcttttttttttccttaaggtcaggaaagcatcaaatatttctattattgagtcttctaaatgatgaaa

SEQ ID NO: 77054 - DNA, 369 bp, Homo sapiens
taggcagttttgaagaactaaatggaatatctagaatgaaaaaccatgcttgctaaaattaactcaatgagtgagtttaaaaagcaatttagacccagctgagagctgaatttgtggtatatgcagaaattacttctgatgcgaggcagagcatgatgacagaatgaggagatcccaaacatctatgagagttccattctgaatgattagaagaatgaggaagcaacagtatttaaaaagataatcactaagaaagttctatacttgatgaaaaatgtgaatcctaagattcaggaacagtgtgagacttcagctggggaaaaaagatgaaactacacttctacatttaggagtaaaactacagaatac

SEQ ID NO: 77055 - DNA, 190 bp, Homo sapiens
ctaaaaaggacaagaagaaatttgggcattgaagtgtagtgttggaactttattaaattctgttgcactgctgtaattgagctggaacctccttgtatttggtattctttctagttaaagctttgacagtcctaggaattctgctctgaaatcataaaaattaaaaaaaaattgtttttactgtatagat

SEQ ID NO: 77056 - DNA, 374 bp, Homo sapiens
gtaaggacaccatcgaccaatgggattagggccctatcctgtgatctttagttttatgtaccccctaaaggctctatgtccaaatgcagtcacactggggtttagggttttaataaatgaattttgggggacacagtttagtccataacattctgtccttgacctgccaaaatgtatgtccttctcccatacaagataaatttattccatcccagccgggcatggtggctcacacctgtaatcccagcactttgggaagccaaggcaggcggatcagaaggtcaagagatcgagaccgttctggctaacacggtgaaaccccatctctactaaaataaaaaaaagtcgacgcggccgcgaatttagtagtagta

SEQ ID NO: 77057 - DNA, 429 bp, Homo sapiens
gtaaggacaccatcgaccaatgggattagggccctatcctgtgatctttagttttatgtaccccctaaaggctctatgtccaaatgcagtcacactggggtttagggttttaataaatgaattttgggggacacagtttagtccataacattctgtccttgacctgccaaaatgtatgtccttctcccatacaagataaatttattccatcccagccgggcatggtggctcacacctgtaatcccagcactttgggaagccaaggcaggcggatcagaaggtcaagagatcgagaccgttctggctaacacggtgaaaccccatctctactaaagagacatgagaatggcataaacccgggaggcagagcttgcagtgagccaagatggtgccactgcactccagcctgggcgacagagctagactccg

SEQ ID NO: 77058 - DNA, 550 bp, Homo sapiens
atgatattcttaaaaataaatgcatatatttgtatatgttatttttaagttgtttcgtttaaaaggataggaagagaaattgttaattttgcacttaggccattaaattaagaaagaatgaataaaacaatggttaggatttgcatattggtaacaatggcaaccttctgaattgctttcattttgctgagttcagtgattgtgctctgtgaattaattcttttgtggaaagctattgaaagatcaaggaatttagaaaacaaaacaacagagaagcgtgctgtttcatatctatttgtacatagaaggttcaaagtgagattgtttacatcacaagtcttgttgacattttatttgcttcttagaagaaagatagtattcaaaaatgattatataatcatgcagataagacgttgcagtcatgaatgaactgttctgagagaaggaccaagaagaaaaaccacatgacaatttcgagctgggtttggttggcaagtgtcttcacaagacttgaaaatagagccctatttgattcctacagaaaaaataa

SEQ ID NO: 77059 - DNA, 423 bp, Homo sapiens
tgctcatgccaggacaggaagcagacgactgctaacaaaatgttttcactgtgatcactgctacctgtgttgggtgcaggtgcccaagtgtcacccaagcctctcccgtggtgcaggtgctcaggcagttcccaggcctccctgtggtctaggtgtccacacactacccaagcctctcccgtggtgcagggccgggcggcggcggacgagggccccgccccggaattccggtttgtgcccaaacctaaaggaccatcaggaagagaatttccagaggcccctggctcaggaatggcctgtaagcctaggtattgggttccaagctgaagccaggccagagtagccaagtggggtttggatttttgtccaaacagctcaggcaagcttctggtgggagaagggaaaggtggggaaatgggcaag

SEQ ID NO: 77060 - DNA, 401 bp, Homo sapiens
aaatgtgagattaatttggtgatcagagtcttcaatgttttgctttagcaagaatgaaaaaagtacaaagtatttggtgaacaaaatccatgtatatgttttttctgaattatttacttattattgagccattggataaaatattttcatggcttttgaaacatatctccataatgctatataaaagatttgtttcagtttataattaacaaaacagtgaacaaatgattagttattaaatggatcacttttagtgctaatatggtagctatagaatgataagttaatgttggtttgattaacattttttgatagcagggatgaatgtttttccatgtttgtttttgaattgtattttttgaactttgaaatgctctttaaaatacagaaaaatctgtatg

SEQ ID NO: 77061 - DNA, 443 bp, Homo sapiens
ttgatgtttcagcaccacagtgttttaattacagaggcttttgtagtatggtgtaagtctggtaaggcctgtcccatcctcttagtttgttgtatttgttttcagtgtgtttctggttattcttgcagatttattttttaatatgaactttagtatcaacctgtctaattttattcaaaagcattgttgggatttttattagggttacattaaacttatgagagctgatatgttaataatattgagtccttctctctgagaatagtattacctcttttatttattttatttatatctacttttgtgtctttcaggtgtgtttttaatttttctttgtatagattttacacatttttaagattattcctaagtaattttctttgttagtattataaatgagattttctttaccatttgtttgctgttggttattgtttgctgtt

SEQ ID NO: 77062 - DNA, 455 bp, Homo sapiens
gtacattcccaatggtatatacctcagattcagaaagaattgcaacgaaaatctgaaattattggtggtggtgttagtactgtgattctgtatctgctgttattctgaacatgtgtattatgggatgaatgggattaggggtattataggataaagtcagaactcatctgaaatttatctttaaaacaatattctcagctctatctactggaaagttgtaagtggtgactaaaccagtcataatgagcactcctagagcccaggttgtgatgtctgaatggacttcccagtagagggagatagggatccttgaagaaccagctgtttcaggtctaggacaagaaatgtagatcctagaacatcttgccatgctagctggctaagaagaatataaaaactatgaggattctgttgaaaggacctatggggtcaacttgaataagctcctactggta

SEQ ID NO: 77063 - DNA, 428 bp, Homo sapiens
gggccccgtctcagaggttctgatgctgtaaatcaggcgggacccctgaattttcatttctaagaagctcacaggtgctactaatgttgaagagaacctatgatctagttcaacttctgggatttcttgctttctttcttttgtaaaaaaaataaataaataaatttaaaaaagagtttttgaagatggggaaatgaggcctggaaatagaaaagatttgcctagagtcacacacactgtcaggtcaggtagagtcaaaatcaggcaccccgactcacagactgcttcacattgccatcagagattgtcctgcaacaatattatgtttagttctactgcagaatgataactggatcttaccccctttgcctgatctggccacaaacttgtttttcaggtctttccattaggctctcttcagctaatta

SEQ ID NO: 77064 - DNA, 85 bp, Homo sapiens
tctggcagtggcaagttccctgtcatccaagtgttcaattgacttcagggccccgccagccctccaagactaacagtgatgtgtg

SEQ ID NO: 77065 - DNA, 757 bp, Homo sapiens
atctgagaaagggactctgtctcacttatattttccaaagttaacacagtacatggaaaatagaatacatatttattcaaaaaacatataaaatgccttgtgtgtctgaataaacccagttcttatgtagacatggtaagggattatttggtattcatgtgagcagttaggttttgtgtcagagtagaatgaccactctatcaaaagctccatactattttgacatgaaattgatctgcaaacacctatccagaatcccaaactaatctaaagaaggacagaatatatcccctgaattttatctttctcatgtgtttagaatctagctgatgaaaattcattttactaccaccttgtttgtttacattcgtttgttctctcattcagcaatctaccacgcaacacgtaatgttagtgagccactcttctaggtgctgaaatagccactcttctaggtgctgaaatacagacgaatccagataaggcctctactttcatgaagtttatattctagtgtctcaggttggagaataaggaaatacagaagatgaaacagagtgatataatgcagaatgactggatgattagtttgggatttctggaaaatattttctgtattggtgtttttctttttttgttttggtttgattttgtctttttgaaacaaggtctcactcttttgtccaggcaagatggtgcagtggcagcatctcagctcactgcaacctctgcctcccggactcaagcgatcttccca

SEQ ID NO: 77066 - DNA, 281 bp, Homo sapiens
atagtaccttttgtggatagacttctcagttaggttgtactagtattattccatattttgttccctcccatcccatcaaccccttactataaaatgaataaataacctgcattttgtatagaagttccaatttcaaatattctttcttgttgttcctgtaaaccagagagtgtttgtaggaacaacaggacagaaatatgtggaaatgtcaaagttttgtcctccagaatgcatttccaatacttttaaacctgaaagtacaataaaattcggatccattt

SEQ ID NO: 77067 - DNA, 578 bp, Homo sapiens
tgtagaaataaaaagtgcagatttatgagaggggatgggtctacctggagtgacttgaggaatacccagaagaccccgtccacctcctcctgcttagaatatgccttttgctagcctgctgtgatgcctggaatttcatccttcacccattgctgggcccacccacatagtttaaagccaagatcaggacagagatggagggagctgtcccctggccaccctgatacctgctgttggaaatcaacaaacaaacacaaacccactttgcgttctgtgagtgtgcatgtatgttggtccctaggtgctgcaggacaagaggagggccagaaagctctgcccatgcctggggagcatgctggatctcccttccagctacagaagaggtctatggtttcttagacacgcgtggattctcacagccaccaccacagacagtacaagcaacagttccaatactccagagaacgccctcatctctcctcacccctgccttctggcaagcaatgagctgttctctgttcctgtatttttgccttttctagaatgccatataaatggaattatatagaatgtgaaaa

SEQ ID NO: 77068 - DNA, 736 bp, Homo sapiens
ctaagatcctatccagaagctgctgatcaccagttgtaggtattttctagccattgggagactgcctttccctggtgccggctgtgaccagttattattttagagagacagtttaacaactgcctgaccacctgatggttgcgtgacattcctggtgggagcggggagccctctcctgctctgcttgtgtctgactacctactgtggcactatagaatcaaatgagaaaaacttaaaatttgggacaatttaacagctttattgaagtatattgatataacaaagtatatttaaagtgttcagtttgatacacacatatacacatagatacacctatttaaaaacccatcaccacaacagacaaaggacatattcatcatacccaaaagtttcctcatgtagcccctccctcccagtcttccttacctctccaccccaccaggcaacccctgatatgctttatgtaactatacattaatttgtatttcctagaattttatataattggaatcacacattgtatattctgttttatctggcttctttcactcagcaaaattattacgagattcactgacgttgtagcatgtatcattagttcattccttttattactgagtagtattcaactgtagggatacaccagtgattttacccattcccttattgatgaacattttggttgtttctagattttggctattgcaaataaagctgctatgaacattcatgtaca

SEQ ID NO: 77069 - DNA, 683 bp, Homo sapiens
gccgggcgcggtggctcaggcctgtaatcccagcactttgggaggccgaggcgggcgtatcacgaggtcgggagattgagaccatcctggctaacacggtgaaaccccgtctctgctaaaaaatacaaaaaaattcgctgggtgtggtggcgggcacctgtaatcccagctactgaggaggctgaggcaggagaatgacatgaacccggggggcagagcttgcagtgagccgagattgcaccactgcactccagcctgggcgacagagcaagactccgtctcaaaaaaaaaaaaaaaagaaggggtgcgtgtgtcttcccccattgagctcctcctcagtgaagcagagtgcatccctcgcagtttctgccgaggcctggccacccccagccagccccagtggatgggcaaactgttgtcaccactagaagtccaatttctcacccctcgggtgtcagctggactggaagcaaaactagcactcaactgtattgactcctctggagccaggggtggggacctggagtctcagtctgctgcatctggaaggcatcataagtgtccccaggcctgggcaggctggccttcctccttcactctaggagatgggcatttgaagcagaactctggggggtttgcctctgtcctttgctttcacctgattgtgggaggggaggtgggag

SEQ ID NO: 77070 - DNA, 390 bp, Homo sapiens
cattttaacattttagcaaggtccaggttgtgagatcattcagtgctctcctgtgtgtctttcataatcttaattcatcactgacctcatcttaaagcaggctaaaaaataatttcaatcaatcagttaataactgatagttaagaatcccagtgttgttacatgttttaaaatgttgattagggcttggctgaaaagtagtttcagttgcatcttataccatgtagactataaataagcattcatgtttatgtcagatatgaatatatataaacatcgatatgtgtatttttaaaaatttaacataaatatcttacgcctacctcccctttgttaagtgccaatgtagattactttctctgcctatgaattaattgaactcttgtgctc

SEQ ID NO: 77071 - DNA, 296 bp, Homo sapiens
gtcaacaggtaggactgtgtgatgactcatcctactcaaaattctccagactcggtttgtgcaatattggattctacaatgctgagcaagggaagaaaagtgtttaaaggagagccacaaataagaatatataggttgaatataaactttatagagcctgaatagattggaatggaatagatggaggcttcacactccttcccacatgcattgtcctatgcatctcttcatctggtgttcatcggtatcctttgtaatatcctttataataagctagtaaatgtgagtacagtcat

SEQ ID NO: 77072 - DNA, 90 bp, Homo sapiens
  misc_feature (88)..(89): n is a, c, g, or t
gcccggatgatcctcagtggtctggggtgcaggcttcaaacctgtagctgtctagcgacagagtggttcaattccacctttcgggcgnna

SEQ ID NO: 77073 - DNA, 414 bp, Homo sapiens
acttcattcagggagagagtttaaggggaaaagatagtcatagtcatcatctctcttggtgtttccaaacctgatgagcattaacattttctgggaagctttaaaaaggtatgggttcttgggtttcactgtataggctgtctttggtggatctgagatgggttgtggagctctatctatattttgaatccctgcccccatgggatctgatgaccaacctgtttgaaaaccattgcctcatccttgcaaatatcacagttggctgagtattggtgagtggggttgatttctggcctgaggtttagagccaactccaaggggcaaggttaacaacgttccataaagagtcaggaaattgacctgtagtcctgtccacaaataagccttctgaatagacacggtttttccctcaag

SEQ ID NO: 77074 - DNA, 347 bp, Homo sapiens
aattatctcctgaccttttcaaaacacactgaagtgagaataagagattttaaaaggtagaacacattgcgcaaagagaaaaggagaaaagatataaggataagagaaatttcaacacatctttggaaaactgaattacggaggaggatgaactgaattagaagcaggaagaaagctataacctaaggacctgcacaaggaaacacatgagaacctggcaaatattctgcagaactgaaatgctcagaattggaggcaacagatattgttgagggaggtgtcatgtgtggggctcaaaaattggtgattggtcaacaatctgaatagggaccagtcagagagtaagc

SEQ ID NO: 77075 - DNA, 480 bp, Homo sapiens
acagaattaatttcttcctcaagtcccattactggcattgctttcttcttgaccaaagctgagttctgcaccaatgctgagtcttctcattttgtaaaatatttatggtcataatccacagtcatataggatagtggtcctataagattacaatactgtatttttactataccttttctatgtttagttttgtttagatatacaaatacttaccattgtgttacagttgcctgtagtattcaggacagtagcatgccatgcaagtttgtagcctaggagcaataggctacactatatagcctaggtgaattgtaggctatgccgtctagttttgtgtaaatgtactctttgatgttgcctcaatgatgatgtcacctaacagtgcatttatcagaagtgcccccatcaatacacatgactgtatttggtcttcttcctaatttcctgatatatgaccactaaaaccttaaaatctcaaaa

SEQ ID NO: 77076 - DNA, 354 bp, Homo sapiens
ccctcaggtcacttgtgatgaccttggaaacataggtagctctcagtggtctgggggcccctggcagcccctccaccttcctcacactttttcagtcagtcatttctggaaggatttgggaaaacttcatttgctagtggacattttagtcattgggtgagcaagaagaaatggcatacttccttatttgagccaatctgccttctcaaaagtgtgatcactattaaaagagtcatgatatggtgtgggcagtctctgaaccaaacacaatgctgaaatgactttcggacaaaggtgatggtgcacttagttctgtcttgggtggcagggacaactttgcagaagctgtcatgg

SEQ ID NO: 77077 - DNA, 429 bp, Homo sapiens
tctgaagcctggggaggactttgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacc

SEQ ID NO: 77078 - DNA, 910 bp, Homo sapiens
gctcgaccagaattctaactaggatcttcaagatcaactctccccaggtcagtgcatggagcagaaagagaagggaaagggatagaatgtcttcatgactttaatcctagtatttgaaaaaaaataatcaaaccttgcacctacaaatttctgtcttgatccagaaagtcattagcataaaaaagataatagtgggcttctcgcctaacgccgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacc

SEQ ID NO: 77079 - DNA, 734 bp, Homo sapiens
ggtcactctacagaatccccttactttcgtccagctgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacc

SEQ ID NO: 77080 - DNA, 725 bp, Homo sapiens
aaagcttaaggctaggtacgaggctgggtgttgatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacc

SEQ ID NO: 77081 - DNA, 1165 bp, Homo sapiens
  misc_feature (421)..(421): n is a, c, g, or t
  misc_feature (433)..(433): n is a, c, g, or t
  misc_feature (456)..(456): n is a, c, g, or t
aatcttgtgtgacactctgcgagcactatctcactactactctgatgggatacctgtcgacgggttgtttaccgaccttgggtgggtctcctctcccatttgtgttgtccccatgtatgcggcctgagaccaatgtcccgcctatgtggttgaacccacgtcttttcccccttgcgagccctcagggatggcacaccagctgtggacctccccggccggtgcggccttttctgggtccccacgtatatagcccatcggggcattccgtggagcttgcgggctcttcagaatcctgaggagtacctgatcctcaggagcaccagtacagcgcccagaccagtagagacccggtagtcagaggcgcaggggagcatcctgggtttgggcccgcgacacccccgcggcccgcgctctgcgctcngctggcttggcnatgcctgcgggcagacggacggncggacggcacagctccctgggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacc

SEQ ID NO: 77082 - DNA, 711 bp, Homo sapiens
cccacgcgtccgccacgcgtccgtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacc

SEQ ID NO: 77083 - DNA, 849 bp, Homo sapiens
  misc_feature (756)..(756): n is a, c, g, or t
  misc_feature (760)..(760): n is a, c, g, or t
  misc_feature (763)..(763): n is a, c, g, or t
  misc_feature (766)..(766): n is a, c, g, or t
  misc_feature (775)..(775): n is a, c, g, or t
ggtcactctacagaatccccttactttcgtccagctgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgaccaaaaaaaaaaaaaaaaaaattngggngcnggncggaaattnacacctcgcgtgggcgcggccaaagaagaccggacagggtccagcaccgcgccagggggttcccaaaaacccgg

SEQ ID NO: 77084 - DNA, 874 bp, Homo sapiens
ccacgcgtcgcggacgcgtgggtcgacccacgcgtgcgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgaccaaacaacaaaagccacgctcctaacacaacaacggggggggggcaaagtctccgggggggcctttcgtcccctctttgaaaaggggctcaaggggctataaagagcgggggtaaacgcgcggggcacccgtgggggttg

SEQ ID NO: 77085 - DNA, 812 bp, Homo sapiens
aaagcttaaggctaggtacgaggctgggtgttgatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgaccacaaaaaaaaccgggcttttccgggaggaaaaggtttaaggccatgcctattttccgccccttttgcaaggaattcgccctagcgta

SEQ ID NO: 77086 - DNA, 868 bp, Homo sapiens
  misc_feature (787)..(787): n is a, c, g, or t
  misc_feature (790)..(790): n is a, c, g, or t
  misc_feature (800)..(803): n is a, c, g, or t
  misc_feature (812)..(812): n is a, c, g, or t
  misc_feature (815)..(815): n is a, c, g, or t
  misc_feature (822)..(823): n is a, c, g, or t
  misc_feature (825)..(826): n is a, c, g, or t
  misc_feature (833)..(834): n is a, c, g, or t
  misc_feature (837)..(837): n is a, c, g, or t
  misc_feature (853)..(853): n is a, c, g, or t
  misc_feature (861)..(861): n is a, c, g, or t
gcaatatggtataggtcgggctggtgtaattcatgacgggacgtgtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgaccaaaaacgaataaaaaaaaatcgggggtttttttgggggggggaaaaagggtttnaangggctgggtnnnnttttccggnccntttttgnnannggggaannggnggccccaagggggggntaatgaanccggtat

SEQ ID NO: 77087 - DNA, 844 bp, Homo sapiens
ccttagctagtaggaggcgggtgtgaatcggccgaggggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctggctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77088 - DNA, 756 bp, Homo sapiens
aaaatataggctaggtagaggctggttcgaatcggccgaggcaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctggctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacc

SEQ ID NO: 77089 - DNA, 738 bp, Homo sapiens
cggacgcgtgggtcgaacgctgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctggctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacc

SEQ ID NO: 77090 - DNA, 862 bp, Homo sapiens
  misc_feature (773)..(774): n is a, c, g, or t
  misc_feature (779)..(779): n is a, c, g, or t
  misc_feature (782)..(783): n is a, c, g, or t
aaaatataggctaggtagaggctggttcgaatcggccgaggcaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctggctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgaccaagcaaaaaaaaaaacnnggggntanntggggggggggaacagaggaaggagggccagggcataggggcccggaccattttggcaaggggaaatgcgcaccaaggg

SEQ ID NO: 77091 - DNA, 960 bp, Homo sapiens
cggacgcgtgggtcgaacgctgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctggctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgaccaaaagaacacaaacgcaccggtctgaggagagcaaggcgacaacgcaacgccgtcgacggatgcacacgccaagacgcgtcaggcacgagaccacacacaaagaaagcggggggcgacaaacgcagcggggacaagccgacccccgtagaaagaccactgggattaaccgcggcccgcaccacaggagacagacgggcgtaggacacactgtgggggagccc

SEQ ID NO: 77092 - DNA, 412 bp, Homo sapiens
  misc_feature (10)..(12): n is a, c, g, or t
  misc_feature (21)..(21): n is a, c, g, or t
  misc_feature (23)..(24): n is a, c, g, or t
ctactaaatnnncggccgcgncnnccaaaaaagcacctggtactaagggtactgctgctgctgctgctgctggctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77093 - DNA, 470 bp, Homo sapiens
ccgcctactactactaaattcgcggccgcgtcgaccaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgaccaaaaaaaagtcgacgcggccgcaatttagtagtagtattccg

SEQ ID NO: 77094 - DNA, 262 bp, Homo sapiens
  misc_feature (235)..(235): n is a, c, g, or t
gctcagattatccccggatgtacatgagtattgatctggctgtacatgagtattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatactcatgtacaaccgggcaccgagnctcgacattcgttactcctggctcata

SEQ ID NO: 77095 - DNA, 461 bp, Homo sapiens
  misc_feature (92)..(92): n is a, c, g, or t
  misc_feature (118)..(118): n is a, c, g, or t
  misc_feature (219)..(219): n is a, c, g, or t
cctttactctcttctccctccagaccttcctctgacccttgctgaactggggtccctttgtgagtgtctcagtctagaggtacctccctccntggggggtctcagctcctggagtcgnccagccttggggcccctctgtgagatctcaatgctgtctggggaccctaagagttttctcacctgttcagtctcatctaaccttccaatgtctgatgttcngctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacc

SEQ ID NO: 77096 - DNA, 338 bp, Homo sapiens
aggtgagctcccagggttttcttaatgctcaaatggtcgcccaacgcagcagagagctgctaagtcatcacttccgacaacagagggtggctatgagctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacc

SEQ ID NO: 77097 - DNA, 295 bp, Homo sapiens
  misc_feature (10)..(12): n is a, c, g, or t
  misc_feature (21)..(21): n is a, c, g, or t
  misc_feature (23)..(24): n is a, c, g, or t
ctactaaatnnncggccgcgncnnccaaaaaagcacctggtactaagggtactgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacc

SEQ ID NO: 77098 - DNA, 287 bp, Homo sapiens
  misc_feature (8)..(8): n is a, c, g, or t
  misc_feature (30)..(30): n is a, c, g, or t
agggcganagccctgggatgcaccggccanaggccatgctgctgcgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacc

SEQ ID NO: 77099 - DNA, 433 bp, Homo sapiens
  misc_feature (178)..(178): n is a, c, g, or t
agcttcatcccatcacagctgatccccccaaccgccaaccccgtcaccagtgcggtgcctcagccgcaggggccaccactccatcccagcgctcccagctggaggcctattccactctgctggccaacatgggcagtctgagccagacgccgggacacaagggcttgtagccatggcncagcagccacagcgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacc

SEQ ID NO: 77100 - DNA, 613 bp, Homo sapiens
  misc_feature (55)..(55): n is a, c, g, or t
  misc_feature (105)..(105): n is a, c, g, or t
cagattcacctgaagagtgtgagtggtcccattgaggttctgctggtgaacaganggcatggagctcaccccctgtggctgtgcctgtgccaccacctgaagatntgctccagagcccatctgctgtttctacactccacctctgcccaagcctgccctagcccagtcccaggaagcctcacgtccaaatagtcctcagctcactcccactgctgtccctggcagtgcagaagtccagggaatggctggcccagcagctgagatcacagtgagtggcggccctgggactgatagcaaggacagtggtgagctcagttcactcccactgggcccaacaacactggacacccggccactgcagtcttctgcccgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacc

SEQ ID NO: 77101 - DNA, 209 bp, Homo sapiens
ctctttattggccgcctactactactatacgggtggaagattacgacagagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacc

SEQ ID NO: 77102 - DNA, 859 bp, Homo sapiens
ggcggtgcgttcttctacacatgcgcagggttgggcgggtcttcttccttctcgcctaacgccgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77103 - DNA, 627 bp, Homo sapiens
ggcggtgcgttcttctacacatgcgcagggttgggcgggtcttcttccttctcgcctaacgccgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagccctgggcgataagcaggtaccgagctcg

SEQ ID NO: 77104 - DNA, 802 bp, Homo sapiens
  misc_feature (773)..(773): n is a, c, g, or t
  misc_feature (790)..(790): n is a, c, g, or t
  misc_feature (792)..(793): n is a, c, g, or t
ggcggtgcgttcttctacacatgcgcagggttgggcgggtcttcttccttctcgcctaacgccgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgaccaaacacaacaancacacaacaaaaaacanannaaaacaaaa

SEQ ID NO: 77105 - DNA, 880 bp, Homo sapiens
ggcggtgcgttcttctacacatgcgcagggttgggcgggtcttcttccttctcgcctaacgccgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctaaagttccagcaaaaaaagatcaccgaaagacctaaatacacatttgatttctcagaagacgaggatgatgatgctgatgatgatgatgatgacaataatgattagaggaatagacagttaaagcatctcccataaagatgatggggaagatgaatttgtaccttcagatgggtaagatcacacgctgacttatacattttcaaccagggaaaatccacaaagccacatccagacaaaatcgggcctgacaaaaacaagtcacgatttcgcgcgctctctctctcattcctctcaagtcctcacgagtccgaagatgcatcagtttagctagacgtcactgccgaaacattc

SEQ ID NO: 77106 - DNA, 872 bp, Homo sapiens
ggcggtgcgttcttctacacatgcgcagggttgggcgggtcttcttccttctcgcctaacgccgccaacatggtgagtcttactgttgcgggctccggggccgtcgaccatgccgctcgacctccacctccgctgggaagctgaggcgccgaacggctcccagagggtcccgggaagcgcatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacc

SEQ ID NO: 77107 - DNA, 510 bp, Homo sapiens
tcgtcgtcgtcgtggtttggcgtgtattccgagcgttggtgtctggcggtttccgagcgttggtgtctggcggtttctgaccgttggtgtctggcggtttccgaccgttggtgtctggcacgcgccaccctctcttgctttggttgcgccatgccgatgtaccaggtaaagccctatcacggggtctgcgcccctctccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgatgggggagccggcggcgccgctacgagcacccgggcttggcgcctggcaccat

SEQ ID NO: 77108 - DNA, 376 bp, Homo sapiens
taaattagcggccggtcgactatgaaggcaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacc

SEQ ID NO: 77109 - DNA, 823 bp, Homo sapiens
gacacgaatggggcacaggacgcttgtagccgagggatcaagacgacgaggacccggatgtgccgattcggatccgtctctctgaaagttattgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgaccaaaaaaaaaaaaaaaaaaaaaaaaaacaggtgtgtgcggggcgcgcccgggagccccggagaaagcttttaagaaacccgcgcgggggggcgcgcgggggccccggggggcacaggaacaggggggccaacgcgcgggtaccacagagggagaccccggggcacagagaacaaaaggggcggagaatcttctcacccaaagtaaaacaagaggccgcgggggcgacacacgagacggggtctggggaacactatcacccagagatgaggaaagccgagagagggcacaaaaggggggagcatccaatcaaaccaggagggggtcccaaagggaagactccagactttccagatttaccccggcccccgtgtgggta

SEQ ID NO: 77110 - DNA, 261 bp, Homo sapiens
  misc_feature (26)..(26): n is a, c, g, or t
acaggctaggtacgaggctggtgtcngcacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccacccgggtgtcccgccgcctctgctc

SEQ ID NO: 77111 - DNA, 750 bp, Homo sapiens
  misc_feature (479)..(479): n is a, c, g, or t
  misc_feature (488)..(488): n is a, c, g, or t
  misc_feature (491)..(491): n is a, c, g, or t
  misc_feature (500)..(500): n is a, c, g, or t
  misc_feature (503)..(503): n is a, c, g, or t
cggacgcgtgggtccggacgcgtgggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctctgctgntgctgctgntgntgctgctgntgntgctggctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacc

SEQ ID NO: 77112 - DNA, 1008 bp, Homo sapiens
gctcgaccagaattctaactaggatcttcaagatcaactctccccaggtcagtgcatggagcagaaagagaagggaaagggatagaatgtcttcatgactttaatcctagtatttgaaaaaaaataatcaaaccttgcacctacaaatttctgtcttgatccagaaagtcattagcataaaaaagataatagtgggcttctcgcctaacgccgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77113 - DNA, 1101 bp, Homo sapiens
gctcgaccagaattctaactaggatcttcaagatcaactctccccaggtcagtgcatggagcagaaagagaagggaaagggatagaatgtcttcatgactttaatcctagtatttgaaaaaaaataatcaaaccttgcacctacaaatttctgtcttgatccagaaagtcattagcataaaaaagataatagtgggcttctcgcctaacgccgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatcaaaaaaaaaaaaaagaaacaaagggggggggaataaagagtactcggaggggccaattaagggcaaacacaatatagtgagaaagggggcacta

SEQ ID NO: 77114 - DNA, 832 bp, Homo sapiens
ggtcactctacagaatccccttactttcgtccagctgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77115 - DNA, 1045 bp, Homo sapiens
gctcgaccagaattctaactaggatcttcaagatcaactctccccaggtcagtgcatggagcagaaagagaagggaaagggatagaatgtcttcatgactttaatcctagtatttgaaaaaaaataatcaaaccttgcacctacaaatttctgtcttgatccagaaagtcattagcataaaaaagataatagtgggcttctcgcctaacgccgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatcacaacactaattcccacccttatacgcccttacccgct

SEQ ID NO: 77116 - DNA, 823 bp, Homo sapiens
aaagcttaaggctaggtacgaggctgggtgttgatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77117 - DNA, 822 bp, Homo sapiens
gcccagtttgagcctgactctagaggatcccccaggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77118 - DNA, 1039 bp, Homo sapiens
gggggcgagaaaacaaatctacggctaggtgcgaggctgggtggtgcgccgctggcgagcgcgtggagggcccggcaggcctggcgcgccttgggccacgcgtgcgcgcctccgccgctggagctggatggctgatgcggctcgtggtccgagagccttgtcctgccgtgtgggccttgcggacctgggagctggtgggcgttgggaaccgggcttaagctactgaggcgtttgctgatttcgtccatccaggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77119 - DNA, 820 bp, Homo sapiens
ggaacgaggggaagacggtgaactaagagcggagtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77120 - DNA, 968 bp, Homo sapiens
  misc_feature (53)..(53): n is a, c, g, or t
  misc_feature (58)..(58): n is a, c, g, or t
  misc_feature (78)..(78): n is a, c, g, or t
  misc_feature (116)..(116): n is a, c, g, or t
  misc_feature (120)..(120): n is a, c, g, or t
  misc_feature (136)..(136): n is a, c, g, or t
  misc_feature (160)..(160): n is a, c, g, or t
  misc_feature (169)..(169): n is a, c, g, or t
cattctatttccccctctattgatccccacctccaaatatctcatcaacaacngactnatcaccacccaacaatgacnaatcaaactaacctcaaaacaaatgatagccatacacnacantaaaggacgaacctgntctcttatactagtatccttaatnatttttatngccacaactaacgtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77121 - DNA, 823 bp, Homo sapiens
ccgcctactactactaaattcgcggccgcgtcgaccgtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77122 - DNA, 825 bp, Homo sapiens
ccttagctagtaggaggcgggtgtgaatcggccgaggggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77123 - DNA, 830 bp, Homo sapiens
  misc_feature (31)..(31): n is a, c, g, or t
cgggagacctaaaccagggaaggggggcccntttggcaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77124 - DNA, 942 bp, Homo sapiens
caggctcggtaggtttgtcgcctctacctataaatcttcccactattttgcaacatagacgggtgtgctcttttagctgttcttaggtagctcgtctggtttcgggggtcttagctttggctctccttgcaaagttatttctagttaattcattagtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77125 - DNA, 1388 bp, Homo sapiens
  misc_feature (933)..(933): n is a, c, g, or t
gctcgaccagaattctaactaggatcttcaagatcaactctccccaggtcagtgcatggagcagaaagagaagggaaagggatagaatgtcttcatgactttaatcctagtatttgaaaaaaaataatcaaaccttgcacctacaaatttctgtcttgatccagaaagtcattagcataaaaaagataatagtgggcttctcgcctaacgccgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgaccaaaaaaaaaaaaaaaaaaaaaanaaaaaaaagaaaaaaaaaaacaaaaacaaaaaaaaaaaaaaaaacaacagccaaccacacaaacagacacacaccacaccaacgccaaccagacataaccaacacacagaccacaaacaaaacacaccacccaccaacgacacgacaccacaagaaacacgacacccaacaaacactagagatcgccgcactcacaccacccacaaccacaccataacagacaagaaaccagaaccataataacaaacaacactagacagtggagcaaaacagcatacaccacacgagcaacacaaagaagcaaaaaagaaagaagacaacgacacgaccccacaccaacccacgccgccggcagcacaacacaacccaaaacaaaccgaactagcacaaaacaaaacataggacgatgagagagagcacacacccagcacacacaacccaccacgacaccaaaa

SEQ ID NO: 77126 - DNA, 951 bp, Homo sapiens
  misc_feature (922)..(922): n is a, c, g, or t
  misc_feature (939)..(939): n is a, c, g, or t
  misc_feature (941)..(942): n is a, c, g, or t
gctcgaccagaattctaactaggatcttcaagatcaactctccccaggtcagtgcatggagcagaaagagaagggaaagggatagaatgtcttcatgactttaatcctagtatttgaaaaaaaataatcaaaccttgcacctacaaatttctgtcttgatccagaaagtcattagcataaaaaagataatagtgggcttctcgcctaacgccgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgaccaaacacaacaancacacaacaaaaaacanannaaaacaaaa

SEQ ID NO: 77127 - DNA, 1045 bp, Homo sapiens
  misc_feature (964)..(964): n is a, c, g, or t
  misc_feature (967)..(967): n is a, c, g, or t
  misc_feature (977)..(980): n is a, c, g, or t
  misc_feature (989)..(989): n is a, c, g, or t
  misc_feature (992)..(992): n is a, c, g, or t
  misc_feature (999)..(1000): n is a, c, g, or t
  misc_feature (1002)..(1003): n is a, c, g, or t
  misc_feature (1010)..(1011): n is a, c, g, or t
  misc_feature (1014)..(1014): n is a, c, g, or t
  misc_feature (1030)..(1030): n is a, c, g, or t
  misc_feature (1038)..(1038): n is a, c, g, or t
gctcgaccagaattctaactaggatcttcaagatcaactctccccaggtcagtgcatggagcagaaagagaagggaaagggatagaatgtcttcatgactttaatcctagtatttgaaaaaaaataatcaaaccttgcacctacaaatttctgtcttgatccagaaagtcattagcataaaaaagataatagtgggcttctcgcctaacgccgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgaccaaaaacgaataaaaaaaaatcgggggtttttttgggggggggaaaaagggtttnaangggctgggtnnnnttttccggnccntttttgnnannggggaannggnggccccaagggggggntaatgaanccggtat

SEQ ID NO: 77128 - DNA, 1112 bp, Homo sapiens
gctcgaccagaattctaactaggatcttcaagatcaactctccccaggtcagtgcatggagcagaaagagaagggaaagggatagaatgtcttcatgactttaatcctagtatttgaaaaaaaataatcaaaccttgcacctacaaatttctgtcttgatccagaaagtcattagcataaaaaagataatagtgggcttctcgcctaacgccgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacccaaacaaaaaaaaaaggggggggtaaaatatcctcgggggcaagttacgcgtaccagtttttgtaaaagggccctatgggggtgaataagaaggagggcggtaaacacgtggatgaacggctgtggatttggaaggcctcttgggtggattggcatcacagtaagttggaataattgtaggtaagttcggggtgtgtattaa

SEQ ID NO: 77129 - DNA, 1049 bp, Homo sapiens
gctcgaccagaattctaactaggatcttcaagatcaactctccccaggtcagtgcatggagcagaaagagaagggaaagggatagaatgtcttcatgactttaatcctagtatttgaaaaaaaataatcaaaccttgcacctacaaatttctgtcttgatccagaaagtcattagcataaaaaagataatagtgggcttctcgcctaacgccgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgaccaaacaacaaaagccacgctcctaacacaacaacggggggggggcaaagtctccgggggggcctttcgtcccctctttgaaaaggggctcaaggggctataaagagcgggggtaaacgcgcggggcacccgtgggggttg

SEQ ID NO: 77130 - DNA, 1056 bp, Homo sapiens
  misc_feature (912)..(913): n is a, c, g, or t
  misc_feature (917)..(917): n is a, c, g, or t
gctcgaccagaattctaactaggatcttcaagatcaactctccccaggtcagtgcatggagcagaaagagaagggaaagggatagaatgtcttcatgactttaatcctagtatttgaaaaaaaataatcaaaccttgcacctacaaatttctgtcttgatccagaaagtcattagcataaaaaagataatagtgggcttctcgcctaacgccgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgaccgnncttntgaccggttcaaaccaaaacacccacaacagcaaaacagaccacaacacgcaaccaagaacacagaaacaaagacacccggggggggggccaacccagagaggagacagggggacaaagagaggaagacgggcacccgg

SEQ ID NO: 77131 - DNA, 997 bp, Homo sapiens
gctcgaccagaattctaactaggatcttcaagatcaactctccccaggtcagtgcatggagcagaaagagaagggaaagggatagaatgtcttcatgactttaatcctagtatttgaaaaaaaataatcaaaccttgcacctacaaatttctgtcttgatccagaaagtcattagcataaaaaagataatagtgggcttctcgcctaacgccgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgaccacaaaaaaaaccgggcttttccgggaggaaaaggtttaaggccatgcctattttccgccccttttgcaaggaattcgccctagcgta

SEQ ID NO: 77132 - DNA, 1055 bp, Homo sapiens
gctcgaccagaattctaactaggatcttcaagatcaactctccccaggtcagtgcatggagcagaaagagaagggaaagggatagaatgtcttcatgactttaatcctagtatttgaaaaaaaataatcaaaccttgcacctacaaatttctgtcttgatccagaaagtcattagcataaaaaagataatagtgggcttctcgcctaacgccgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgcccaccagaagtatgtccgacaagcctggcagaaggcagacatcaatacaaaatgggcagccacacgatgggccaagaagattgaagccagagaaaggaaagccaagatgacagattttgcttcctttctctgctagatcggt

SEQ ID NO: 77133 - DNA, 1452 bp, Homo sapiens
gctcgaccagaattctaactaggatcttcaagatcaactctccccaggtcagtgcatggagcagaaagagaagggaaagggatagaatgtcttcatgactttaatcctagtatttgaaaaaaaataatcaaaccttgcacctacaaatttctgtcttgatccagaaagtcattagcataaaaaagataatagtgggcttctcgcctaacgccgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgaccgcctatagggcatccatgtattaagggtccttttgccccggtaacgcaaagtttgcctgcgccccaatctggcctattggccaatctgcctataggggggatatacatttctgtggcgtgtttaaaccggcgcattggtccgtgggggacccatattaaccgcttggacaccacgcctttctcacgcgcccattcccgcaagggccccctgtggcctttgcacgatgtgctcccctctcgcccttacatcccccgcgcgcattctgtaccccggcgcatctgcttacgcgcgctttctacaccacgccccacggtcacacctttgactaccagacccacgctgcagcgccctctctcctctcacagagcctctctttccccgcggctccgtcactagtctacgctctgctctcgcgccctgccccgcgcctcccttcccttcatgtccactcacgcctctccgtcaccgctcctcccttgcctcctccacctccgtggccacactcttgctcgcgctcccgtcgctccgcgtgctccccgcc

SEQ ID NO: 77134 - DNA, 952 bp, Homo sapiens
gctcgaccagaattctaactaggatcttcaagatcaactctccccaggtcagtgcatggagcagaaagagaagggaaagggatagaatgtcttcatgactttaatcctagtatttgaaaaaaaataatcaaaccttgcacctacaaatttctgtcttgatccagaaagtcattagcataaaaaagataatagtgggcttctcgcctaacgccgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgaccaaaaaaaagtcgacgcggccgcaatttagtagtagtattccg

SEQ ID NO: 77135 - DNA, 981 bp, Homo sapiens
  misc_feature (914)..(914): n is a, c, g, or t
  misc_feature (976)..(976): n is a, c, g, or t
gctcgaccagaattctaactaggatcttcaagatcaactctccccaggtcagtgcatggagcagaaagagaagggaaagggatagaatgtcttcatgactttaatcctagtatttgaaaaaaaataatcaaaccttgcacctacaaatttctgtcttgatccagaaagtcattagcataaaaaagataatagtgggcttctcgcctaacgccgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgaccaaanaaaaaaaagaaaaaaaaaaacaaaaacctttggggggcgcccgggcccggaaaaagtttttnaaacc

SEQ ID NO: 77136 - DNA, 939 bp, Homo sapiens
  misc_feature (911)..(911): n is a, c, g, or t
gctcgaccagaattctaactaggatcttcaagatcaactctccccaggtcagtgcatggagcagaaagagaagggaaagggatagaatgtcttcatgactttaatcctagtatttgaaaaaaaataatcaaaccttgcacctacaaatttctgtcttgatccagaaagtcattagcataaaaaagataatagtgggcttctcgcctaacgccgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgaccnaaaaaaaaaatgagagaagtcgtatcga

SEQ ID NO: 77137 - DNA, 741 bp, Homo sapiens
gctggtagcgactctagaggatcccctggctgtacatgagtattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77138 - DNA, 751 bp, Homo sapiens
gctcagattatccccggatgtacatgagtattgatctggctgtacatgagtattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77139 - DNA, 712 bp, Homo sapiens
gtacccctcaacgctttatacttctgggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77140 - DNA, 750 bp, Homo sapiens
aggcagtgatcgactcggtacccatctcgtgaccggcgattatagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77141 - DNA, 961 bp, Homo sapiens
tacacctaatatttccttgtccccctccttttcgattgatgctgtaatattttctcggaatcctcttcactgcccaaagtttggcagatagaggcaactcccaggccagtgagctttacttgccgtgtaaaaggaggaaaggggtggaaaaaaaccgactttctgcatttaactacaaaaaaagttcatgtttagtttggtagaggtgttatgtataatcgccggtcacgagatatctcgtgaccggcgattatagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77142 - DNA, 730 bp, Homo sapiens
gctcggactcctgttgcatttactttcttgtactgtgtgctaagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77143 - DNA, 723 bp, Homo sapiens
  misc_feature (34)..(35): n is a, c, g, or t
  misc_feature (37)..(37): n is a, c, g, or t
tgggccccgtgtttatcatgcagtattgatcagnncnggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77144 - DNA, 1058 bp, Homo sapiens
gggggcgagaaaacaaatctacggctaggtgcgaggctgggtggtgcgccgctggcgagcgcgtggagggcccggcaggcctggcgcgccttgggccacgcgtgcgcgcctccgccgctggagctggatggctgatgcggctcgtggtccgagagccttgtcctgccgtgtgggccttgcggacctgggagctggtgggcgttgggaaccgggcttaagctactgaggcgtttgctgatttcgtccatccaggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctggctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77145 - DNA, 854 bp, Homo sapiens
aaaatataggctaggtagaggctggttcgaatcggccgaggcaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctggctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77146 - DNA, 836 bp, Homo sapiens
cggacgcgtgggtcgaacgctgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctggctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77147 - DNA, 1001 bp, Homo sapiens
ctctgtggaaacatcagttcgcatggccattccggcagcctgtggatgctgtcaaactgggtctaccgattcccacctcgggttgggagaggaccacggtggccaaaattcttagcttcttcctttccctcatgcagcccatggatagccagccccagagattcccacctcgggttgggagaggaccacggtggccaaaattcttagcttcttcctttccctcatgcagcccatggatagccagccccagaggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77148 - DNA, 1070 bp, Homo sapiens
  misc_feature (53)..(53): n is a, c, g, or t
  misc_feature (58)..(58): n is a, c, g, or t
  misc_feature (78)..(78): n is a, c, g, or t
  misc_feature (116)..(116): n is a, c, g, or t
  misc_feature (120)..(120): n is a, c, g, or t
  misc_feature (136)..(136): n is a, c, g, or t
  misc_feature (160)..(160): n is a, c, g, or t
  misc_feature (169)..(169): n is a, c, g, or t
cattctatttccccctctattgatccccacctccaaatatctcatcaacaacngactnatcaccacccaacaatgacnaatcaaactaacctcaaaacaaatgatagccatacacnacantaaaggacgaacctgntctcttatactagtatccttaatnatttttatngccacaactaacgtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggggtaataacttagggtcatttgaattctggtcctttctttttttggagggttcaagatagtgtgagagggataatttttatttgttgttttttttttaacagaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77149 - DNA, 1182 bp, Homo sapiens
gggggcgagaaaacaaatctacggctaggtgcgaggctgggtggtgcgccgctggcgagcgcgtggagggcccggcaggcctggcgcgccttgggccacgcgtgcgcgcctccgccgctggagctggatggctgatgcggctcgtggtccgagagccttgtcctgccgtgtgggccttgcggacctgggagctggtgggcgttgggaaccgggcttaagctactgaggcgtttgctgatttcgtccatccaggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctggctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgaccaaaagaacacaaacgcaccggtctgaggagagcaaggcgacaacgcaacgccgtcgacggatgcacacgccaagacgcgtcaggcacgagaccacacacaaagaaagcggggggcgacaaacgcagcggggacaagccgacccccgtagaaagaccactgggattaaccgcggcccgcaccacaggagacagacgggcgtaggacacactgtgggggagccc

SEQ ID NO: 77150 - DNA, 575 bp, Homo sapiens
ccgcctactactactaaattcgcggccgcgtcgaccaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77151 - DNA, 504 bp, Homo sapiens
  misc_feature (485)..(485): n is a, c, g, or t
gcccagtttgagcctgactctagaggatcccccaggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctggnatcctctgagatcacctca

SEQ ID NO: 77152 - DNA, 729 bp, Homo sapiens
  misc_feature (488)..(488): n is a, c, g, or t
gcccagtttgagcctgactctagaggatcccccaggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctccaggngcttgtggggccctgtgaaggtggtggtagcagagaattttgatgaaatagtgaataatgaaaataaagatgtgctgattgaatttcacgccccttggtgtggtcattgtaagaacctggagcccaagtataaagaacttggggagaagctcagaaaagacccaaatattgtcataggcaagatggatgccacagccagtgatgtgccttctccatatgaagtcagaggtttcctaccata

SEQ ID NO: 77153 - DNA, 884 bp, Homo sapiens
  misc_feature (490)..(490): n is a, c, g, or t
  misc_feature (501)..(501): n is a, c, g, or t
  misc_feature (505)..(505): n is a, c, g, or t
  misc_feature (507)..(507): n is a, c, g, or t
gcccagtttgagcctgactctagaggatcccccaggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgcagcagnagcagcagcancagnancagcagcagttcgtccggaaccaaaccttctacctcctttgagcccatcaaggcagacccacaggtggtgagtacctgccccctgggggcagagagagagagtctagcctcagtccagtcctaggtcagaaaacagaattggggatggaacccagatctcctggtcaaaccctgatgggacacgagagctcatcatgcagcaccttctggggttcagtgctggttggcccactataggcacaccaattcctagggataacacagaaactccactgccgtattcttcaagccctttacctgcacaacccttggaagcaacgactcacttaattgacacttctactgtattaactctctctcatctaatatgaatacct

SEQ ID NO: 77154 - DNA, 731 bp, Homo sapiens
gcccagtttgagcctgactctagaggatcccccaggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctccaggcgcttgtgggagacactaatggcccaggcgagtttattgataattttgatgtaacagagcaccggagaaattacccccacgtccaaaatgtcaactctgagaagaaccaggttcagagactcacgaccccacgacgcatgacactgcggtgggtctggaaggaccgcaacaacaatgtgacttactgtgtttgatatactcggtagccgggaactgaaatagaaagagcgtgtcagtgaaggta

SEQ ID NO: 77155 - DNA, 785 bp, Homo sapiens
gcccagtttgagcctgactctagaggatcccccaggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctccaggcgcttgttggtatcagtcagtgctctgactcttgcaactgaaactgttcggagcattctgaaaatagatgatgtggtaaacactcgataatctggataactgactagcaccattatgatcaccagtattgtggctggaatggaagaagatcaccttgttgttccttgtttggaagattatttcctctgaatttctgggcttggtcttccagttggcatttgcctgaagttgtattgaaacatttaatgaaaatattaaatatttggtttcaagggcagatttatcttctcccactacg

SEQ ID NO: 77156 - DNA, 765 bp, Homo sapiens
  misc_feature (489)..(489): n is a, c, g, or t
  misc_feature (504)..(504): n is a, c, g, or t
  misc_feature (507)..(507): n is a, c, g, or t
  misc_feature (514)..(514): n is a, c, g, or t
  misc_feature (520)..(520): n is a, c, g, or t
  misc_feature (552)..(553): n is a, c, g, or t
  misc_feature (563)..(563): n is a, c, g, or t
  misc_feature (591)..(591): n is a, c, g, or t
  misc_feature (606)..(606): n is a, c, g, or t
  misc_feature (615)..(615): n is a, c, g, or t
  misc_feature (620)..(622): n is a, c, g, or t
  misc_feature (626)..(626): n is a, c, g, or t
  misc_feature (632)..(632): n is a, c, g, or t
  misc_feature (641)..(641): n is a, c, g, or t
  misc_feature (652)..(652): n is a, c, g, or t
  misc_feature (687)..(687): n is a, c, g, or t
  misc_feature (751)..(751): n is a, c, g, or t
gcccagtttgagcctgactctagaggatcccccaggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctcgcgcancagcaacagcagcancanccaacancaacancagcaacaccaccacactaaagggcatacatnncctgctttcnccaattaaccactgaattgctatttttnccttttggccagatngctaggtcnctggnnncccngcagtnggtgttttnacataagattngggtccttttggaaagaatagttgcagtgtttatnggatagttgtggtaagaatctagtttattttgcatttggctaattaggtctgtgctgcctggtnctaaactcaacccc

SEQ ID NO: 77157 - DNA, 735 bp, Homo sapiens
ccacgcgtcgcggacgcgtgggtcgacccacgcgtgcgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacc

SEQ ID NO: 77158 - DNA, 1317 bp, Homo sapiens
  misc_feature (421)..(421): n is a, c, g, or t
  misc_feature (433)..(433): n is a, c, g, or t
  misc_feature (456)..(456): n is a, c, g, or t
aatcttgtgtgacactctgcgagcactatctcactactactctgatgggatacctgtcgacgggttgtttaccgaccttgggtgggtctcctctcccatttgtgttgtccccatgtatgcggcctgagaccaatgtcccgcctatgtggttgaacccacgtcttttcccccttgcgagccctcagggatggcacaccagctgtggacctccccggccggtgcggccttttctgggtccccacgtatatagcccatcggggcattccgtggagcttgcgggctcttcagaatcctgaggagtacctgatcctcaggagcaccagtacagcgcccagaccagtagagacccggtagtcagaggcgcaggggagcatcctgggtttgggcccgcgacacccccgcggcccgcgctctgcgctcngctggcttggcnatgcctgcgggcagacggacggncggacggcacagctccctgggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctcacaacaacgaactaaacacaaaacaacacaaccaccaacaccacagaaaaccaccacgcaagaccccccaagcaaagaccagggaacaccccagagacagggagggacacacccaccacagaaaacatgcgcacacccggacaccgaagc

SEQ ID NO: 77159 - DNA, 385 bp, Homo sapiens
  misc_feature (8)..(8): n is a, c, g, or t
  misc_feature (30)..(30): n is a, c, g, or t
agggcganagccctgggatgcaccggccanaggccatgctgctgcgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77160 - DNA, 357 bp, Homo sapiens
  misc_feature (1)..(1): n is a, c, g, or t
ngaggcagtgaatcgagctcgtgtaccatctcgtgaccggcgattatagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcgccggtcacgagatggtccggctt

SEQ ID NO: 77161 - DNA, 288 bp, Homo sapiens
ccacgcgtcgcggacgcgtgggtcgacccacgcgtgcgccaacatggctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacc

SEQ ID NO: 77162 - DNA, 420 bp, Homo sapiens
  misc_feature (25)..(25): n is a, c, g, or t
  misc_feature (54)..(54): n is a, c, g, or t
atgacctttttaactgtccttcagncttaaacgttaaaaagcactgtcaggccnagcccccccttaggcttgaaagtatgtcccctgatgagcagaactcccagacacccatttctgacccaaactcaaatgatggtcagtcagatcccctccctaattcttcaaactcagttgtgccgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacc

SEQ ID NO: 77163 - DNA, 761 bp, Homo sapiens
ggcggtgcgttcttctacacatgcgcagggttgggcgggtcttcttccttctcgcctaacgccgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacc

SEQ ID NO: 77164 - DNA, 819 bp, Homo sapiens
ggcggtgcgttcttctacacatgcgcagggttgggcgggtcttcttccttctcgcctaacgccgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgaccaggggatctaaaaaagtgggtttttttgcccgctttgcggcccatttctctttctctt

SEQ ID NO: 77165 - DNA, 482 bp, Homo sapiens
  misc_feature (477)..(477): n is a, c, g, or t
ggcggtgcgttcttctacacatgcgcagggttgggcgggtcttcttccttctcgcctaacgccgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaaaaaaaaaaaaaaaaacactttggggggcgcccgggcccggaaaaagtttttnaaacc

SEQ ID NO: 77166 - DNA, 952 bp, Homo sapiens
ggcggtgcgttcttctacacatgcgcagggttgggcgggtcttcttccttctcgcctaacgccgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatcaaaaaaaaaaaaaagaaacaaagggggggggaataaagagtactcggaggggccaattaagggcaaacacaatatagtgagaaagggggcacta

SEQ ID NO: 77167 - DNA, 866 bp, Homo sapiens
  misc_feature (330)..(331): n is a, c, g, or t
  misc_feature (349)..(349): n is a, c, g, or t
gcttctcgcctaacgctgccaacatggtgttgtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggannagccaagatgacagattntgatccgtctacaaggttatgcacagggcaaagcacacatgaggcaacaggaacatcactccaaggaattgcacacgttacgcaagcctttcaaacagggccaggctctccctgtaaaggctttctcccaaagaaaagcaccctgggtaactaaaggggtaacttgactgctgagatgcctgactgcttgcttgccttgctgccttacacggttccagacgaacacacagcattcaccggcacgccaacgttacagaaggggctcgcaaggcccaggcaagggttccctgtcccagaatcggcccctcaggcccagaaatacgacgccgccctaggctcccaaacaagggctcacgacatcgggcgcgcaaaagacgacgtccacaggcgccaaggaaagcgcacccaggtccccaaaggagctcgttcggggcagaaagcacaggcataaagtttgcgagactcactttcagcccaggttcatacaaaagggtcactcatttggaacctagttcgg

SEQ ID NO: 77168 - DNA, 684 bp, Homo sapiens
  misc_feature (330)..(331): n is a, c, g, or t
  misc_feature (349)..(349): n is a, c, g, or t
gcttctcgcctaacgctgccaacatggtgttgtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggannagccaagatgacagattntgatcgttttagacagttatgaaggggatatggatagtgtgtggttctcttaaggaattttggggcaggtgatccactaataatttttaaatactatgggaaagtggcagagggaccggaagtgggctttaaagatcgtgaaggggatttcttcatgaggagtagggtggcgtaatcatcaaggttggggattctcacactacaagaaagatgtcgtccggcgaggaaccccgcgcgttccgtagcgagcacccacttggggccactggagggcccttgacgggagatccgatcaccagggtgttgctgcgagaactcttgtcaattgtccccgc

SEQ ID NO: 77169 - DNA, 1263 bp, Homo sapiens
  misc_feature (421)..(421): n is a, c, g, or t
  misc_feature (433)..(433): n is a, c, g, or t
  misc_feature (456)..(456): n is a, c, g, or t
aatcttgtgtgacactctgcgagcactatctcactactactctgatgggatacctgtcgacgggttgtttaccgaccttgggtgggtctcctctcccatttgtgttgtccccatgtatgcggcctgagaccaatgtcccgcctatgtggttgaacccacgtcttttcccccttgcgagccctcagggatggcacaccagctgtggacctccccggccggtgcggccttttctgggtccccacgtatatagcccatcggggcattccgtggagcttgcgggctcttcagaatcctgaggagtacctgatcctcaggagcaccagtacagcgcccagaccagtagagacccggtagtcagaggcgcaggggagcatcctgggtttgggcccgcgacacccccgcggcccgcgctctgcgctcngctggcttggcnatgcctgcgggcagacggacggncggacggcacagctccctgggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77170 - DNA, 833 bp, Homo sapiens
ccacgcgtcgcggacgcgtgggtcgacccacgcgtgcgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77171 - DNA, 1134 bp, Homo sapiens
ggcttctggctgccgccggccccccgcgaacgggctgcggggcaggagtggcgctgctgctccgactttccccggacttcgaggctcccgggacctggtagcgctctgggtctccggcggagaacaggcgcctaatctggcgagaaggaactcaggccgagccctccggcctcccgcaggaccctgtcacgtggattgctgggggatggcgttgaggaggaggtcagaagttgagtagcaggggcctaggagggctcgaagccttcacagcgatggcagagaagcgacccctgagaaccctggggcctgtgatgtatggcaagctgccccgcttagagacagactccgtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77172 - DNA, 918 bp, Homo sapiens
  misc_feature (39)..(39): n is a, c, g, or t
agcggcgccaggaaattgaacaaaaacttgaagttcagncagaagaagagagaaagcaggttgaaaatgaaaggagagaactgtttgaagagaggcgtgctaaacagacagaactgcggcttttggaacagaaagttgagcttgcgcagctgcaagaagaatggaatgaacataatcgccggtcacgagatatctcgtgaccggcgattatagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77173 - DNA, 707 bp, Homo sapiens
gttcagcagcagccagagttgggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatca

SEQ ID NO: 77174 - DNA, 1260 bp, Homo sapiens
gggggcgagaaaacaaatctacggctaggtgcgaggctgggtggtgcgccgctggcgagcgcgtggagggcccggcaggcctggcgcgccttgggccacgcgtgcgcgcctccgccgctggagctggatggctgatgcggctcgtggtccgagagccttgtcctgccgtgtgggccttgcggacctgggagctggtgggcgttgggaaccgggcttaagctactgaggcgtttgctgatttcgtccatccaggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctggctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacctgttgacaaatgtatttaagcctttggatttaaagcctgttgaggctagagttaggaggcagattgatagtaggattataataaacattaaataatcacaaacaaaaaaaaaaggggggggtaaaatatcctcgggggcaagttacgcgtaccagtttttgtaaaagggccctatgggggtgaataagaaggagggcggtaaacacgtggatgaacggctgtggatttggaaggcctcttgggtggattggcatcacagtaagttggaataattgtaggtaagttcggggtgtgtattaa

SEQ ID NO: 77175 - DNA, 960 bp, Homo sapiens
gggggcgagaaaacaaatctacggctaggtgcgaggctgggtggtgcgccgctggcgagcgcgtggagggcccggcaggcctggcgcgccttgggccacgcgtgcgcgcctccgccgctggagctggatggctgatgcggctcgtggtccgagagccttgtcctgccgtgtgggccttgcggacctgggagctggtgggcgttgggaaccgggcttaagctactgaggcgtttgctgatttcgtccatccaggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctggctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacc

SEQ ID NO: 77176 - DNA, 1164 bp, Homo sapiens
gggggcgagaaaacaaatctacggctaggtgcgaggctgggtggtgcgccgctggcgagcgcgtggagggcccggcaggcctggcgcgccttgggccacgcgtgcgcgcctccgccgctggagctggatggctgatgcggctcgtggtccgagagccttgtcctgccgtgtgggccttgcggacctgggagctggtgggcgttgggaaccgggcttaagctactgaggcgtttgctgatttcgtccatccaggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccagaagtatgtccgacaagcctggcagaaggcagacatcaatacaaaatgggcagccacacgatgggccaagaagattgaagccagagaaaggaaagccaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctggctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggcaatcataaaaagtaataaaggttctttttgacccaaacaaacacaaacataaaaaaaaactgaaacaaaaaaaaaaggggggggggcgaaaaaaatttctcagggggggcccaaatttagggcaacccgttttttgtgtaaagggggcccaaatgagggggattataaagagcggcaggggcgggtaaaaaggggtgtgggaaacgcgtcgtggttgtgggagagagaccatggggg

SEQ ID NO: 77177 - DNA, 641 bp, Homo sapiens
tccaaaggttaagggtgctgtcagaagttgaaaatttcttcttagtgaggcatgttggctcacaaatataatccgagcactctgggaggctgaggcagaaggatagcttgaggctaggagttcaagaccagcctggataacatagcaagaccctatctctacaaaaatgtttgtaaaaagaaatagccaagtgtggtggcacgtgtctatagtcccagctgctcaggaagctgaggcaggaggattgcttagtctgggtgttcaaggctgcagtgagctatgatcatgccgctgccctccagcctgggcaacagaacaaaactctatctaaaaaaaaaattttaaatataattaataaatattttaaaacataaaatttcttctttcctatgtgtgtcttcaccgtatacctcccaaagtgctgggattacaggtgtgcaccactgtgccaggcctcaaagcttatattctaattagaggagggattcaagtaaatcattgaaggtaatgctgaaaggctggcagtaccatttttgcttttttggagattgtatatttgattacatttacctttatttttctgattgtactcttggatcaggagctgaaactactagaatttaagacaaaacaaactatag

SEQ ID NO: 77178 - DNA, 735 bp, Homo sapiens
  misc_feature (14)..(15): n is a, c, g, or t
  misc_feature (25)..(26): n is a, c, g, or t
  misc_feature (71)..(71): n is a, c, g, or t
  misc_feature (76)..(76): n is a, c, g, or t
  misc_feature (93)..(93): n is a, c, g, or t
  misc_feature (170)..(170): n is a, c, g, or t
  misc_feature (229)..(229): n is a, c, g, or t
  misc_feature (330)..(330): n is a, c, g, or t
  misc_feature (339)..(339): n is a, c, g, or t
  misc_feature (604)..(604): n is a, c, g, or t
ggctctcagtcccnncctcacgggnngtgcctccccccactgcgatgggggtcctaagagccaggggggangaggngctggctctcagtcccntcctcgcggggggtgcctcccgcctctgcgatggggctcctaagagccagggggggaagacgggctcgctctcagtngccgcctcgcggggggtgcctcccgccctgcgatgggggtcccaagagccgggggggangaggggctggctctctgtactcgcctctcgatgggtgcctccccgcctgcgattggggtcctaagagccagggggtaagagggcctagctctgagtccctncctctcggngggtgcctccccaccctgcgatggcggtcccaagtgtcagggggggaagagggggtggctgtcactcctcggctcgtggaggctgtctcccaccactgcgatgggggttctaagagccaggggggaagaggggctggttctcagtccctgcctcagtgggggtgcctccccctctgcgatgggggtcctaagagccagcggaggaagaggggctggctctcagttcccgccttttttttttttctcagtgttttagacgcccagntgcacaacttgattgccttacaaatgacctgcttccaggatgcggaaattcctaatttcttctgtgacccttctcaactcccccatcttgcatgttgtgacaccttcaccaataacataatcatgtatttc

SEQ ID NO: 77179 - DNA, 782 bp, Homo sapiens
cgcaaacttggtttcactggatccactcctattggcaaacagatcatgaagagctgtgctgttagcaacttgaagaaagtttcccttgagcttggtggcaagtctccacttataatatttaatgactgtgaacttgacaaggctgtgcgaatgggcatgggagcagtatttttcaacaaaggagagaactgtattgctgctgggcggttgttcgtggaagaatccatccacgacgaatttgtgacaagagtggtagaagaaattaaaaagatgaaaattggtgatccacttgacagatccactgatcatgggccccaaaatcataaggctcatctggaaaagctgctgcaatactgtgaaactggagtgaaagaaggggccactttggtgtacgggggaagacaagtccaaaggccaggctttttcatggagccgaccgtgttcacagatgtggaagactacatgtacctcgccaaagaggaatcctttgggcctattatggtcatttctaaattccaaaatgggtaggttcttcagacacaatgtaacttaggttttgactagataagtcatttttcccctttgccactctgctatatacacagcataagattaatgaacatgtaattttctaccataagaataattaacttaaataattagaagttacgcttttgctaaccatcgtagatcatagtatatttttgcttttcagcttcaattaatggccaacataatgggcttttagctgaataaattttagtttttctgcacttgaaatt

SEQ ID NO: 77180 - DNA, 1759 bp, Homo sapiens
  misc_feature (7)..(7): n is a, c, g, or t
  misc_feature (16)..(16): n is a, c, g, or t
  misc_feature (35)..(36): n is a, c, g, or t
  misc_feature (40)..(40): n is a, c, g, or t
ggcgccnccccggccnccctagcaccccggcctcnncatnagaggcgggagacccggagcagcagcagaggcaggaggactaggaggaggaggaggagccgtcgcaggatgaaggatcggactcaagagctgcggagtgcgaaagacagtgatgatgaagaggaggtggtccacgtggatcgggaccacttcatggatgagttctttgaacaggtggaagagatccggggctgcattgagaaactgtcggaggatgtggagcaggtgaaaaaacagcatagcgccatcctggccgcacccaacccagatgagaagaccaaacaggagctggaggatctcactgcagacatcaagaagacggccaacaaggttcggtccaaattgaaagcgatcgagcaaagcattgaacaggaggaggggctgaaccgttcctccgcggacctgcgcatccgcaagacccagcactccacactgtcccggaagttcgtggaggtaatgaccgaatataacgcgacccagtccaagtaccgggaccgctgcaaggaccggatccagcggcaactggagatcactggaaggaccaccaccaacgaagaactggaagacatgctggagagcgggaagctggccatcttcacagatgacatcaaaatggactcacagatgacgaagcaggcgctgaatgagattgagacgaggcacaatgagatcatcaagctggagaccagcatccgcgagctgcacgatatgtttgtggacatggccatgctcgtagagagccagggagagatgattgaccgcatcgagtacaacgtggaacattctgtggactacgtggagcgagctgtgtctgacaccaagaaagcagtgaaatatcagagcaaggcccggaggaagaaaatcatgatcatcatttgctgtgtggtgctgggggtggtcttggcgtcatccattggggggacgctgggcttgtaggccccccccacccttctctctcccagacccttcccccaccacatcgggagcaatacccccaccacccctttcactccatcccctgctccaggctcactcccaaaacagacccaggcagccccacccctcctccacccccacggcagaccctggtgtccctggacctcaccgggccatggacccccccccgtccccgcacgtagatcgcagcaggcgtgattacacatgcacaccaacatgcatgccgccggcacatgctcgagacgtgtggacaccccagcgtgcgtgtgcgtgtgatgtgtgtgatgcaccagagcaccccctccacccccaccttgggtgtgtgtgcgtggtctgagcttcccccttcaccggggctgttgtgtagactgcagccaagtgtaacacagcagtccatcacgccctctctgtcctctgtgaacagtgtgtgtgcgtgcgtgagaccacagatctgtggacacaccatttgtgtacgtggaattttgtgtttcagtgtttgaacctaatgcaacagcaacaaagccactgatacctgagccctttgtgtctgctacaaaccaggcaggtggtgtgtgtggactcacactcacattctcagaggatccagggaggcccaggtacacacaggccatggcagacaccccatgtctttgttaccccaggggctgtggcatgtcccaggagggtgtgcatgtgtgtgtgtgtgtgtgtgtgtgtgtccaggatgtgcctgaagtattgataggtcttctcagatagagcc

SEQ ID NO: 77181 - DNA, 1132 bp, Homo sapiens
  misc_feature (7)..(7): n is a, c, g, or t
  misc_feature (16)..(16): n is a, c, g, or t
  misc_feature (35)..(36): n is a, c, g, or t
  misc_feature (40)..(40): n is a, c, g, or t
ggcgccnccccggccnccctagcaccccggcctcnncatnagaggcgggagacccggagcagcagcagaggcaggaggactaggaggaggaggaggagccgtcgcaggatgaaggatcggactcaagagctgcggagtgcgaaagacagtgatgatgaagaggaggtggtccacgtggatcgggaccacttcatggatgagttctttgaacaggtggaagagatccggggctgcattgagaaactgtcggaggatgtggagcaggtgaaaaaacagcatagcgccatcctggccgcacccaacccagatgagaagaccaaacaggagctggaggatctcactgcagacatcaagaagacggccaacaaggttcggtccaaattgaaagcgatcgagcaaagcattgaacaggaggaggggctgaaccgttcctccgcggacctgcgcatccgcaagacccagcactccacactgtcccggaagttcgtggaggtaatgaccgaatataacgcgacccagtccaagtaccgggaccgctgcaaggaccggatccagcggcaactggagatcactggaaggaccaccaccaacgaagaactggaagacatgctggagagcgggaagctggccatcttcacagatgacgtgagccgcgggtggggcgggctctgcttttggaaaatttttgcctcccctccctaagttcaggttgaactaaggtcctaagtccaccctggaaaaatgagcagcgggaagcctgagccgggaactggggaattccatgggagcggagcaggaaggcacccccatcagatgacggagtcgttcgtgtgccaggcactgttctaagcactttccatcttcacattcacccaccaactcatttaatactcacacatccccttcgaggaaaccccatttcacagatgaggaaaactggcccagagagatgaaatcacttggcaagatctcagagcgagggagagggccaggacttgaatcctgtctagtttcagagtcagaactctcgagccctaggatacacgacatactctgctactgaagcaagtcgtttcaccagagaactgatttgcctacattaaaagaaattttttttaattaaaaaaaactt

SEQ ID NO: 77182 - DNA, 642 bp, Homo sapiens
gagaattcaaggaatttcagagccaagagaaaaggggtttatgtttgtaaacaaaaactcataaatgtgtatgtttgaaaagccaaaaataaagcacactatattccactaagtgaaactgttactcccttgggcagtcttctgggtcttccacccactcttcagacaaatcactggtctcttctattctcatttcctgtttcttatctggagtctggcagataaaagggttctacattcacaccctagatctacttcatgctatccatccttcttctagaaaatggctagcattagggggtccttttcctatttgtccaagagaaaaatttgtaagagattacctccttttcttgctttggaattctctgtcccattccgaaactgttgaaatttgaatatgatcactggagaagtgaatcattccatgggactttactaaaacctacccaaccacaggtccccacttgtgggggtacaggctaggtttgaccaatgaacacacaactacaaatgtgaaaaagacacttttccagacagtcaactggatgccatattggaatggcttgtgatatctgtagtccttggttttgaaaaatttccacagtaattagtgttattttatgacctttctggagtaga

SEQ ID NO: 77183 - DNA, 588 bp, Homo sapiens
gagaattcaaggaatttcagagccaagagaaaaggggtttatgtttgtaaacaaaaactcataaatgtgtatgtttgaaaagccaaaaataaagcacactatattccactaagtgaaactgttactcccttgggcagtcttctgggtcttccacccactcttcagacaaatcactggtctcttctattctcatttcctgtttcttatctggagtctggcagataaaagggttctacattcacaccctagatctacttcatgctatccatccttcttctagaaaatggctagcattagggggtccttttcctatttgtccaagagacgaaactgttgaaatttgaatatgatcactggagaagtgaatcattccatgggactttactaaaacctacccaaccacaggtccccacttgtgggggtacaggctaggtttgaccaatgaacacacaactacaaatgtgaaaaagacacttttccagacagtcaactggatgccatattggaatggcttgtgatatctgtagtccttggttttgaaaaatttccacagtaattagtgttattttatgacctttctggagtaga

SEQ ID NO: 77184 - DNA, 2577 bp, Homo sapiens
ccgggacagcgagcggcggctcacctgggagagcaaagcgtggctctcctgcgcccactcgggagaaggagcggatccacttaggtcagcggttaaaacgtcgttacaagaggccaccccggcatcgcggggcctgtggctgcgccccctcttgaattcaggcctagcacatcacctccgcccctcgcaccctgcagtctgcgctccatacagcacgtgagcgggtgctcagcaatgttccctggctgaaagaaccgcatagagtagcatgcaaaaatgacatgcatgtttaagataaaataagggagaggacacctgttctgactgagtctggcaactcagatctccccgcagccaacatctacattcctttggacagctgtctgctgtgtagggacacctccctggaactttgaaaagcaccccatcattaccttccactttgttctggagcaaggtttcaaaagaagagtgccgtattttgattaatttagtgaattggattttcagacacaagtaagagcatccactcagtggcctctgcagtaaataatgatatcagatcacataacaagaagactggaggttggcgggaaatctggacctggtgactcaaagaagtcatgaaggaccatctctccattctgccaccttctcgcctgtggattttcctccccaggcttgtcacttcattgtcgagagatgccctcacaatccaagccaggcagcctcacatgaccagatctaaaacacaaagagggagccaaactgagaaaggaccttttccctctgaacacttctctcttggaaaaagaaaatgtttcccagaaagcctcatagccttcctcttatatctccttgactaactgggacccggatccctggatatcctttcctgagaaagagagggtctggggcaggggatagagaaaatgactagcaactagcagcacatgatgtttaaacataagatttaaagaaatgcaaggcacaaacaatttgaagactttttttaagtttttaaaatcttcacaaaataaaaaggaattggacaatgcactttaaaaactagaagacgtttcactgaaaacagcatctcctaattcatttcatggcttagatagtaatagaaaattattttattctaattccatactttatcaactaattttaattattttataattacccaaaatatgtcatgtagaatgaaaataaaagaaaatgaaaacagttatatcaaggccaagtcagttgtatgtttactggctatttagaaatttctaaatacgtgtatatttagaaatgactatatagatactatttgggtaatgttagggatggaaagtttatgtccccccaaaatttgtatgttgaaatcctaagcccaatgtgatggttttaaggggcggggcctttgtgaggtgattaggtcatgagagtggagacttcatggatgagaatagtaagtatccttataaaagagactccagaggctgggtgcagtgtctcatgcctgtaatcccagcactttgggaggccgaggcaggtggatcgcctggggtcaggagttcgagaccagcctggccaacatggcaaaaccctgtctctactaaaaatacaaaaattagccaggtgttgtggtgggcacctgtaatcccagctacttaggaggctgaggcctgagaattgcttgaacccaggaggtggaggttgcagtgaactgagatcgcgccactgcactccagcctgggggacggagtgagactgtctccaaaaaataaaatacaataaaagagactccaaagaactttctagccctcttgccaccacctaaggatgcaaagagttgacagcaacctggaagagccctcaccagaactcgaccattctggcactctgacttccagcctccactgtgagaaataaatttctattgtttatgagccactcagcatatggtactttgtagccctagacaggctaagacaggtaattagcaattttaggtgattttcatcatcaaaattttcatgatggcattttggagaattcacataaaccactctgttaccctcctaaaagtattgctcaaatactgaattatatttatgcttgccaaagttaatttttttccaacaagtaacactagccacttcattttgtgcttttgatacaaaagcatttcccaatccagcggctttcatcttctggcctggttggcaaaagtgtaactcacttcggcaccctctctgaaccctagtctcctcctcaaatgtaaaacagtaataaacctttcttacccaggaagccattataaggattataatcaacataagatataattctttaattatcaaagcagttgctggcatgtggcaggcattcaacagaaaccgtgttgctatgttatttttattgttaccattaatattcctattgggattgaaacccttatgtcatatcaaaacttttccatctttgacaaatgagacatattaggatagtatcttaataatatgtaagagtttagtgcttgagctattcaattattaaactttgcttccaagaaacaga

SEQ ID NO: 77185 - DNA, 616 bp, Homo sapiens
tgttctataaacgcttattacatcattgtgcataggcttcatttttaaaagtactcccaaataaatacaaggaggcgatggaaattgaatgaagattcgaaggattcccatagagcgtggctcacttcccctcaccgggacagcgagcggcggctcacctgggagagcaaagcgtggctctcctgcgcccactcgggagagcaaacaatggctcacctgcgcccacccgggagagcaagcgtggctcacctgcgcccactcgggaaagccagccgccatcctgtgctgcaggcagggagcgggcggcgggagaggagcggatccacttaggtcagcggttaaaacgtcgttacaagaggccaccccggcatcgcggggcctgtggctgcgccccctcttgaattcaggcctagcacatcacctccgcccctcgcaccctgcagtctgcgctccatacagcacgtgagcgggtgctcagcaatgttccctggctgaaagaaccgcatagagtagcatgcaaaaatgacatgcatgtttaagataaaataagggagaggacacctgttctgactgagtctggcaactcagatctccccgcagccaacatctacattcc

SEQ ID NO: 77186 - DNA, 937 bp, Homo sapiens
acgtcacaggacgcgcccgcttctcgctggagtgcgcaccgagcggcagtgacttcgccgctgctgtagttccccggctggatgcggtgactggtgccagtgctcaggcgcccgctgcccttgacctcccgccccgcgagccctaactcagcgcaggaggaccggctgccgccgccgccgccgccagcagagccaagcacagtgggaactttcagaaagcactggttgaaggaacgctggaatccctgggacttactgcgtagcatgtagtagttgctcctctacaaaagtttcaccttatgaagtatagcaggctctgatgctggtgtctggtagaagaagattactcacagctctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccaaagacgatgacgcagttcctagagcagggagaggccaccctctcagtggcaagaagagccttggctgcccagttgccagtcctaccatggtcggaggtaaccttcctggctccagtcacatggccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggtcagtgcctccccactgccctccctagtcactgggcccatcacaagggcattctgagctcagtattgagcctactggagccacctctcgctcagtagtgcattcaacagaaactctacaggattatacacacagtagtaacactggccttggaaa

SEQ ID NO: 77187 - DNA, 1517 bp, Homo sapiens
acgtcacaggacgcgcccgcttctcgctggagtgcgcaccgagcggcagtgacttcgccgctgctgtagttccccggctggatgcggtgactggtgccagtgctcaggcgcccgctgcccttgacctcccgccccgcgagccctaactcagcgcaggaggaccggctgccgccgccgccgccgccagcagagccaagcacagtgggaactttcagaaagcactggttgaaggaacgctggaatccctgggacttactgcgtagcatgtagtagttgctcctctacaaaagtttcaccttatgaagtatagcaggctctgatgctggtgtctggtagaagaagattactcacagctctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccaaagacgatgacgcagttcctagagcagggagaggccaccctctcagtggcaagaagagccttggctgcccagttgccagtcctaccatggtcggaggtaaccttcctggctccagtcacatggccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggccacagatgccatggcccacgtggccggcttcactgtggctcatgacgtgagtgctcgtgactggctaacaagacgcaatgggaaacagtggctgctgggaaaaaccttcgacaccttctgccctctgggccctgccttggtgaccaaggacagtgtagcagatccacacaacttaaagatctgctgccgagtgaatggggaagtcgtccagagcagcaacaccaaccagatggtattcaagacagaggacctgatagcctgggtctcccagtttgttaccttttacccaggggatgtcatcctaactgggacccccccaggtgtcggtgtattcaggaaacctcctgtctttctcaagaagggggatgaagtccagtgtgagattgaagaactaggtgtcatcatcaacaaggtggtgtgatggctcctgcacaggcccgacataggatgagggcatctgctcccactcagcctagcccagggaaaggcccagtggcaggtgtgggcaggtgccagccctgcaagccgcctcttctcggtagaagggagaaggacagagctctcttcaataaatgcgtcgggtcaaaaaaacaaacaatcaaacactacaacaaacaaaaaaaaatttggggggaggcccgcgcccgaaaatttttataacaacactgtggggg

SEQ ID NO: 77188 - DNA, 1707 bp, Homo sapiens
acgtcacaggacgcgcccgcttctcgctggagtgcgcaccgagcggcagtgacttcgccgctgctgtagttccccggctggatgcggtgactggtgccagtgctcaggcgcccgctgcccttgacctcccgccccgcgagccctaactcagcgcaggaggaccggctgccgccgccgccgccgccagcagagccaagcacagtgggaactttcagaaagcactggttgaaggaacgctggaatccctgggacttactgcgtagcatgtagtagttgctcctctacaaaagtttcaccttatgaagtatagcaggctctgatgctggtgtctggtagaagaagattactcacagctctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccaaagacgatgacgcagttcctagagcagggagaggccaccctctcagtggcaagaagagccttggctgcccagttgccagtcctaccatggtcggaggtaaccttcctggctccagtcacatggccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggtgaggtggaaagggtgggctcccaggccagagtgcagcagaggccccagctcctgcctctcctagttctgacctcactcaccgacacatggcaccagctgtccctgacactaggaagcagtcagcctccttgctccctgacactgcctttcccttcacccacctttggctggctctggctactaacatgggataacagctttgagatcccttgccacaggtgttggtgtcacccgtgatctaacctcctgtatggccaaatcccctgcccccataggccacagatgccatggcccacgtggccggcttcactgtggctcatgacgtgagtgctcgtgactggctaacaagacgcaatgggaaacagtggctgctgggaaaaaccttcgacaccttctgccctctgggccctgccttggtgaccaaggacagtgtagcagatccacacaacttaaagatctgctgccgagtgaatggggaagtcgtccagagcagcaacaccaaccagatggtattcaagacagaggacctgatagcctgggtctcccagtttgttaccttttacccaggggatgtcatcctaactgggacccccccaggtgtcggtgtattcaggaaacctcctgtctttctcaagaagggggatgaagtccagtgtgagattgaagaactaggtgtcatcatcaacaaggtggtgtgatggctcctgcacaggcccgacataggatgagggcatctgctcccactcagcctagcccagggaaaggcccagtggcaggtgtgggcaggtgccagccctgcaagccgcctcttctcggtagaagggagaaggacagagctctcttcaataaatgcgtcgggtcaaa

SEQ ID NO: 77189 - DNA, 1304 bp, Homo sapiens
acgtcacaggacgcgcccgcttctcgctggagtgcgcaccgagcggcagtgacttcgccgctgctgtagttccccggctggatgcggtgactggtgccagtgctcaggcgcccgctgcccttgacctcccgccccgcgagccctaactcagcgcaggaggaccggctgccgccgccgccgccgccaggctctgatgctggtgtctggtagaagaagattactcacagctctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccaaagacgatgacgcagttcctagagcagggagaggccaccctctcagtggcaagaagagccttggctgcccagttgccagtcctaccatggtcggaggtaaccttcctggctccagtcacatggccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggccacagatgccatggcccacgtggccggcttcactgtggctcatgacgtgagtgctcgtgactggctaacaagacgcaatgggaaacagtggctgctgggaaaaaccttcgacaccttctgccctctgggccctgccttggtgaccaaggacagtgtagcagatccacacaacttaaagatctgctgccgagtgaatggggaagtcgtccagagcagcaacaccaaccagatggtattcaagacagaggacctgatagcctgggtctcccagtttgttaccttttacccaggggatgtcatcctaactgggacccccccaggtgtcggtgtattcaggaaacctcctgtctttctcaagaagggggatgaagtccagtgtgagattgaagaactaggtgtcatcatcaacaaggtggtgtgatggctcctgcacaggcccgacataggatgagggcatctgctcccactcagcctagcccagggaaaggcccagtggcaggtgtgggcaggtgccagccctgcaagccgcctcttctcggtagaagggagaaggacagagctctcttcaataaatgcgtcgggtcaaa

SEQ ID NO: 77190 - DNA, 1571 bp, Homo sapiens
acgtcacaggacgcgcccgcttctcgctggagtgcgcaccgagcggcagtgacttcgccgctgctgtagttccccggctggatgcggtgactggtgccagtgctcaggcgcccgctgcccttgacctcccgccccgcgagccctaactcagcgcaggaggaccggctgccgccgccgccgccgccagcagagccaagcacagtgggaactttcagaaagcactggttgaaggaacgctggaatccctgggacttactgcgtagcatgtagtagttgctcctctacaaaagtttcaccttatgaagtatagcaggctctgatgctggtgtctggtagaagaagattactcacagctctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccaaagacgatgacgcagttcctagagcagggagaggccaccctctcagtggcaagaagagccttggctgcccagttgccagtcctaccatggtcggaggtaaccttcctggctccagtcacatggccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggtgaggtggaaagggtgggctcccaggccagagtgcagcagaggccccagctcctgcctctcctagttctgacctcactcaccgacacatggcaccagctgtccctgacactaggaagcagtcagcctccttgctccctgacactgcctttcccttcacccacctttggctggctctggctactaacatgggataacagctttgagatcccttgccacaggtgttggtgtcacccgtgatctaacctcctgtatggccaaatcccctgcccccataggccacagatgccatggcccacgtggccggcttcactgtggctcatgacgtgagtgctcgtgactggctaacaagacgcaatgggaaacagtggctgctgggaaaaaccttcgacaccttctgccctctgggccctgccttggtgaccaaggacagtgtagcagccaccagttctcccatgggcttccttcccaagccccctagagggaacacaactgcagaggatgtgaaactgcatgcgtgaagtaaattacaaagaacactgagctgatgggtggatcgggcttcctgcggctgccaccatctgaaataatctaagttgagcatcatggagcatagctatcgcaaggcccaggcattttccacactacagatgaaagccagtgtgactcacccagccactgtggaaacaacagcattgaccacacacagtgaggggacagcgccaggttgg

SEQ ID NO: 77191 - DNA, 1581 bp, Homo sapiens
acgtcacaggacgcgcccgcttctcgctggagtgcgcaccgagcggcagtgacttcgccgctgctgtagttccccggctggatgcggtgactggtgccagtgctcaggcgcccgctgcccttgacctcccgccccgcgagccctaactcagcgcaggaggaccggctgccgccgccgccgccgccaggctctgatgctggtgtctggtagaagaagattactcacagctctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccaaagacgatgacgcagttcctagagcagggagaggccaccctctcagtggcaagaagagccttggctgcccagttgccagtcctaccatggtcggaggtaaccttcctggctccagtcacatggccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggtgaggtggaaagggtgggctcccaggccagagtgcagcagaggccccagctcctgcctctcctagttctgacctcactcaccgacacatggcaccagctgtccctgacactaggaagcagtcagcctccttgctccctgacactgcctttcccttcacccacctttggctggctctggctactaacatgggataacagctttgagatcccttgccacaggtgttggtgtcacccgtgatctaacctcctgtatggccaaatcccctgcccccataggccacagatgccatggcccacgtggccggcttcactgtggctcatgacgtgagtgctcgtgactggctaacaagacgcaatgggaaacagtggctgctgggaaaaaccttcgacaccttctgccctctgggccctgccttggtgaccaaggacagtgtagcagatccacacaacttaaagatctgctgccgagtgaatggggaagtcgtccagagcagcaacaccaaccagatggtattcaagacagaggacctgatagcctgggtctcccagtttgttaccttttacccaggggatgtcatcctaactgggacccccccaggtgtcggtgtattcaggaaacctcctgtctttctcaagaagggggatgaagtccagtgtgagattgaagaactaggtgtcatcatcaacaaggtggtgtgatggctcctgcacaggcccgacataggatgagggcatctgctcccactcagcctagcccagggaaaggcccagtggcaggtgtgggcaggtgccagccctgcaagccgcctcttctcggtagaagggagaaggacagagctctcttcaataaatgcgtcgggtcaaa

SEQ ID NO: 77192 - DNA, 976 bp, Homo sapiens
acgtcacaggacgcgcccgcttctcgctggagtgcgcaccgagcggcagtgacttcgccgctgctgtagttccccggctggatgcggtgactggtgccagtgctcaggcgcccgctgcccttgacctcccgccccgcgagccctaactcagcgcaggaggaccggctgccgccgccgccgccgccagcagagccaagcacagtgggaactttcagaaagcactggttgaaggaacgctggaatccctgggacttactgcgtagcatgtagtagttgctcctctacaaaagtttcaccttatgaagtatagcaggctctgatgctggtgtctggtagaagaagattactcacagctctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccaaagacgatgacgcagttcctagagcagggagaggccaccctctcagtggcaagaagagccttggctgcccagttgccagtcctaccatggtcggaggtaaccttcctggctccagtcacatggccagataaggtggtgtgtgtgggcatgaattatgtggaccactgcaaagaacagaacgtgcccgtgcccaaggagcccatcatcttcagcaagtttgccagctccatcgtggggccctatgatgaggtggtctcccactcagcctagcccagggaaaggcccagtggcaggtgtgggcaggtgccagccctgcaagccgcctcttctcggtagaagggagaaggacagagctctcttcaataaatgcgtcgggtcaaaaaaacaaacaatcaaacactacaacaaacaaaaaaaaatttggggggaggcccgcgcccgaaaatttttataacaacactgtggggg

SEQ ID NO: 77193 - DNA, 1430 bp, Homo sapiens
acgtcacaggacgcgcccgcttctcgctggagtgcgcaccgagcggcagtgacttcgccgctgctgtagttccccggctggatgcggtgactggtgccagtgctcaggcgcccgctgcccttgacctcccgccccgcgagccctaactcagcgcaggaggaccggctgccgccgccgccgccgccagcagagccaagcacagtgggaactttcagaaagcactggttgaaggaacgctggaatccctgggacttactgcgtagcatgtagtagttgctcctctacaaaagtttcaccttatgaagtatagcaggctctgatgctggtgtctggtagaagaagattactcacagctctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccaaagacgatgacgcagttcctagagcagggagaggccaccctctcagtggcaagaagagccttggctgcccagttgccagtcctaccatggtcggaggtaaccttcctggctccagtcacatggccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggccacagatgccatggcccacgtggccggcttcactgtggctcatgacgtgagtgctcgtgactggctaacaagacgcaatgggaaacagtggctgctgggaaaaaccttcgacaccttctgccctctgggccctgccttggtgaccaaggacagtgtagcagatccacacaacttaaagatctgctgccgagtgaatggggaagtcgtccagagcagcaacaccaaccagatggtattcaagacagaggacctgatagcctgggtctcccagtttgttaccttttacccaggggatgtcatcctaactgggacccccccaggtgtcggtgtattcaggaaacctcctgtctttctcaagaagggggatgaagtccagtgtgagattgaagaactaggtgtcatcatcaacaaggtggtgtgatggctcctgcacaggcccgacataggatgagggcatctgctcccactcagcctagcccagggaaaggcccagtggcaggtgtgggcaggtgccagccctgcaagccgcctcttctcggtagaagggagaaggacagagctctcttcaataaatgcgtcgggtcaaa

SEQ ID NO: 77194 - DNA, 1693 bp, Homo sapiens
acgtcacaggacgcgcccgcttctcgctggagtgcgcaccgagcggcagtgacttcgccgctgctgtagttccccggctggatgcggtgactggtgccagtgctcaggcgcccgctgcccttgacctcccgccccgcgagccctaactcagcgcaggaggaccggctgccgccgccgccgccgccagcagagccaagcacagtgggaactttcagaaagcactggttgaaggaacgctggaatccctgggacttactgcgtagcatgtagtagttgctcctctacaaaagtttcaccttatgaagtatagcaggctctgatgctggtgtctggtagaagaagattactcacagctctgctgcaggctcagaagtggccctttcaaccctccagagacatgagactagtgcagttccgggcaccccacctggtggggcctcacttgggcctggagacagggaatggtggaggggttatcaacctcaatgcctttgaccccacactcccaaagacgatgacgcagttcctagagcagggagaggccaccctctcagtggcaagaagagccttggctgcccagttgccagtcctaccatggtcggaggtaaccttcctggctccagtcacatggccagataaggtggtgtgtgtgggcatgaattatgtggaccactgcaaagaacagaacgtgcccgtgcccaaggagcccatcatcttcagcaagtttgccagctccatcgtggggccctatgatgaggtggtcctcccaccacagagccaggaggtagattgggaagtggagctggccgtggtcattggaaagaaaggcaagcacatcaaggccacagatgccatggcccacgtggccggcttcactgtggctcatgacgtgagtgctcgtgactggctaacaagacgcaatgggaaacagtggctgctgggaaaaaccttcgacaccttctgccctctgggccctgccttggtgaccaaggacagtgtagcagatccacacaacttaaagatctgctgccgagtgaatggggaagtcgtccagagcagcaacaccaaccagatggtattcaagacagaggacctgatagcctgggtctcccagtgagtgacaagggctgtcctgccagccccgctccacctgccacacatgtggaggctgacctgagccctccacctttggctgtggccactcagccagcccctggtctcactgggtccttttgctttgctccaggtttgttaccttttacccaggggatgtcatcctaactgggacccccccaggtgtcggtgtattcaggaaacctcctgtctttctcaaggtaggttagcgaaaagcaaagagagcaagggccccaaaggcctggcaggcttggctcagacttgagaagtacaggcttgtgtatgtgtctgacggaagggctgacaccgtcatggcctgctctgttgcagaagggggatgaagtccagtgtgagattgaagaactaggtgtcatcatcaacaaggtggtgtgatggctcctgcacaggcccgacataggatgagggcatctgctcccactcagcctagcccagggaaaggcccagtggcaggtgtgggcaggtgccagccctgcaagccgcctcttctcggtagaagggagaaggacagagctctcttcaataaatgcgtcgggtcaaa

SEQ ID NO: 77195 - DNA, 427 bp, Homo sapiens
gagatggagtctcgctctgttgcccaggctggagtgcaatggcgcaatcacagctcagaagcagttcttatatgcatagtgcctctgcccaaattgaccccttttttcaacttccagactatttccattggcccagaaattggaacttgtggagagacgtgaagggatggtcaaaggagagagtgtaggaaatttaggggactaatgatataactcagttcatcattagatttctttttatttattctttactgtctttgtattagaaacaaccttcataatttagctacactgttcttgtggaagatgccattttttgatttgcaaattcttagaattttttatttgatacttgagcctaggagttcgagacctgactgggtaatatagcgacaccctgttctccacaaaaaggaaaaaagaaaga

SEQ ID NO: 77196 - DNA, 414 bp, Homo sapiens
ataactcactggagccttgatgtcttgggctcaagcgatccccctgcctcagcctccctaatagtgaggactataggcatgtgccatcatgcctggttaattttttaaattttttgtagagacagatctcactatattgcctaggctggtctcaaactcctggcctcaagtgatcttctcacctttgcctcccaaagtgctggaatttcaggtgtgagccgccaccacacccatcccaatccctgctttttagagtgtattcggttcgaatgaaaacaacctattttgctactagaaatatttttaaaaatcctttcatggcatagttaggttttactattttaattttatcatgagactgaattcctcagaaattcagaattcttttaggtttactaggtataagagaaacga

SEQ ID NO: 77197 - DNA, 458 bp, Homo sapiens
aaaacctagtgtggagtcttttttcctgatttatccctaactgccatatccccactcttctccccaacagttactgtgatctgcattctaacatagcatgtacccacattgtacattaaacgtaatttgtatataactatgtaagattggaactgaatagcaggtgactggttgacctaatgtttcctttttgtatgtttagattttgtaattttccttgcatatttttgtaattaatacctttttccttttctcatatctcatacttttttttttttttttgagatagggtctcattctgtcacccaggctgaagttcagtgacacaatcacagctcactgtagccttgacctcctgggatcaagtaatcctcctgcctcagcctccgaagtagccaagaccacaggcgcaccaccacacctggctaatttttttttactttttgtagagacagggt

SEQ ID NO: 77198 - DNA, 408 bp, Homo sapiens
tttcaccatgttagccaggatggtctcgatcttctgaccttgtgatccgcctgcctcggcctcccaaagtgcttgtattacaggcgtgagcaaccgcgcccagccaggattattattttttaaatcagagacactgagtaccacctaaagggacttaaattatgcaattggaatgaaactaaagtgaattgaacatttagtttcacttagattttatttttcctgccaactgtcatatgagagtttgagagggagcccagattagacttagagaaaaataaataaattacattttatctgcacacatgaattctagagtgagttaaatttaccacagcgtgcatatatatgtatatatatgataccttgttttatatagctccttatagttttaaaagcactttgtac

SEQ ID NO: 77199 - DNA, 452 bp, Homo sapiens
tttctctgatatagaaaaacactcattttagaatgaaaaatagtgatatgcatgtgtgtaaaatgtgtaatcttagtctcaggcttcagtttcgtaattttagatcacttccctctttttcatgagaaaagctcctagacactcctatttgggaattgtataaatagtgaataatataatgaagaaaaaagtctaaaacaaggacttgctgtacactatctacaggtgtcttgaacatgttatataaggtattcttttgcttatttatgagtttggttatttgtttttatttgctgaattgtaagagttctttgtgtattttggatacaggtcctttatcagatatgtgacgtgcaaatatatcctccaaggttgaagcttgtttcttcattccctcaagagttaatttcacagagggaaacataattttaataaagtccaatttatcaatt

SEQ ID NO: 77200 - DNA, 562 bp, Homo sapiens
gggacttttgttagactgatgttggaacttctggatctcttctctgattattttatctttcttttatatttcttattgctttatttctttgtgttgcattatgggagagttccttggccttttcttctggttcacacattagttctgctgggtctgttctgctattctgccttattaaattttttatttcaaaagcttttcataccagatctctaatggctgttttcataagttcttgttccaatcttaaggatgcaaacttttatttaaaaaaactctcagaccaggcgcagtggctcatgcctgtaatcccagcacttcgggaggccgaggcgggcggatcatgaggtcaggagatcaagaccatcctggctaacacagtgaaaccctgtctctactaaaagtacaaaaattagccaggcatgctggcgggcgcctgtagtcccagctactcgggaggctgaggcaggagaatggcgtgaacctgggaggcggaggttgctgtgagccaagattgcgccactacactccagcctgggggacagagcgagactccatctca

SEQ ID NO: 77201 - DNA, 767 bp, Homo sapiens
gaattattacaaattgaagaacatgggaggctcttaataaatttccttgaataaaataattgaatttatgtaacagcaagctgcattatgaaaaaaagtgaaagctataaaaattaagtttcatgaacagaaacaaatctaaaaaaaaaatactctcttttgccacaatttgtttcccagaaaagataacagtatccaagtcctttatagctatttgtgtaaccttgaaagggtttcctctaaatctggtcactgcatcatggccaactcatttaatatttggtttttgttatgacaaggagatggcaggaattcaaagtcctgtccactaggaaatggatagagatagccaagtcactgctatcaacagtcaatttcactcactgttaaactggattctgaccaaggcttaagtaaaaaagaccttgaaaacttagccattcgattcagctttgagcctgactttaaatattctccaccaagattaccatgtttaaacatttggtaaaaccctcccttcaataagaagtgtgaatcagggagcgctcaaggagtcctaaaggaagacgaagtggactgtgaaattctcaaatataattataaacttaatagtgtgtatattcaattctgattggtgtataatcacttaactaatagaaagaaactaatttgccattacagctgttttgaaattacatttaaaggcaaaatcacagtgcactgggaattgcagccacagagccactgactagttttgctttggaaaa

SEQ ID NO: 77202 - DNA, 790 bp, Homo sapiens
aatgggtaacgttgcatgtcccaccttatttgctcctcaccttatatagcaggattatcatccccactttgtagatgagaacactgaggcaagaggttaagtaacttaggtcgaagaacattgctggtgacagcatcggcatcaaagccaggtctgtgtgacattctctttactctgtcatagaacctccctacatagcccactctcctgactcctaacaagaactaatgattctgtcactccaagaatagcatttccagagtgacacccatgaactgagcccacgctggcctgtacttagtggaaattattggccactttattgtgcttaagcatatgatgggcaactgaattaggtgactcagggtattaaagctggaagggtctatatagatcatttagcatcactctactcatttttgaggtgagaacattaaaactggccagagtcacaccagtgagttgcactgctaaggactgaacatgggactcaaggctctcattatttctaggtgctcttcctctgcagcacctctcagttttctctttccaaatcttttccaaatccagcttaaattccattgtgttcttacagcattccatgattttccaaatgagaattagtcattctttgctctcagcttacattatactttaaacctctgttttagcacttcattccttctgctttatattaattttgtatgttggtcaccctttctaaactataaacctgttaagaacttatttttgtataaccttcaagtatctagttcattgttttgtccat

SEQ ID NO: 77203 - DNA, 435 bp, Homo sapiens
ctcctaatttttatagcttttaatgtctacctaatgctccaagtttagtctgattatttaatgtgcagaaatcattaaaaccattttctgcctcacaaaaaactaaatcattggctgttactaaacaataattaagatttatacttcataggtatgtaagtataaaatcagcaataaaaagaccaggtgcagtgactcacacctgtaatcccagtgctttgggagaccaaggctggcgaatcacttgaggccaggagtttgagaccagtctggccaacatggtaaaaccccatctctactaaaaatataaaaattagccaggcgtggtgatgcacacctgtaatctcagctactaaagaggctgaggcatgagaatctcttgaaccctggaggcggtggttgcagtgagctgagatcgcgccactgcactccagc

SEQ ID NO: 77204 - DNA, 318 bp, Homo sapiens
tgagctgattggatcccggtgagtagcctcggtactccatgcctgtacttaggagggtatatttcttttgcaggaagaaaccaatagttttctgaaagcgattgaagaagccaataaaaagatgcaagcagcagagatcagcctagaggagaaagaccagaggatcggggagctggacaggctgattgagcgcatggaaaaggtaggacacagcgttgggcctattgcccacttgcccaaacttttccctgtaggtccatctgagatacgagaggccctggatatggattcctctcacctccaaaatttgcaattaaa

SEQ ID NO: 77205 - DNA, 3246 bp, Homo sapiens
cgccgtcccgcgtcgcccccgcgcagggcgggccccgcacgcttattctgcccgggaggaacgccggcgtccagcccgctaccgaccgccgctgcgggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtgagagccactttggaaaaggtgagaaagcgaatgtatggagactatgatgagatgagacagaagattcgacagctcacccaggaactatcagtttcccatgctcagcaggagtatctggagaatcacatccaaacccagtcgtctgccctggatcgttttaatgccatgaactcagccttggcatcagattccattggcctgcagaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaagtcaagcagatggtcgaggagattgaatcattaaagaaaaagttgcaacagaaacagctcttaatactgcagcttttagaaaagatatctttcttagaaggagagaataatgaactacaaagcaggttggactatttaacagaaacccaggccaagaccgaagtggaaaccagagagataggagtgggctgtgatcttctacccagccaaacaggcaggactcgtgaaattgtgatgccttctaggaactacaccccatacacaagagtcctggagttaaccatgaagaaaactctgacttaggcactcagaggcatacactttttacagatggacaaaagctctggaaccctgtggcttcaaatcctttgggaagggtgactgttgtttcccctacacacagtgtaagccggaatgggaatcgctgaggctctgatccacttctaagacaggaaggaaagtgaaggcagagtgagcaggtaagagagggatatacaaggtcacatttcagacacccactcggcataccctgccgtactgcatcatcatttgttttctttgtagacactgaaatcctatcaggaggattccttcacaatgtattttatttgctagactttggttgggagggaaaaggacattaatttgaagtttcatgttattcatgccaggattgtttgatagagcatgaaggttttgtttacccataaaagtattagaggcagcgtttctctgatacagagaggcctgtccacaagaagcatgggcacccagccaaacttgaacctggaagggagggttcccggcctgcaggtgctctttcctcttggtcccaagcatctgtgcagggtcgtgggagccacactgagagacttgtgtgggccagacaagcttcattctgatgcgctagtcccttggtttaatttgtgccttatgctttcattggaccagctgaaatcactgtatttattcaacttgtgatttttttttctttctcactttaacttaaagagaattttatatgtcttggaaatttaataatttagtgttctcagtatcaattggtgtttttgttaaacgaatgaatcatctgttcatgcatgctctactttgatattataacctatgtcacatgtgtttaataaataccatatattttgttctaaaaaaaaaaaagaaaaaaaaaaaaaaaaaaaaaaaaaaaaaagaaaaaaaaaaaaaaaagaaaaaagaaaaaaaaaaaaataaaaaaaaaaaaaaagaaaaaaaaaaaaaaagaagggtggggggggcgggcgcaggaaaaaaaagtatataaaaaatacgcgagcgtgggggcgggcgcagcgccactaagagagatacgaaaacaaggtagctaacagcaagctatctacaaaagaaacagcggcgatagaacgagaaaggggggggcgggcccccaaacaaaaaaaaaacagcgcgcggggggcaggagacagaaaaagggcgtgaatgatcaacaacaacaacggaagagaggaagagatcagatacaggagcagactacatcacaggagaggaataggacaacaaacaaaagagagagggaccagacacaaaagtaagcagaccgaacataacaaatcaaaaacacccgcccccggcggcgcggggggtgaggacaaagaaaaagaggacataacaatagagcataacaaagagcaagcagtgaagaagaacacaaagagacgaagcaagacaagaagtaaagagagcaacaacacaacgaagatcaagacagaaaacaacacgcacaaaagcaacgaaagagaaacgaaaatggagagagacaccaccaaagaacaaaacgaacacagcaagacgaaaaaacgagcaagaacgataaaatacgagaacagaacaagacaaggcacataacaaagaaccaaagagaagaagaaaagcacgaaaccaagacacaacaatgagcagacagaagaaaaacaaagaaacgagcacaaaaagatagaaaaaagaaggagagtatgtaaaaataaaagacaagagaa

SEQ ID NO: 77206 - DNA, 548 bp, Homo sapiens
acgtgctggcatccatacagtgatttaaaacagcagaagatgaaggctaagaaatgatttcctctttctgggaacgtaggacggtgcagaaggaggagaacccccgatccccacccaaggaagcaaagttactcagaccaatcctggtgatcatggggtgacagatgttacagccttcacatctggcctcttttgtagctttgaactaacctgcctaagaagagaggaaaactgttgatgtagtgggaacgctccctcctcgagcattaaccgggttgaccccacccctctgtcctcgctgtcttcagtccaatcaagatcggaaagcaggatcaagagaaagatgatcagaccggaacaggtaaacgttccatatagagatgcttcggaagtgcggagaagtgacagcttatcccctctcaggccgtcatgttctctcagcagaccctctgaattactgatgtcagaacttattggctgggctacagcacataagcaactcctagagttttaagacattaaaagaaggtgatttcagacaagaaaac

SEQ ID NO: 77207 - DNA, 430 bp, Homo sapiens
tgagatgaggaagaatgtaggcacgagccttaactgtgctgagaaaagacggcacatgaaaatctgagctcaaaatgtaaaacctaactaacctgcctaagaagagaggaaaactgttgatgtagtgggaacgctccctcctcgagcattaaccgggttgaccccacccctctgtcctcgctgtcttcagtccaatcaagatcggaaagcaggatcaagagaaagatgatcagaccggaacaggtaaacgttccatatagagatgcttcggaagtgcggagaagtgacagcttatcccctctcaggccgtcatgttctctcagcagaccctctgaattactgatgtcagaacttattggctgggctacagcacataagcaactcctagagttttaagacattaaaagaaggtgatttcagacaagaaaac

SEQ ID NO: 77208 - DNA, 585 bp, Homo sapiens
tcacagttcagcagggaacaggaaggatccatttttaggaaggagagtctgtgcttgaggttttttttaaaccagggttggctcttaaaatcaaacccactggggtcattcccttagataaggctgccctatgggcctcagagacaattttcccatccccaacctcttaaaacaagtgagtcatttcctactaaagaagataagggtctatttctatgatttatgaccagatgctcctatcagtcagtccctgggaactgctagatgatactcaactcagaggatgtgtgaggggaacaatgacaggcagtggaaccagacagcctcagtgtaaatcctggctcagccactgtgcccagcgtgtgacctcaggcatgacacctgacctctctatggctcagtgtcctcatctgtaaaatgagaatagtacctacctcatagagttgttatggagattaaatgatgaaaatcagaatgttgcatattaaatttcaatatatgaaaaagtgctgactcttaggaagccctacagtgttttccgttatattactcttcacaatccctggctagtggatccaatgagga

SEQ ID NO: 77209 - DNA, 427 bp, Homo sapiens
acatacacacatacccaatgcacactctatccaaggattgtaattttgtatatttaaaattttaaatttaacaaggggtagatgtggcttagtctttcagtattgctgattaagtgactaaagattttagcaactaggaatttgtaatgatgaaatattgttctgttaatactagcaaatttaactaaagcaattctaaggaatggtgattatggatatattctaacccactttacccttttcaaaatgtagtgaaaggcatgaaactcaaactgctagggagggcacgaagaagttggggctgcaggctgtatgcttttgtaaacacgtccagctccctgctctgatgatgtgtctgcagggtcatttggaggagttgatatgagggagcagatgaatcttctcacttaaaatatcctgtaacgtc

SEQ ID NO: 77210 - DNA, 595 bp, Homo sapiens
aggacaggcagctagcctcccctggggcaggcagggaccagaagagccccagagggtcttgtagaacagaggcggaggaggagaggacagaaaggacagggagacaaccaaggaggccctgaagagactgaatgggagagtgtgactgctccctgcaaatcctccccatgtctggactgaggaaatagctcgaagcaccatccgtctcctggtggagcagcagcagcgtccagaggctgggggctgaggctccttgtttccaacaagctcctaggtgatggatgctgctggcaggtgcaccacactgagttgcaagactcgtccctccaggcacccccttcacaggttcagcatcctcgctgccatctcctcacaaatgcgggaagggagccaccaccccaggctgggctaactcgcatgaggacaccactaacattgtctgcgttccatttacgttagacaggcaggtctacaatgtttgaagtttacagatttcttggatatagcagtgaaaggtttgtattttttatctgtaaggaaaaattgtgaagtttacatcattgcaaaataaacagaactgtgacttctgtttcac

SEQ ID NO: 77211 - DNA, 399 bp, Homo sapiens
acttctgccccctgggttcaagagattctcctacctcagcctcctgcgtagccgggattacaggcacccgcaccatgcccagctaatttttgcattgttagcagagatgaggtttcgccaggttggccaggctggtcttgaactcctgacctcaagtgatccacccacctttgttggcctcccaaagtgctggaattacaggcaacatgtagcctttgagtctagcttcttccactagcctaattcatttgagattccactcgattctacttgagattcatccacattgttgaatgcacattcttttttatttgttctgtagcattctgttgtgcagctgtgccccagtttgtttatctattcactctcagttgtttccagttttaatgacatcttcag

SEQ ID NO: 77212 - DNA, 533 bp, Homo sapiens
tattttttgtagagatgggtcttactagataatcatagtttcttttactgtgcctttactacatatcagaaacagggccagcattttgcatgcattatctctaactctcctaacagcctgtaaggaagttgttactatcttcttttaacaaatgacagaacagaaaggttaaatgattttgctaaggccacacagccagaaggtggaggttataaggctcatacccttcccattaaagcagaataccttaggcttcatacttgggttaggttcatagtatcagtgaccagaatgccccttaccccaactttttcaaataccggtggtctcaaccaggttttggagagaaaccggacaacagccagtgcaaggttcagcgcctcgataacagtccaacgctcagaaactctactctaactggaggaagaccctccaacttctttttgctttcttcttactcaccttttaggggcagcatttaatgatatggaatattctttctgttacaggaataaagtgaagtaatttgtatt

SEQ ID NO: 77213 - DNA, 4520 bp, Homo sapiens
aggtcagttccggcgggtgacggtgcggacgggtcaggagcgtagaggcggcggcaaaatggcggcgcctgaggagcgggatctaacccaggagcagacagagaagctgctgcagtttcaggatctcactggcatcgaatctatggatcagtgtcgccataccttggaacagcataactggaacatagaggctgctgtacaggacagattgaatgagcaagagggcgtacctagtgttttcaacccacctccatcacgacccctgcaggttaatacagctgaccacaggatctacagctatgttgtctcaagacctcaaccaagggggctgcttggatggggttattacttgataatgcttccattccggtttacctattacacgatacttgatatatttaggtttgctcttcgttttatacggcctgaccctcgcagccgggtcactgaccccgttggggacattgtttcatttatgcactcttttgaagagaaatatgggagggcacaccctgtcttctaccagggaacgtacagccaggcacttaacgatgccaaaagggagcttcgctttcttttggtttatcttcatggagatgatcaccaggactctgatgagttttgtcgcaacacactctgtgcacctgaagttatttcactaataaacactaggatgctcttctgggcatgctctacaaacaaacctgagggatacagggtctcacaggctttacgagagaacacctatccattcctggccatgattatgctgaaggatcgaaggatgactgtggtgggacggctagaaggcctcattcaacctgatgacctcattaaccaactgacatttatcatggatgctaaccagacttacctggtgtcagaacgcctagaaagggaagaaagaaaccagacccaagtgctgagacaacagcaggatgaggcctacctggcctctctcagagctgaccaggagaaagaaagaaagaaacgggaggagcgggagcgtaagcggcggaaggaggaggaggtgcaacagcaaaagttggcagaggagagacggcggcagaatttacaggaggaaaaggaaaggaagttggaatgcctgccccctgaaccttcccctgatgaccctgaaagtgtcaagatcatcttcaaattacctaatgattctcgagtagagagacgattccacttttcacagtctctaacagtaatccacgacttcttattctccttgaaggaaagcccagaaaagtttcagattgaagccaattttcccaggcgagtgctgccctgcatcccttcagaggagtggcccaatccccctacgctacaggaggccggactcagccacacagaagttctttttgttcaggacctaactgacgaatgacatttttttcttcctgtcccctcctaccccagtccctaaaagaaatggggaaaaaagaaaacaacagcaagtcagaaaaaaaaaacaagagagagaaattcatattattattattattataatacaatattttttttaaaagactgctgcatccttaggaaggatcagaaaccatgctgcccgtaagagtcacaacctgtgtgtgcgcgcaaggttagcaacaaacgtacccgcttggcaagcccacccttcctgtggcctctgtgcacgcaccttccagtgaacagagactcttcaccttcgacccatccattgtcccagctgggaaggggacattcccactagttctcattcattcttgcttttatgaaaaataaaagtgaaaaacctccatcaaccagctacttgcagcatctcctgaggacttgcttctcctgcctctggggaagagagggaagagaaagcacagagcagagaagcagagatgttccttgaactgcccacaagttttcaataacttttatttctgttttgtaatgaccaaaggaatgaggctgacataggtatatatatatatttttttcctttatttgataaagagccaattctttaaacccatgagtttatgccctgggctccttagcccacaatagtgtaataaaagtgccccgggctggtttgtgcttatttctgccattgtccctctcacgttcccagagaggtcattctttttggtccaactcttgctgtcctttcttaccacctgtgcaccccacttggagcagtgggaggaaatctgggtttgtggccccacaaaggctgtatatgtaaagatacacctatgtatgtggtggaactcacctttacacacaactgcagcttttccttggagtctgtaccaggtggtggttatggggtctgaaccaaaggatagcagctcttcattcctcttctgacatgtgcatgctgctccccccagccctgggctttcctgaattgccaagcctggtgcctttccaaaggactagcagggcctgtggtggagccagcagaaccacaggagagtgccctgcctgtctcagtggaagtgtattattgttttaaggatagaaccagaggccttgaagggagccaagacagaactcccagcctgtgtaatctattggaaggcacattttcatttctgatgcagccaccttctggaggcagcttttatcctttctctctattgctatgttgaagtaatagggttttttttaacctctggatgtctcgtctgtggttgagtttatggtaatgggtacatgggtcaggccatgtattaacagatgccagtgcgctctgacaagtattccaaagtgttccgtagctagactggtgcaggctcgttgtaccactgcaaccgactgacgttactgtagttcctagaatgctgtgagggcggggggttcagatcaacataaagcctaacttgctggagttgtagtctcaaggctttctctcttgcttaactaaaacctaaggaccactgtttttggtagcaattatatggttactatccactgcagtcctcagttgttggggtaaatcccacatggcagagtaaggcaccccacagaaattaacttggagagcctgagaaattcccagtggccttggcatagctgtctagaacaccatctctaggaaaatttaattctgtccctggccagctattgttcttccacttcgttttctgctgtcccaaggccagatgagtggaatcaccatctgactgttgtcaataaaatgtatctggcgtgaacagcaggataacccatgttctccacataaggataaccttacgtgaaaccttcctgctgacaaccatgcagaggaatttttccacttaagtcagagccttcctccccatctggaattcacagctgttccctggcagcacacaggagggtattaaggacctttgtgaggctaggtacactgtccacacctctttggggaagttacgattttttttttccatcataattcagtctcttcttattctacagtgtgcactttatgcctctcgccttttgataatagttgttcagtgaaggaagtcagctgccagaatattaagaagggtctccctttatgtcagtacaactgttagggcggccttcccatttactttaggtttcaagaggattcaccggaagcacatgccccggtctagtcccatttgaaacagttctgctttactgagaccctaggccggtctccttgctgaccctagcgctgctgcctaggtgccatttcctttcctcctcagtcaaatacaggctgcacattttgtcacttaatgccagtacaatctgtgttactcctaaggacttttgggattttgatgagacctgcgagggagaagacactgagaagccagtgatctgcaagcatttgctcttgtttccacatcacctctgggatatttcagctgttgtttccaaatggcaaatcatcaactaaaagcacttgtttcaagttttgttctgcactcccacgactgaagttgtagattgagctgaataaccatgggaagtgaccaagcaaagacactcgattggagtcagttgaatatttgtaccctcagtggagcccttctggtcttttcttccacttctgcagaatttcctctagcaaatacttctttctccttgcttgcctccaccatgatatttgaataagagatggccagaggataacacttgtctcttaaaaactaagctaaaaagaacctagaaccttcaattgagcagttgtgaaaattgctaatggtgccaaggccaagcaaagagtttcagaaaatgactgagaaggagcgataacccccagaatgcaaaatcaggggcatcattatccggtgcttgaacaaggagctccgctctacaactggtttttttaggacttgtgaggaacacagcaacggaaatccatccacaaaggatgcagtgccccaacttgtactgcgcctgaatagtcatgtgataatttactgaagaaatctagtgtactttaaatttttttcataaaagtttacattgtattgtaggttaacattaaatgttttatagcaaaaacttca

SEQ ID NO: 77214 - DNA, 2082 bp, Homo sapiens
aggtcagttccggcgggtgacggtgcggacgggtcaggagcgtagaggcggcggcaaaatggcggcgcctgaggagcgggatctaacccaggagcagacagagaagctgctgcagtttcaggatctcactggcatcgaatctatggatcagtgtcgccataccttggaacagcataactggaacatagaggctgctgtacaggacagattgaatgagcaagagggcgtacctagtgttttcaacccacctccatcacgacccctgcaggttaatacagctgaccacaggatctacagctatgttgtctcaagacctcaaccaagggggctgcttggatggggttattacttgataatgcttccattccggtttacctattacacgatacttgatatatttaggtttgctcttcgttttatacggcctgaccctcgcagccgggtcactgaccccgttggggacattgtttcatttatgcactcttttgaagagaaatatgggagggcacaccctgtcttctaccagggaacgtacagccaggcacttaacgatgccaaaagggagcttcgctttcttttggtttatcttcatggagatgatcaccaggactctgatgagttttgtcgcaacacactctgtgcacctgaagttatttcactaataaacactaggatgctcttctgggcatgctctacaaacaaacctgagggatacagggtctcacaggctttacgagagaacacctatccattcctggccatgattatgctgaaggatcgaaggatgactgtggtgggacggctagaaggcctcattcaacctgatgacctcattaaccaactgacatttatcatggatgctaaccagacttacctggtgtcagaacgcctagaaagggaagaaagaaaccagacccaagtgctgagacaacagcaggatgaggcctacctggcctctctcagagctgaccaggagaaagaaagaaagaaacgggaggagcgggagcgtaagcggcggaaggaggaggaggtgcaacagcaaaagttggcagaggagagacggcggcagaatttacaggaggaaaaggaaaggaagttggaatgcctgccccctgaaccttcccctgatgaccctgaaagtgtcaagatcatcttcaaattacctaatgattctcgagtagagagacgattccacttttcacagtctctaacagtaatccacgacttcttattctccttgaaggaaagcccagaaaagtttcagattgaagccaattttcccaggcgagtgctgccctgcatcccttcagaggagtggcccaatccccctacgctacaggaggccggactcagccacacagaagttctttttgttcaggacctaactgacgaatgacatttttttcttcctgtcccctcctaccccagtccctaaaagaaatggggaaaaaagaaaacaacagcaagtcagaaaaaaaaaacaagagagagaaattcatattattattattattataatacaatattttttttaaaagactgctgcatccttaggaaggatcagaaaccatgctgcccgtaagagtcacaacctgtgtgtgcgcgcaaggttagcaacaaacgtacccgcttggcaagcccacccttcctgtggcctctgtgcacgcaccttccagtgaacagagactcttcaccttcgacccatccattgtcccagctgggaaggggacattcccactagttctcattcattcttgcttttatgaaaaataaaagtgaaaaacctccatcaaccagctacttgcagcatctcctgaggacttgcttctcctgcctctggggaagagagggaagagaaagcacagagcagagaagcagagatgttccttgaactgcccacaagttttcaataacttttatttctgttttgtaatgaccaaaggaatgaggctgacataggtatatatatatatttttttcctttatttgataaagagccaattctttaaacccatgagtttatgccctgggctccttagcccacaatagtgtaataaaagtgccccgggctggtttgtgctt

SEQ ID NO: 77215 - DNA, 4459 bp, Homo sapiens
aggtcagttccggcgggtgacggtgcggacgggtcaggagcgtagaggcggcggcaaaatggcggcgcctgaggagcgggatctaacccaggagcagacagagaagctgctgcagtttcaggatctcactggcatcgaatctatggatcagtgtcgccataccttggaacagcataactggaacatagaggctgctgtacaggacagattgaatgagcaagagggcgtacctagtgttttcaacccacctccatcacgacccctgcaggttaatacagctgaccacaggatctacagctatgttgtctcaagacctcaaccaagggggctgcttggatggggttattacttgataatgcttccattccggtttacctattacacgatacttgatatatttaggtttgctcttcgttttatacggcctgaccctcgcagccgggtcactgaccccgttggggacattgtttcatttatgcactcttttgaagagaaatatgggagggcacaccctgtcttctaccagggaacgtacagccaggcacttaacgatgccaaaagggagcttcgctttcttttggtttatcttcatggagatgatcaccaggactctgatgagttttgtcgcaacacactctgtgcacctgaagttatttcactaataaacactaggatgctcttctgggcatgctctacaaacaaacctgagggatacagggtctcacaggctttacgagagaacacctatccattcctggccatgattatgctgaaggatcgaaggatgactgtggtgggacggctagaaggcctcattcaacctgatgacctcattaaccaactgacatttatcatggatgctaaccagacttacctggtgtcagaacgcctagaaagggaagaaagaaaccagacccaagtgctgagacaacagcaggatgaggcctacctggcctctctcagagctgaccaggagaaagaaagaaagaaacgggaggagcgggagcgtaagcggcggaaggaggaggaggtgcaacagcaaaagttggcagaggagagacggcggcagaatttacaggaggaaaaggaaaggaagttggaatgcctgccccctgaaccttcccctgatgaccctgaaagtgtcaagatcatcttcaaattacctaatgattctcgagtagagagacgattccacttttcacagtctctaacagtaatccacgacttcttattctccttgaaggaaagcccagaaaagtttcagattgaagccaattttcccaggcgagtgctgccctgcatcccttcagaggagtggcccaatccccctacgctacaggaggccggactcagccacacagaagttctttttgttcaggacctaactgacgaatgacatttttttcttcctgtcccctcctaccccagtccctaaaagaaatggggaaaaaagaaaacaacagcaagtcagaaaaaaaaaacaagagagagaaattcatattattattattattataatacaatattttttttaaaagactgctgcatccttaggaaggatcagaaaccatgctgcccgtaagagtcacaacctgtgtgtgcgcgcaaggttagcaacaaacgtacccgcttggcaagcccacccttcctgtggcctctgtgcacgcaccttccagtgaacagagactcttcaccttcgacccatccattgtcccagctgggaaggggacattcccactagttctcattcattcttgcttttatgaaaaataaaagtgaaaaacctccatcaaccagctacttgcagcatctcctgaggacttgcttctcctgcctctggggaagagagggaagagaaagcacagagcagagaagcagagatgttccttgaactgcccacaagttttcaataacttttatttctgttttgtaatgaccaaaggaatgaggctgacataggtatatatatatatttttttcctttatttgataaagagccaattctttaaacccatgagtttatgccctgggctccttagcccacaatagtgtaataaaagtgccccgggctggtttgtgcttatttctgccattgtccctctcacgttcccagagaggtcattctttttggtccaactcttgctgtcctttcttaccacctgtgcaccccacttggagcagtgggaggaaatctgggtttgtggccccacaaaggctgtatatgtaaagatacacctatgtatgtggtggaactcacctttacacacaactgcagcttttccttggagtctgtaccaggtggtggttatggggtctgaaccaaaggatagcagctcttcattcctcttctgacatgtgcatgctgctccccccagccctgggctttcctgaattgccaagcctggtgcctgtctcagtggaagtgtattattgttttaaggatagaaccagaggccttgaagggagccaagacagaactcccagcctgtgtaatctattggaaggcacattttcatttctgatgcagccaccttctggaggcagcttttatcctttctctctattgctatgttgaagtaatagggttttttttaacctctggatgtctcgtctgtggttgagtttatggtaatgggtacatgggtcaggccatgtattaacagatgccagtgcgctctgacaagtattccaaagtgttccgtagctagactggtgcaggctcgttgtaccactgcaaccgactgacgttactgtagttcctagaatgctgtgagggcggggggttcagatcaacataaagcctaacttgctggagttgtagtctcaaggctttctctcttgcttaactaaaacctaaggaccactgtttttggtagcaattatatggttactatccactgcagtcctcagttgttggggtaaatcccacatggcagagtaaggcaccccacagaaattaacttggagagcctgagaaattcccagtggccttggcatagctgtctagaacaccatctctaggaaaatttaattctgtccctggccagctattgttcttccacttcgttttctgctgtcccaaggccagatgagtggaatcaccatctgactgttgtcaataaaatgtatctggcgtgaacagcaggataacccatgttctccacataaggataaccttacgtgaaaccttcctgctgacaaccatgcagaggaatttttccacttaagtcagagccttcctccccatctggaattcacagctgttccctggcagcacacaggagggtattaaggacctttgtgaggctaggtacactgtccacacctctttggggaagttacgattttttttttccatcataattcagtctcttcttattctacagtgtgcactttatgcctctcgccttttgataatagttgttcagtgaaggaagtcagctgccagaatattaagaagggtctccctttatgtcagtacaactgttagggcggccttcccatttactttaggtttcaagaggattcaccggaagcacatgccccggtctagtcccatttgaaacagttctgctttactgagaccctaggccggtctccttgctgaccctagcgctgctgcctaggtgccatttcctttcctcctcagtcaaatacaggctgcacattttgtcacttaatgccagtacaatctgtgttactcctaaggacttttgggattttgatgagacctgcgagggagaagacactgagaagccagtgatctgcaagcatttgctcttgtttccacatcacctctgggatatttcagctgttgtttccaaatggcaaatcatcaactaaaagcacttgtttcaagttttgttctgcactcccacgactgaagttgtagattgagctgaataaccatgggaagtgaccaagcaaagacactcgattggagtcagttgaatatttgtaccctcagtggagcccttctggtcttttcttccacttctgcagaatttcctctagcaaatacttctttctccttgcttgcctccaccatgatatttgaataagagatggccagaggataacacttgtctcttaaaaactaagctaaaaagaacctagaaccttcaattgagcagttgtgaaaattgctaatggtgccaaggccaagcaaagagtttcagaaaatgactgagaaggagcgataacccccagaatgcaaaatcaggggcatcattatccggtgcttgaacaaggagctccgctctacaactggtttttttaggacttgtgaggaacacagcaacggaaatccatccacaaaggatgcagtgccccaacttgtactgcgcctgaatagtcatgtgataatttactgaagaaatctagtgtactttaaatttttttcataaaagtttacattgtattgtaggttaacattaaatgttttatagcaaaaacttca

SEQ ID NO: 77216 - DNA, 4946 bp, Homo sapiens
aggtcagttccggcgggtgacggtgcggacgggtcaggagcgtagaggcggcggcaaaatggcggcgcctgaggagcgggatctaacccaggagcagacagagaagctgctgcagtttcaggatctcactggcatcgaatctatggatcagtgtcgccataccttggaacagcataactggaacatagaggctgctgtacaggacagattgaatgagcaagagggcgtacctagtgttttcaacccacctccatcacgacccctgcaggttaatacagctgaccacaggatctacagctatgttgtctcaagacctcaaccaagggggctgcttggatggggttattacttgataatgcttccattccggtttacctattacacgatacttgatatatttaggtttgctcttcgttttatacggcctgaccctcgcagccgggtcactgaccccgttggggacattgtttcatttatgcactcttttgaagagaaatatgggagggcacaccctgtcttctaccagggaacgtacagccaggcacttaacgatgccaaaagggagcttcgctttcttttggtttatcttcatggagatgatcaccaggactctgatgagttttgtcgcaacacactctgtgcacctgaagttatttcactaataaacactaggatgctcttctgggcatgctctacaaacaaacctgagggatacagggtctcacaggctttacgagagaacacctatccattcctggccatgattatgctgaaggatcgaaggatgactgtggtgggacggctagaaggcctcattcaacctgatgacctcattaaccaactgacatttatcatggatgctaaccagacttacctggtgtcagaacgcctagaaagggaagaaagaaaccagacccaagtgctgagacaacagcaggatgaggcctacctggcctctctcagagctgaccaggagaaagaaagaaagaaacgggaggagcgggagcgtaagcggcggaaggaggaggaggtgcaacagcaaaagttggcagaggagagacggcggcagaatttacaggaggaaaaggaaaggaagttggaatgcctgccccctgaaccttcccctgatgaccctgaaagtgtcaagatcatcttcaaattacctaatgattctcgagtagagagacgattccacttttcacagtctctaacagtaatccacgacttcttattctccttgaaggaaagcccagaaaagtttcagattgaagccaattttcccaggcgagtgctgccctgcatcccttcagaggagtggcccaatccccctacgctacaggaggccggactcagccacacagaagttctttttgttcaggacctaactgacgaatgacatttttttcttcctgtcccctcctaccccagtccctaaaagaaatggggaaaaaagaaaacaacagcaagtcagaaaaaaaaaacaagagagagaaattcatattattattattattataatacaatattttttttaaaagactgctgcatccttaggaaggatcagaaaccatgctgcccgtaagagtcacaacctgtgtgtgcgcgcaaggttagcaacaaacgtacccgcttggcaagcccacccttcctgtggcctctgtgcacgcaccttccagtgaacagagactcttcaccttcgacccatccattgtcccagctgggaaggggacattcccactagttctcattcattcttgcttttatgaaaaataaaagtgaaaaacctccatcaaccagctacttgcagcatctcctgaggacttgcttctcctgcctctggggaagagagggaagagaaagcacagagcagagaagcagagatgttccttgaactgcccacaagttttcaataacttttatttctgttttgtaatgaccaaaggaatgaggctgacataggtatatatatatatttttttcctttatttgataaagagccaattctttaaacccatgagtttatgccctgggctccttagcccacaatagtgtaataaaagtgccccgggctggtttgtgcttatttctgccattgtccctctcacgttcccagagaggtcattctttttggtccaactcttgctgtcctttcttaccacctgtgcaccccacttggagcagtgggaggaaatctgggtttgtggccccacaaaggctgtatatgtaaagatacacctatgtatgtggtggaactcacctttacacacaactgcagcttttccttggagtctgtaccaggtggtggttatggggtctgaaccaaaggatagcagctcttcattcctcttctgacatgtgcatgctgctccccccagccctgggctttcctgaattgccaagcctggtgcctttccaaaggactagcagggcctgtggtggagccagcagaaccacaggagagtgccctgcctgtctcagtggaagtgtattattgttttaaggatagaaccagaggccttgaagggagccaagacagaactcccagcctgtgtaatctattggaaggcacattttcatttctgatgcagccaccttctggaggcagcttttatcctttctctctattgctatgttgaagtaatagggttttttttaacctctggatgtctcgtctgtggttgagtttatggtaatgggtacatgggtcaggccatgtattaacagatgccagtgcgctctgacaagtattccaaagtgttccgtagctagactggtgcaggctcgttgtaccactgcaaccgactgacgttactgtagttcctagaatgctgtgagggcggggggttcagatcaacataaagcctaacttgctggagttgtagtctcaaggctttctctcttgcttaactaaaacctaaggaccactgtttttggtagcaattatatggttactatccactgcagtcctcagttgttggggtaaatcccacatggcagagtaaggcaccccacagaaattaacttggagagcctgagaaattcccagtggccttggcatagctgtctagaacaccatctctaggaaaatttaattctgtccctggccagctattgttcttccacttcgttttctgctgtcccaaggccagatgagtggaatcaccatctgactgttgtcaataaaatgtatctggcgtgaacagcaggataacccatgttctccacataaggataaccttacgtgaaaccttcctgctgacaaccatgcagaggaatttttccacttaagtcagagccttcctccccatctggaattcacagctgttccctggcagcacacaggagggtattaaggacctttgtgaggctaggtacactgtccacacctctttggggaagttacgattttttttttccatcataattcagtctcttcttattctacagtgtgcactttatgcctctcgccttttgataatagttgttcagtgaaggaagtcagctgccagaatattaagaagggtctccctttatgtcagtacaactgttagggcggccttcccatttactttaggtttcaagaggattcaccggaagcacatgccccggtctagtcccatttgaaacagttctgctttactgagaccctaggccggtctccttgctgaccctagcgctgctgcctaggtgccatttcctttcctcctcagtcaaatacaggctgcacattttgtcacttaatgccagtacaatctgtgttactcctaaggacttttgggattttgatgagacctgcgagggagaagacactgagaagccagtgatctgcaagcatttgctcttgtttccacatcacctctgggatatttcagctgttgtttccaaatggcaaatcatcaactaaaagcacttgtttcaagttttgttctgcactcccacgactgaagttgtagattgagctgaataaccatgggaagtgaccaagcaaagacactcgattggagtcagttgaatatttgtaccctcagtggagcccttctggtcttttcttccacttctgcagaatttcctctagcaaatacttctttctccttgcttgcctccaccatgatatttgaataagagatggccagaggataacacttgtctcttaaaaactaagctaaaaagaacctagaaccttcaattgagcagttgtgaaaattgctaatggtgccaaggccaagcaaagagtttcagaaaatgactgagaaggagcgataacccccagaatgcaaaatcaggggcatcattatccggtgcttgaacaaggagctccgctctacaactggtttttttaggacttgtgaggaacacagcaacggaaatccatccacaaaggatgcagtgccccaacttgtactgcgcctgaatagtcatgtgataatttactgaagaaatctagtgtactttaaatttttttcataaaagtttacattgtattgtaggttaacattaaatgttttatagcaaaaacttcaaaaaaaaaaaaaaaaaaaaaaaaaaaaaaaaaaaaggggggggggcctaaaagatttcccccgggggggcccattttgggttcccccgattttttttggtcacaaggtggtccccttgtaggggaacgggttattataattaagcataagggaacgggggcggggatgttttaacaccacgttcgggggcggggaaaacacgctgtctacgctggggacacttcgtgggggaaggagaaaccctctaccttcgtgggggggcggcgcacctattgtgggggcaacactccctccagggaaatttaagggtccagggggaaattataacatttctcagggtgcttatggtggtgttcaaccacacacggtaaataggtggggggatgaaatatttggccacgggacatagtttgggaaagatttttg

SEQ ID NO: 77217 - DNA, 4418 bp, Homo sapiens
aggtcagttccggcgggtgacggtgcggacgggtcaggagcgtagaggcggcggcaaaatggcggcgcctgaggagcgggatctaacccaggagcagacagagaagctgctgcagtttcaggatctcactggcatcgaatctatggatcagtgtcgccataccttggaacagcataactggaacatagaggctgctgtacaggacagattgaatgagcaagagggcgtacctagtgttttcaacccacctccatcacgacccctgcaggttaatacagctgaccacaggatctacagctatgttgtctcaagacctcaaccaagggggctgcttggatggggttattacttgataatgcttccattccggtttacctattacacgatacttgatatatttaggtttgctcttcgttttatacggcctgaccctcgcagccgggtcactgaccccgttggggacattgtttcatttatgcactcttttgaagagaaatatgggagggcacaccctgtcttctaccagggaacgtacagccaggcacttaacgatgccaaaagggagcttcgctttcttttggtttatcttcatggagatgatcaccaggactctgatgagttttgtcgcaacacactctgtgcacctgaagttatttcactaataaacactaggatgctcttctgggcatgctctacaaacaaacctgagggatacagggtctcacaggctttacgagagaacacctatccattcctggccatgattatgctgaaggatcgaaggatgactgtggtgggacggctagaaggcctcattcaacctgatgacctcattaaccaactgacatttatcatggatgctaaccagacttacctggtgtcagaacgcctagaaagggaagaaagaaaccagacccaagtgctgagacaacagcaggatgaggcctacctggcctctctcagagctgaccaggagaaagaaagaaagaaacgggaggagcgggagcgtaagcggcggaaggaggaggaggtgcaacagcaaaagttggcagaggagagacggcggcagaatttacaggaggaaaaggaaaggaagttggaatgcctgccccctgaaccttcccctgatgaccctgaaagtgtcaagatcatcttcaaattacctaatgattctcgagtagagagacgattccacttttcacagtctctaacagtaatccacgacttcttattctccttgaaggaaagcccagaaaagtttcagattgaagccaattttcccaggcgagtgctgccctgcatcccttcagaggagtggcccaatccccctacgctacaggaggccggactcagccacacagaagttctttttgttcaggacctaactgacgaatgacatttttttcttcctgtcccctcctaccccagtccctaaaagaaatggggaaaaaagaaaacaacagcaagtcagaaaaaaaaaacaagagagagaaattcatattattattattattataatacaatattttttttaaaagactgctgcatccttaggaaggatcagaaaccatgctgcccgtaagagtcacaacctgtgtgtgcgcgcaaggttagcaacaaacgtacccgcttggcaagcccacccttcctgtggcctctgtgcacgcaccttccagtgaacagagactcttcaccttcgacccatccattgtcccagctgggaaggggacattcccactagttctcattcattcttgcttttatgaaaaataaaagtgaaaaacctccatcaaccagctacttgcagcatctcctgaggacttgcttctcctgcctctggggaagagagggaagagaaagcacagagcagagaagcagagatgttccttgaactgcccacaagttttcaataacttttatttctgttttgtaatgaccaaaggaatgaggctgacataggtatatatatatatttttttcctttatttgataaagagccaattctttaaacccatgagtttatgccctgggctccttagcccacaatagtgtaataaaagtgccccgggctggtttgtgcttatttctgccattgtccctctcacgttcccagagaggtcattctttttggtccaactcttgctgtcctttcttaccacctgtgcaccccacttggagcagtgggaggaaatctgggtttgtggccccacaaaggctgtatatgtaaagatacacctatgtatgtggtggaactcacctttacacacaactgcagcttttccttggagtctgtaccaggtggtggttatggggtctgaaccaaaggatagcagctcttcattcctcttctgacatgtgcatgctgctccccccagccctgggctttcctgaattgccaagcctggtgcctttccaaaggactagcagggcctgtggtggagccagcagaaccacaggagagtgccctgcctgtctcagtggaagtgtattattgttttaaggatagaaccagaggccttgaagggagccaagacagaactcccagcctgtgtaatctattggaaggcacattttcatttctgatgcagccaccttctggaggcagcttttatcctttctctctattgctatgttgaagtaatagggttttttttaacctctggatgtctcgtctgtggttgagtttatggtaatgggtacatgggtcaggccatgtattaacagatgccagtgcgctctgacaagtattccaaagtgttccgtagctagactggtgcaggctcgttgtaccactgcaaccgactgacgttactgtagttcctagaatgctgtgagggcggggggttcagatcaacataaagcctaacttgctggagttgtagtctcaaggctttctctcttgcttaactaaaacctaaggaccactgtttttggtagcaattatatggttactatccactgcagtcctcagttgttggggtaaatcccacatggcagagtaaggcaccccacagaaattaacttggagagcctgagaaattcccagtggccttggcatagctgtctagaacaccatctctaggaaaatttaattctgtccctggccagctattgttcttccacttcgttttctgctgtcccaaggccagatgagtggaatcaccatctgactgttgtcaataaaatgtatctggcgtgaacagcaggataacccatgttctccacataaggataaccttacgtgaaaccttcctgctgacaaccatgcagaggaatttttccacttaagtcagagccttcctccccatctggaattcacagctgttccctggcagcacacaggagggtattaaggacctttgtgaggctaggtacactgtccacacctctttggggaagttacgattttttttttccatcataattcagtctcttcttattctacagtgtgcactttatgcctctcgccttttgataatagttgttcagtgaaggaagtcagctgccagaatattaagaagggtctccctttatgtcagtacaactgttagggcggccttcccatttactttaggtttcaagaggattcaccggaagcacatgccccggtctagtcccatttgaaacagttctgctttactgagaccctaggccggtctccttgctgaccctagcgctgctgcctaggtgccatttcctttcctcctcagtcaaatacaggctgcacattttgtcacttaatgccagtacaatctgtgttactcctaaggacttttgggattttgatgagacctgcgagggagaagacactgagaagccagtgatctgcaagcatttgctcttgtttccacatcacctctgggatatttcagctgttgtttccaaatggcaaatcatcaactaaaagcacttgtttcaagttttgttctgcactcccacgactgaagttgtagattgagagaatttcctctagcaaatacttctttctccttgcttgcctccaccatgatatttgaataagagatggccagaggataacacttgtctcttaaaaactaagctaaaaagaacctagaaccttcaattgagcagttgtgaaaattgctaatggtgccaaggccaagcaaagagtttcagaaaatgactgagaaggagcgataacccccagaatgcaaaatcaggggcatcattatccggtgcttgaacaaggagctccgctctacaactggtttttttaggacttgtgaggaacacagcaacggaaatccatccacaaaggatgcagtgccccaacttgtactgcgcctgaatagtcatgtgataatttactgaagaaatctagtgtactttaaatttttttcataaaagtttacattgtattgtaggttaacattaaatgttttatagcaaaaacttca

SEQ ID NO: 77218 - DNA, 4976 bp, Homo sapiens
aggtcagttccggcgggtgacggtgcggacgggtcaggagcgtagaggcggcggcaaaatggcggcgcctgaggagcgggatctaacccaggagcagacagagaagctgctgcagtttcaggatctcactggcatcgaatctatggatcagtgtcgccataccttggaacagcataactggaacatagaggctgctgtacaggacagattgaatgagcaagagggcgtacctagtgttttcaacccacctccatcacgacccctgcaggttaatacagctgaccacaggatctacagctatgttgtctcaagacctcaaccaagggggctgcttggatggggttattacttgataatgcttccattccggtttacctattacacgatacttgatatatttaggtttgctcttcgttttatacggcctgaccctcgcagccgggtcactgaccccgttggggacattgtttcatttatgcactcttttgaagagaaatatgggagggcacaccctgtcttctaccagggaacgtacagccaggcacttaacgatgccaaaagggagcttcgctttcttttggtttatcttcatggagatgatcaccaggactctgatgagttttgtcgcaacacactctgtgcacctgaagttatttcactaataaacactaggatgctcttctgggcatgctctacaaacaaacctgagggatacagggtctcacaggctttacgagagaacacctatccattcctggccatgattatgctgaaggatcgaaggatgactgtggtgggacggctagaaggcctcattcaacctgatgacctcattaaccaactgacatttatcatggatgctaaccagacttacctggtgtcagaacgcctagaaagggaagaaagaaaccagacccaagtgctgagacaacagcaggatgaggcctacctggcctctctcagagctgaccaggagaaagaaagaaagaaacgggaggagcgggagcgtaagcggcggaaggaggaggaggtgcaacagcaaaagttggcagaggagagacggcggcagaatttacaggaggaaaaggaaaggaagttggaatgcctgccccctgaaccttcccctgatgaccctgaaagtgtcaagatcatcttcaaattacctaatgattctcgagtagagagacgattccacttttcacagtctctaacagtaatccacgacttcttattctccttgaaggaaagcccagaaaagtttcagattgaagccaattttcccaggcgagtgctgccctgcatcccttcagaggagtggcccaatccccctacgctacaggaggccggactcagccacacagaagttctttttgttcaggacctaactgacgaatgacatttttttcttcctgtcccctcctaccccagtccctaaaagaaatggggaaaaaagaaaacaacagcaagtcagaaaaaaaaaacaagagagagaaattcatattattattattattataatacaatattttttttaaaagactgctgcatccttaggaaggatcagaaaccatgctgcccgtaagagtcacaacctgtgtgtgcgcgcaaggttagcaacaaacgtacccgcttggcaagcccacccttcctgtggcctctgtgcacgcaccttccagtgaacagagactcttcaccttcgacccatccattgtcccagctgggaaggggacattcccactagttctcattcattcttgcttttatgaaaaataaaagtgaaaaacctccatcaaccagctacttgcagcatctcctgaggacttgcttctcctgcctctggggaagagagggaagagaaagcacagagcagagaagcagagatgttccttgaactgcccacaagttttcaataacttttatttctgttttgtaatgaccaaaggaatgaggctgacataggtatatatatatatttttttcctttatttgataaagagccaattctttaaacccatgagtttatgccctgggctccttagcccacaatagtgtaataaaagtgccccgggctggtttgtgcttatttctgccattgtccctctcacgttcccagagaggtcattctttttggtccaactcttgctgtcctttcttaccacctgtgcaccccacttggagcagtgggaggaaatctgggtttgtggccccacaaaggctgtatatgtaaagatacacctatgtatgtggtggaactcacctttacacacaactgcagcttttccttggagtctgtaccaggtggtggttatggggtctgaaccaaaggatagcagctcttcattcctcttctgacatgtgcatgctgctccccccagccctgggctttcctgaattgccaagcctggtgcctttccaaaggactagcagggcctgtggtggagccagcagaaccacaggagagtgccctgcctgtctcagtggaagtgtattattgttttaaggatagaaccagaggccttgaagggagccaagacagaactcccagcctgtgtaatctattggaaggcacattttcatttctgatgcagccaccttctggaggcagcttttatcctttctctctattgctatgttgaagtaatagggttttttttaacctctggatgtctcgtctgtggttgagtttatggtaatgggtacatgggtcaggccatgtattaacagatgccagtgcgctctgacaagtattccaaagtgttccgtagctagactggtgcaggctcgttgtaccactgcaaccgactgacgttactgtagttcctagaatgctgtgagggcggggggttcagatcaacataaagcctaacttgctggagttgtagtctcaaggctttctctcttgcttaactaaaacctaaggaccactgtttttggtagcaattatatggttactatccactgcagtcctcagttgttggggtaaatcccacatggcagagtaaggcaccccacagaaattaacttggagagcctgagaaattcccagtggccttggcatagctgtctagaacaccatctctaggaaaatttaattctgtccctggccagctattgttcttccacttcgttttctgctgtcccaaggccagatgagtggaatcaccatctgactgttgtcaataaaatgtatctggcgtgaacagcaggataacccatgttctccacataaggataaccttacgtgaaaccttcctgctgacaaccatgcagaggaatttttccacttaagtcagagccttcctccccatctggaattcacagctgttccctggcagcacacaggagggtattaaggacctttgtgaggctaggtacactgtccacacctctttggggaagttacgattttttttttccatcataattcagtctcttcttattctacagtgtgcactttatgcctctcgccttttgataatagttgttcagtgaaggaagtcagctgccagaatattaagaagggtctccctttatgtcagtacaactgttagggcggccttcccatttactttaggtttcaagaggattcaccggaagcacatgccccggtctagtcccatttgaaacagttctgctttactgagaccctaggccggtctccttgctgaccctagcgctgctgcctaggtgccatttcctttcctcctcagtcaaatacaggctgcacattttgtcacttaatgccagtacaatctgtgttactcctaaggacttttgggattttgatgagacctgcgagggagaagacactgagaagccagtgatctgcaagcatttgctcttgtttccacatcacctctgggatatttcagctgttgtttccaaatggcaaatcatcaactaaaagcacttgtttcaagttttgttctgcactcccacgactgaagttgtagattgagctgaataaccatgggaagtgaccaagcaaagacactcgattggagtcagttgaatatttgtaccctcagtggagcccttctggtcttttcttccacttctgcagaatttcctctagcaaatacttctttctccttgcttgcctccaccatgatatttgaataagagatggccagaggataacacttgtctcttaaaaactaagctaaaaagaacctagaaccttcaattgagcagttgtgaaaattgctaatggtgccaaggccaagcaaagagtttcagaaaatgactgagaaggagcgataacccccagaatgcaaaatcaggggcatcattatccggtgcttgaacaaggagctccgctctacaactggtttttttaggacttgtgaggaacacagcaacggaaatccatccacaaaggatgcagtgccccaacttgtactgcgcctgaatagtcatgtgataatttactgaagaaatctagtgtactttaaatttttttcataaaagtttacattgtattgtaggttaacattaaatgttttatagcaaaaacttcataacaggctgtggatctttctgtgtgggaccgatgtggtagataattttctatgtgtgaaggagaggttgaaaaacaccgggagggaacagcatggcatggcattgccaagaaggaagggagagtcaaagagaaggatggagttaggtcttctctgttgtatccctgtggaaaaatagcaacttagtatgatggagagagagagcagacaggcctgggttcaaatttgggctctctagtttgtcaggtttgcaacctcgggcaaattctctagcttccctgaacttgaatttccccaactataaatgaagataatgccgtccacctcaggataggtttatagattcaatcaagtaaatgtatatgaggctcctgatatgtagatgtcattaagtgtttgttccccttctatgggagtgtattttgtaagaatattttcttggaataacattttctt

SEQ ID NO: 77219 - DNA, 4077 bp, Homo sapiens
  misc_feature (4076)..(4076): n is a, c, g, or t
aggtcagttccggcgggtgacggtgcggacgggtcaggagcgtagaggcggcggcaaaatggcggcgcctgaggagcgggatctaacccaggagcagacagagaagctgctgcagtttcaggatctcactggcatcgaatctatggatcagtgtcgccataccttggaacagcataactggaacatagaggctgctgtacaggacagattgaatgagcaagagggcgtacctagtgttttcaacccacctccatcacgacccctgcaggttaatacagctgaccacaggatctacagctatgttgtctcaagacctcaaccaagggggctgcttggatggggttattacttgataatgcttccattccggtttacctattacacgatacttgatatatttaggtttgctcttcgttttatacggcctgaccctcgcagccgggtcactgaccccgttggggacattgtttcatttatgcactcttttgaagagaaatatgggagggcacaccctgtcttctaccagggaacgtacagccaggcacttaacgatgccaaaagggagcttcgctttcttttggtttatcttcatggagatgatcaccaggactctgatgagttttgtcgcaacacactctgtgcacctgaagttatttcactaataaacactaggatgctcttctgggcatgctctacaaacaaacctgagggatacagggtctcacaggctttacgagagaacacctatccattcctggccatgattatgctgaaggatcgaaggatgactgtggtgggacggctagaaggcctcattcaacctgatgacctcattaaccaactgacatttatcatggatgctaaccagacttacctggtgtcagaacgcctagaaagggaagaaagaaaccagacccaagtgctgagacaacagcaggatgaggcctacctggcctctctcagagctgaccaggagaaagaaagaaagaaacgggaggagcgggagcgtaagcggcggaaggaggaggaggtgcaacagcaaaagttggcagaggagagacggcggcagaatttacaggaggaaaaggaaaggaagttggaatgcctgccccctgaaccttcccctgatgaccctgaaagtgtcaagatcatcttcaaattacctaatgattctcgagtagagagacgattccacttttcacagtctctaacagtaatccacgacttcttattctccttgaaggaaagcccagaaaagtttcagattgaagccaattttcccaggcgagtgctgccctgcatcccttcagaggagtggcccaatccccctacgctacaggaggccggactcagccacacagaagttctttttgttcaggacctaactgacgaatgacatttttttcttcctgtcccctcctaccccagtccctaaaagaaatggggaaaaaagaaaacaacagcaagtcagaaaaaaaaaacaagagagagaaattcatattattattattattataatacaatattttttttaaaagactgctgcatccttaggaaggatcagaaaccatgctgcccgtaagagtcacaacctgtgtgtgcgcgcaaggttagcaacaaacgtacccgcttggcaagcccacccttcctgtggcctctgtgcacgcaccttccagtgaacagagactcttcaccttcgacccatccattgtcccagctgggaaggggacattcccactagttctcattcattcttgcttttatgaaaaataaaagtgaaaaacctccatcaaccagctacttgcagcatctcctgaggacttgcttctcctgcctctggggaagagagggaagagaaagcacagagcagagaagcagagatgttccttgaactgcccacaagttttcaataacttttatttctgttttgtaatgaccaaaggaatgaggctgacataggtatatatatatatttttttcctttatttgataaagagccaattctttaaacccatgagtttatgccctgggctccttagcccacaatagtgtaataaaagtgccccgggctggtttgtgcttatttctgccattgtccctctcacgttcccagagaggtcattctttttggtccaactcttgctgtcctttcttaccacctgtgcaccccacttggagcagtgggaggaaatctgggtttgtggccccacaaaggctgtatatgtaaagatacacctatgtatgtggtggaactcacctttacacacaactgcagcttttccttggagtctgtaccaggtggtggttatggggtctgaaccaaaggatagcagctcttcattcctcttctgacatgtgcatgctgctccccccagccctgggctttcctgaattgccaagcctggtgcctttccaaaggactagcagggcctgtggtggagccagcagaaccacaggagagtgccctgcctgtctcagtggaagtgtattattgttttaaggatagaaccagaggccttgaagggagccaagacagaactcccagcctgtgtaatctattggaaggcacattttcatttctgatgcagccaccttctggaggcagcttttatcctttctctctattgctatgttgaagtaatagggttttttttaacctctggatgtctcgtctgtggttgagtttatggtaatgggtacatgggtcaggccatgtattaacagatgccagtgcgctctgacaagtattccaaagtgttccgtagctagactggtgcaggctcgttgtaccactgcaaccgactgacgttactgtagttcctagaatgctgtgagggcggggggttcagatcaacataaagcctaacttgctggagttgtagtctcaaggctttctctcttgcttaactaaaacctaaggaccactgtttttggtagcaattatatggttactatccactgcagtcctcagttgttggggtaaatcccacatggcagagtaaggcaccccacagaaattaacttggagagcctgagaaattcccagtggccttggcatagctgtctagaacaccatctctaggaaaatttaattctgtccctggccagctattgttcttccacttcgttttctgctgtcccaaggccagatgagtggaatcaccatctgactgttgtcaataaaatgtatctggcgtgaacagcaggataacccatgttctccacataaggataaccttacgtgaaaccttcctgctgacaaccatgcagaggaatttttccacttaagtcagagccttcctccccatctggaattcacagctgttccctggcagcacacaggagggtattaaggacctttgtgaggctaggtacactgtccacacctctttggggaagttacgattttttttttccatcataattcagtctcttcttattctacagtgtgcactttatgcctctcgccttttgataatagttgttcagtgaaggaagtcagctgccagaatattaagaagggtctccctttatgtcagtacaactgttagggcggccttcccatttactttaggtttcaagaggattcaccggaagcacatgccccggtctagtcccatttgaaacagttctgctttactgagaccctaggccggtctccttgctgaccctagcgctgctgcctaggtgccatttcctttcctcctcagtcaaatacaggctgcacattttgtcacttaatgccagtacaatctgtgttactcctaaggacttttgggattttgatgagacctgcgagggagaagacactgagaagccagtgatctgcaagcatttgctcttgtttccacatcacctctgggatattcagtgtgtcccaatgcaatctcataaagcctgttcagtgtgttggctccagatgatttgtgatgggccatacctggagggcagagacgagggcaggaattgacccgggcctggtttcatgggatctcgaaatttccgggcccattaaagggaacgtttaaaacaaacgggtgggccaaatagcacgctgttttctcgccagatatttng

SEQ ID NO: 77220 - DNA, 3989 bp, Homo sapiens
aggtcagttccggcgggtgacggtgcggacgggtcaggagcgtagaggcggcggcaaaatggcggcgcctgaggagcgggatctaacccaggagcagacagagaagctgctgcagtttcaggatctcactggcatcgaatctatggatcagtgtcgccataccttggaacagcataactggaacatagaggctgctgtacaggacagattgaatgagcaagagggcgtacctagtgttttcaacccacctccatcacgacccctgcaggttaatacagctgaccacaggatctacagctatgttgtctcaagacctcaaccaagggggctgcttggatggggttattacttgataatgcttccattccggtttacctattacacgatacttgatatatttaggtttgctcttcgttttatacggcctgaccctcgcagccgggtcactgaccccgttggggacattgtttcatttatgcactcttttgaagagaaatatgggagggcacaccctgtcttctaccagggaacgtacagccaggcacttaacgatgccaaaagggagcttcgctttcttttggtttatcttcatggagatgatcaccaggactctgatgagttttgtcgcaacacactctgtgcacctgaagttatttcactaataaacactaggatgctcttctgggcatgctctacaaacaaacctgagggatacagggtctcacaggctttacgagagaacacctatccattcctggccatgattatgctgaaggatcgaaggatgactgtggtgggacggctagaaggcctcattcaacctgatgacctcattaaccaactgacatttatcatggatgctaaccagacttacctggtgtcagaacgcctagaaagggaagaaagaaaccagacccaagtgctgagacaacagcaggatgaggcctacctggcctctctcagagctgaccaggagaaagaaagaaagaaacgggaggagcgggagcgtaagcggcggaaggaggaggaggtgcaacagcaaaagttggcagaggagagacggcggcagaatttacaggaggaaaaggaaaggaagttggaatgcctgccccctgaaccttcccctgatgaccctgaaagtgtcaagatcatcttcaaattacctaatgattctcgagtagagagacgattccacttttcacagtctctaacagtaatccacgacttcttattctccttgaaggaaagcccagaaaagtttcagattgaagccaattttcccaggcgagtgctgccctgcatcccttcagaggagtggcccaatccccctacgctacaggaggccggactcagccacacagaagttctttttgttcaggacctaactgacgaatgacatttttttcttcctgtcccctcctaccccagtccctaaaagaaatggggaaaaaagaaaacaacagcaagtcagaaaaaaaaaacaagagagagaaattcatattattattattattataatacaatattttttttaaaagactgctgcatccttaggaaggatcagaaaccatgctgcccgtaagagtcacaacctgtgtgtgcgcgcaaggttagcaacaaacgtacccgcttggcaagcccacccttcctgtggcctctgtgcacgcaccttccagtgaacagagactcttcaccttcgacccatccattgtcccagctgggaaggggacattcccactagttctcattcattcttgcttttatgaaaaataaaagtgaaaaacctccatcaaccagctacttgcagcatctcctgaggacttgcttctcctgcctctggggaagagagggaagagaaagcacagagcagagaagcagagatgttccttgaactgcccacaagttttcaataacttttatttctgttttgtaatgaccaaaggaatgaggctgacataggtatatatatatatttttttcctttatttgataaagagccaattctttaaacccatgagtttatgccctgggctccttagcccacaatagtgtaataaaagtgccccgggctggtttgtgcttatttctgccattgtccctctcacgttcccagagaggtcattctttttggtccaactcttgctgtcctttcttaccacctgtgcaccccacttggagcagtgggaggaaatctgggtttgtggccccacaaaggctgtatatgtaaagatacacctatgtatgtggtggaactcacctttacacacaactgcagcttttccttggagtctgtaccaggtggtggttatggggtctgaaccaaaggatagcagctcttcattcctcttctgacatgtgcatgctgctccccccagccctgggctttcctgaattgccaagcctggtgcctttccaaaggactagcagggcctgtggtggagccagcagaaccacaggagagtgccctgcctgtctcagtggaagtgtattattgttttaaggatagaaccagaggccttgaagggagccaagacagaactcccagcctgtgtaatctattggaaggcacattttcatttctgatgcagccaccttctggaggcagcttttatcctttctctctattgctatgttgaagtaatagggttttttttaacctctggatgtctcgtctgtggttgagtttatggtaatgggtacatgggtcaggccatgtattaacagatgccagtgcgctctgacaagtattccaaagtgttccgtagctagactggtgcaggctcgttgtaccactgcaaccgactgacgttactgtagttcctagaatgctgtgagggcggggggttcagatcaacataaagcctaacttgctggagttgtagtctcaaggctttctctcttgcttaactaaaacctaaggaccactgtttttggtagcaattatatggttactatccactgcagtcctcagttgttggggtaaatcccacatggcagagtaaggcaccccacagaaattaacttggagagcctgagaaattcccagtggccttggcatagctgtctagaacaccatctctaggaaaatttaattctgtccctggccagctattgttcttccacttcgttttctgctgtcccaaggccagatgagtggaatcaccatctgactgttgtcaataaaatgtatctggcgtgaacagcaggataacccatgttctccacataaggataaccttacgtgaaaccttcctgctgacaaccatgcagaggaatttttccacttaagtcagagccttcctccccatctggaattcacagctgttccctggcagcacacaggagggtattaaggacctttgtgaggctaggtacactgtccacacctctttggggaagttacgattttttttttccatcataattcagtctcttcttattctacagtgtgcactttatgcctctcgccttttgataatagttgttcagtgaaggaagtcagctgccagaatattaagaagggtctccctttatgtcagtacaactgttagggcggccttcccatttactttaggtttcaagaggattcaccggaagcacatgccccggtctagtcccatttgaaacagttctgctttactgagaccctaggccggtctccttgctgaccctagcgctgctgcctaggtgccatttcctttcctcctcagtcaaatacaggctgcacattttgtcacttaatgcaaaatcaggggcatcattatccggtgcttgaacaaggagctccgctctacaactggtttttttaggacttgtgaggaacacagcaacggaaatccatccacaaaggatgcagtgccccaacttgtactgcgcctgaatagtcatgtgataatttactgaagaaatctagtgtactttaaatttttttcataaaagtttacattgtattgtaggttaacattaaatgttttatagcaaaaacttca

SEQ ID NO: 77221 - DNA, 232 bp, Homo sapiens
acttagaaggatgaggtggccaggaagaaggaactgtactttagaggaacaaatcacatggaaggaccaaaaagagtgagaaaatctgacctagccatttgataaaatattagggattgagagaattgtctctaactttgtttttggactttcaggggctgcttggatggggttattacttgataatgcttccattccggtttacctattacacgatacttgatatatttag

SEQ ID NO: 77222 - DNA, 355 bp, Homo sapiens
ccttttcatacctttccacagcaacacactctgtgcacctgaagttatttcactaataaacactaggatgctcttctgggcatgctctacaaacaaacctgagggatacaggggtaagttatgtttcttctgcctcattgagattgttggagtatctttggaatagtctggaaagacatgccatgccatttattacaagtgtgtttgttctgtggtagatacgacgctagttgctattttatattgtctcatttaatcctctcagcagtcctgagagatggggggtcatattacctttgctttatggtttaggaaataggctcagagagttcaagccactggctgaagatcacac

SEQ ID NO: 77223 - DNA, 440 bp, Homo sapiens
ggttcaacagctgaactgctgtatgaatcagtaaaatgaaagttacacacagtagtttaggcagaagtatttttgggagaattgcctttcgtccatattgctttgggctgtaccatttttattgactgagtagatttttattgaggagcacttgttttttattagtattaggagagacctaaggaaagaggatgtcgtatttctgctctcatggaacttgagagtttgaatggagtagggcaagacatgtacgcaggtgtgagtagtgtcatggaggcattaagagaggagagagcttattcagcctcagtagattgtgaaggaatcagctcaccctgatccaatggtgtcttcctgttaaggtgctgtactctgataaaagttatattaaagtcattaaaatgcttatgcttcattaccagagaggttttttcttttta

SEQ ID NO: 77224 - DNA, 348 bp, Homo sapiens
cttatggacttcaagtgaattctgataaagggctaaaagtaggggaagtgtttactgttgaccttggagaggccatcctatttgattgttctgctgattctcatccccccaacacctactcctggattaggaggactgacaatactacatatatcattaagcatgggcctcgcttagaagttgcatctgagaaagtagcccagaagacaatggactatgtgtgctgtgcttacaacaacataaccggcaggcaagatgaaactcatttcacagttatcatcacttccgtaggtatgtgtgacatacaaggaagggatcctaataaaacatgaatgcatgctggccttg

SEQ ID NO: 77225 - DNA, 334 bp, Homo sapiens
ttaaacatttcctccattcatgtcaggaactcatccatataaggcctcatgagcacatggatctggtgcatggtcccctcaagctctacaggcactaggcagtcagcattgctgattggcttaaaggagctatgcacaagggtttcatccaggtcagtgaccatacagatccttccttgatttttctctgtcacctctgggagcaggcaggttcctgggatctgataaaactgatattggagacgctggagctgatccgacatagcaatggtgttgactccctccttatgtgtggattgctcagcgggggaacttgactgtccaacatgctggg

SEQ ID NO: 77226 - DNA, 857 bp, Homo sapiens
cgtccggaaagagctgttgggtctgagccggcaggcgaaggcgaaagggtctgggactacaaggtttagctcccagccagagcaggaaaggaacgactgactgttcgccatctgggtgtaattctaacctctctgcacgcccagcccgactcgtggcctgagccgcacttgtcctcctgcctcgcccactagcaacaggctgccaggtcgggaggcccctggtgcccatggtgctcttgtccatggggcttgggtgcatctgggccccgcctgcaagtgggcccggtgcatctccctagttcaggctctgcagcctgacaaggcactgaaatagcaattaagccaactaagtattggcccaggtggttcacaaaagactttttttttttcttttagttaaatctgcataaagttggatgcagtcgttttatctgcaaaggggagaggagtctttgtataaaatccataaatatgttaaattttaatttgccgatgtccttcagactatcatagcctcattaccttttattttgtataccgagatctatgctaaaaagttgtcaaaacaaatacttcaccttcaagttaagatgtaaggttttgtgctgtttctggcgagctgctgaactggcaggaaaggaataaaccagaaacaataaatcagaagcaatttgcttcttccctcatttcatgctcttcctccagcaaccagcgaaagagatcctcacatagaggccttttatttgagatcttttcacatcctgaagggagagagctggagaggtttgacctgagagagaagtgattatttccaagcctcaggaaaaaatgaaataaaatctgctaatagcgtccta

SEQ ID NO: 77227 - DNA, 445 bp, Homo sapiens
ttttaggacagatagggagatgaaggtagaatagaaataagtgcctgttaagctagggtatataaagatgtgaaaatgaataaccaggaaagtagaggatgggaggaaagtgtgtgttaaatttctctgtgcctaggtgttttcttacagaggaaatacatttggatataattgaacttgttaagagttactagatttatctgtaaatggtcactgtgctgtaacctctttttctatagattgaagaatgtgtggtatgctctgacaagaaagcagctgttctttttcaaccctgtggccacatgtgtgcttgtgagagtaagtagcctatgcagagttcctcaatattattataaaaatagaaagtgaaacaaaaattatgtttttgagggtttttttgcttttgattttgggataactccataaaaaagttgatggggcctcg

SEQ ID NO: 77228 - DNA, 7703 bp, Homo sapiens
atcttcaagttgtgaagactttattggactttggctgtcatcccagtctccaggattctgaaggtgatacccctcttcatgatgcaataagtaagaaacgtgatgatatcctagcagttcttttggaagctggagcagatgttaccatcacaaacaataatggatttaatgctctgcatcatgctgcactaaggggaaatcccagtgcaatgcgtgttttactatctaaattaccaagaccatggattgtggatgagaagaaagatgatggttatactgccttacatctggctgcccttaataatcacgtagaagtggctgaactgttggtacatcagggtaatgcaaacctggatatccagaatgtgaaccaacaaactgccctacaccttgctgttgaacgacagcatacccagattgttaggcttttggtccgtgcaggtgccaagcttgatattcaggataaggatggggatactcctttgcatgaagctctaaggcatcacactttgtctcagctacgtcagctccaagatatgcaagatgtggggaaggtggatgctgcctgggagccatccaaaaacacgttaataatgggacttggtacccagggggcagagaagaagagtgcagcatctattgcctgtttcttggcagccaatggtgctgacctgagcattcgaaataagaagggtcaatcgccacttgatctctgtcctgatccgaatctctgcaaagcactggcaaagtgtcataaggaaaaagtcagtggtcaagtgggttctcggagtccttctatgattagtaatgattctgaaaccttagaagagtgtatggtgtgctcagatatgaagagagatactctttttggtccatgtggacatattgctacctgttctttatgttctccacgtgtcaagaaatgcctcatctgtaaagaacaggttcaatccaggacaaagattgaagaatgtgtggtatgctctgacaagaaagcagctgttctttttcaaccctgtggccacatgtgtgcttgtgagaactgtgctaacctgatgaaaaagtgtgtgcagtgtcgagcagtagttgaacgaagagtgcctttcattatgtgctgtggagggaaaagttcagaagatgccactgatgatatctcaagtgggaatattccagtattacaaaaggacaaggataataccaatgtcaatgcagatgtgcaaaagttgcagcaacagttacaagacattaaagagcagacaatgtgccctgtgtgtctagatcgtctgaagaatatgattttcctttgtggtcacggaacctgtcaactctgtggagaccgcatgagtgaatgtcctatctgtcgcaaggctattgaacgaaggattcttttgtattaactaagacacatggtgtattttgttagctaatgtatctagtcatgagatcttaataggcttttgatctagttggaagttctgatgagttaatttctaatatcatagtttctttactagagtataattgggctgtaaatgtaccagaacaaaaaaccctacaaaatggtgttggaaattgtgttttttgtttttgttttaaatttgaaacatcaaattcatgtaactcataggataatttacctttggcttctaagaggaaagtcctttaaggatatccttttttaaaaaattgcatttttctcttataatttgtaaatttgttggatctcaaaagacataattctttgtgatcagttatccttcatttcatcgtggttttacacagtgagttgataacaggttctctgagaagtcatgcatcaaataaaagaggcaggtcaaacaattatgtcacatggtaaattataaaatgacagtacaagttccagatagttaagggaataccgaagggatgattctttttttaagataacaggaagttacccacatgtttgtttctgaattcttagagtaaatggaagcatagaatgagggaataatgactttgcatttctcttgttttctagattcaaaaggaacattgtttaacttgaatcagattaccagtttcaaggtgactgatagacaagaaaaggaaaaataagcaataatagtgggcaactgaagagaaaaaaaaaacgagtatctattaactggccactaacagttgcctttcttacattaatttatacactattttgttcagccagtgtttttaaaaaaaatctatgaaaagtgtacttccggttttctgtgattacttatctgggcttgatctgaccagtgaaatgacattgccctatttggacctctgaggttctatttagctttgcagatgtacatagtatcccagtgatctgcaaaattaatgccttttccaagaaaaaatcttttcttctctgtatcagttaattctgacagtgttagtgattctgtcttcattataggccttatttccattatctctttctttatagtattttttgttataaagaaaacagtctttctgtgtatacctacggatgagggtattatttaaactgccaacaatatccaagacatggtcaataacctaattataaatactttagaaagagtgaccaggacatgtatagaaatgtctgcttacctgtagactttaaaaacaaacaaaaaaaacaaacaaaatttttggagcatttaatcattttttttctccttttatctcctttgtaatcttattgtctcctgagtaaatatacacataaatgtttggggattcattgctgctagattatatcaggtgtttacatagtgtctactatatgctgttgataagctttttcctaaaaatagttatcctcttttgtagtttttttccctcctttaaatctggctagcttttcttacttcagtttttatagaacaccaactaaatttgaaagtatgaagtctctagccctcttacactgtttctggctgtttaatccttgctgcctttgcaagtcctggtgaaagcaatggggagctttgctggctggttttgtagtctcaacaattccatgtctgtgtttagctgagtaactgctatcatttagaacagtaaaatttttatagatttcaaatttgaaaattcatgtacactcagttatctaataaggggccaccgacgctgtttttaaaactattttgaagttataaaaaggtagaacatctgactgatgatgttcacataaagagacagacagactatcatgttgcagacatgaaaacagcatgtcaggtttttcctttccttccatgccatgggctacccatctcttcccactagatcacctggtgaggagggagcacctggctgactcatgcagagtttggccaatcagagaattgtgtggtctccagctctactttccttaaacaaatcctttctgttttctgagctgcagtgctaaaacagatccctaaaaggtaatagcatcttccagactagtttaattatttcctttataagaatatgacataaatttttattatagaaataatgtcattataattttagtgctagtacttgtgggttttctgtatttgtatcaccttgaaatttgttccatgaatagaaaatacttctttattcatgttttcaatcacttagaattattttaaatttattttgggtttgtgagagataataagattaagaacttcatcatttcagtgactttcctccaactctctgaatctgctacctcttattatatgtcccttagcagtacttttccagttaggttcgttaccctcctcattagctaaacctctttatcttgtgcctcaaaagagcttttacttttcttagaaacatttataaaaaagaaaaaaactgacacgcattcattcaaaaaagtatttattgggctttagggattagatacacaacagtggaaaaatggcatcttagcacactcagaatttattgtgcagcagttgtgtattttaaggaatctgtagttaaaaggaagagatccaaaggtcctgataacatttcctaacgtttcagaagagttgtcattgagtagtgtttggatttcctctctgtatccctcaccctaccattttctcctttattcttctaagattgttagcgttgttactcaaaacatacacatacaacataccagatggtgctgttctaatggtatttgttcacgtaatttaacgttcttactgcttatactatatacatatttaattttgttgggagcaagaaggttttcaagaaaagataattttgtattagtgtaggaatatattagacaaatgtttagttggtcaaattatgcataagatatttgtaactttaaacattgcaaattgaccagctagctatggaagcataaaattaattgataattaatgttggaaatacatttctaaaatttatatttttatggtgttagcctgtaagagcattttagcatattgaaatgcatgctgcttaagatgtgtctggttcaaatatcaaaacttgctgggtcatttttacatagtagaaacatactgtctatgtgttgcccaattgctgtttgtccactctgaattctggaccctttttggactaagaattagttaaattcatgaactaagagaattagagatggggtagagtaggatcaggacagtggggttacaacagataggaaaggaaagtcagcatttgagtgtagagaaaaaaagaggatcatacagatgtcatcaaattataggctttaatacaggttgctttttttaatccaaaaggaaaagcacttatcctatcagaatgtctaccatgttttatagtaataatttgtgtaaaaaattgaatttttgaatagttttttgtattttttgtgatgaaaaactcataacataaaatttaccatattaactgtttctaaagaatacagttcagccatgtgaagtacatttacactgttgtgaaacagatctccagaactttttcatcttgcaaaactgaaactccatacccattaaacaactcccctttttgttttctcctcagtggaatagaattttgactccatataaatcaagaaacacctaaattctttagttgtttgtgtttgcaagatctaaggtcatggtaaacattaagttcttaaaatttttgggagggacagtgcacctctcctctgaattgttagcaattaaattgagtaggttttaaatgtctattcattggaagggtttgttatttcattttgagccagaggggagaggcacattttaaatatcagaattagattagctttgagtttgtacaattgggaacataatagattttcataaattatgtgtgccttgttggaagtgtcaactgtctttatgtctgcttgtaaaagtttcaaaatatgttttccctcaaaaaggcaacgttacttcatttgcttgaatattatgataggaatgcttactgatattacttgatagtcatatatagcctaggaaatttaacatatatataactatagcagtattaataatgatagttgtacttctttaaaacattaaatttgaggaaactttaatgctgtctcgtgtacattgctttactacagtgagggggaatatcctttagattgagcctcaatttactggttagtagtatgtgaaactctggtataaaaacgtaaactagacagtagagccgatgaattaaaattgtaaattgctacattggcattttctacctccttttctgtcagagtattactttttccagcatttattcttatttgtgagtaaagaggaaatgggaacctgaggttaaaattgacatttttgtttcattgagaatttaagcagtaggtacaggagaagtgacttgtcacattaatttggtgcctaaatctgtaactacaagttgtgatcgacatgtacaaaatgtctaagaaaggtcatatgctgaatattttacttttcctgtatagtctgcatgatttgtttcataaacccagcttatttcctccaaaaagcaaaatggtcctgtaatttttaaagtaaaataaacgtgccattttgtctgcaatctataatttcaggaagttattgaaagttctgactcagggctttttaacagttcaagcaattgtcagttatattttggaaactccatctgtgtaattctccagtgccttgaaagaattattaacttggcaacactattaaaactttataaaagatggtctttagtgcacgtgtatcattatatacacgttttaaagtcatattgcttagcttgttaataatgattctgcatgtgtgctgggtttgggtaattctttaaaggaagttttctagatttgcacttgatgtttgttttttaaaaactgattatttatggccgtgacactgttaccagaaaagtaattctaattaagttattatgcaaagtcatctataagtagcatctgggaagaggagatcgaggccacagtttgctattttagtatgaaaggaggatctgtttgggaaacatagattgtcttcccctcaaatgaggggaaaaaaaaagaccctttgttcaaatggattctgttgtaaaaaattatttttaaaggaaatcacaaattgtatgtcattcttaatgctagtcttatagaataaatccataaaattgtttttatgttcagtatgtttatgtcattctaaatgcagcaaattcaatgatagcagttcaattgactcatagcagtgttttgtattttttctaattctttagctttcaatattggattaaagtcttgtttgtgaatatagtttccgtatggcaaatgatttcttgcttattagcttttgttaaagaatgcttagtaagagctaagcttttaaaagtaatgcaaacatttatcgttaataaaacctatggtgtaatatcatataatgcttttctttgatctttggagaattattcttttatagtagtatacatgaattttgatttttaaagcatttaaaaacaaatctcaatacattaaaaaacctgttattgttaaaaaggaaattaccatgcctttaagaaacaaggatgtacatcttcaattcagcataagtgtccacatctagaaggctctcattgcagttgtttacagttaaggtacctctatctaaagggccaaagaagcatttcatattttaacacctcacattctttcaggattaagacatatgaaaatagtctgaataggataaatttgataggaagtaacttaaccagtctggaagattcagctttttctataaaaagcttattcctcttcacaactcagatgtagatttcattttcaagaggtagatattttaaagcaatgatctatttgggttttagttttatgagtaaatcattaattgtatggtttgggggttattttattttccatgttaatataagcacttatttctgaagttattgagaggtcatctagctccagttcaaaagattatgtatatctgatgtttaagaggaaaaacatctgaaaaaatatcttttgtttatttgaaaaaagcatatatattccaactttaaaattgtgaatttattttgagtaacctctaattaactgtatttttttgtttctgttgctgtatagttagaaatttcatggcaatattttttactaaattgaaactataggttttaaaaataaagacattttagaaaatttgctt

SEQ ID NO: 77229 - DNA, 6793 bp, Homo sapiens
atcttcaagttgtgaagactttattggactttggctgtcatcccagtctccaggattctgaaggtgatacccctcttcatgatgcaataagtaagaaacgtgatgatatcctagcagttcttttggaagctggagcagatgttaccatcacaaacaataatggatttaatgctctgcatcatgctgcactaaggggaaatcccagtgcaatgcgtgttttactatctaaattaccaagaccatggattgtggatgagaagaaagatgatggttatactgccttacatctggctgcccttaataatcacgtagaagtggctgaactgttggtacatcagggtaatgcaaacctggatatccagaatgtgaaccaacaaactgccctacaccttgctgttgaacgacagcatacccagattgttaggcttttggtccgtgcaggtgccaagcttgatattcaggataaggatggggatactcctttgcatgaagctctaaggcatcacactttgtctcagctacgtcagctccaagatatgcaagatgtggggaaggtggatgctgcctgggagccatccaaaaacacgttaataatgggacttggtacccagggggcagagaagaagagtgcagcatctattgcctgtttcttggcagccaatggtgctgacctgagcattcgaaataagaagggtcaatcgccacttgatctctgtcctgatccgaatctctgcaaagcactggcaaagtgtcataaggaaaaagtcagtggtcaagtgggttctcggagtccttctatgattagtaatgattctgaaaccttagaagagtgtatggtgtgctcagatatgaagagagatactctttttggtccatgtggacatattgctacctgttctttatgttctccacgtgtcaagaaatgcctcatctgtaaagaacaggttcaatccaggacaaagattgaagaatgtgtggtatgctctgacaagaaagcagctgttctttttcaaccctgtggccacatgtgtgcttgtgagaactgtgctaacctgatgaaaaagtgtgtgcagtgtcgagcagtagttgaacgaagagtgcctttcattatgtgctgtggagggaaaagttcagaagatgccactgatgatatctcaagtgggaatattccagtattacaaaaggacaaggataataccaatgtcaatgcagatgtgcaaaagttgcagcaacagttacaagacattaaagagcagacaatgtgccctgtgtgtctagatcgtctgaagaatatgattttcctttgtggtcacggaacctgtcaactctgtggagaccgcatgagtgaatgtcctatctgtcgcaaggctattgaacgaaggattcttttgtattaactaagacacatggtgtattttgttagctaatgtatctagtcatgagatcttaataggcttttgatctagttggaagttctgatgagttaatttctaatatcatagtttctttactagagtataattgggctgtaaatgtaccagaacaaaaaaccctacaaaatggtgttggaaattgtgttttttgtttttgttttaaatttgaaacatcaaattcatgtaactcataggataatttacctttggcttctaagaggaaagtcctttaaggatatccttttttaaaaaattgcatttttctcttataatttgtaaatttgttggatctcaaaagacataattctttgtgatcagttatccttcatttcatcgtggttttacacagtgagttgataacaggttctctgagaagtcatgcatcaaataaaagaggcaggtcaaacaattatgtcacatggtaaattataaaatgacagtacaagttccagatagttaagggaataccgaagggatgattctttttttaagataacaggaagttacccacatgtttgtttctgaattcttagagtaaatggaagcatagaatgagggaataatgactttgcatttctcttgttttctagattcaaaaggaacattgtttaacttgaatcagattaccagtttcaaggtgactgatagacaagaaaaggaaaaataagcaataatagtgggcaactgaagagaaaaaaaaaacgagtatctattaactggccactaacagttgcctttcttacattaatttatacactattttgttcagccagtgtttttaaaaaaaatctatgaaaagtgtacttccggttttctgtgattacttatctgggcttgatctgaccagtgaaatgacattgccctatttggacctctgaggttctatttagctttgcagatgtacatagtatcccagtgatctgcaaaattaatgccttttccaagaaaaaatcttttcttctctgtatcagttaattctgacagtgttagtgattctgtcttcattataggccttatttccattatctctttctttatagtattttttgttataaagaaaacagtctttctgtgtatacctacggatgagggtattatttaaactgccaacaatatccaagacatggtcaataacctaattataaatactttagaaagagtgaccaggacatgtatagaaatgtctgcttacctgtagactttaaaaacaaacaaaaaaaacaaacaaaatttttggagcatttaatcattttttttctccttttatctcctttgtaatcttattgtctcctgagtaaatatacacataaatgtttggggattcattgctgctagattatatcaggtgtttacatagtgtctactatatgctgttgataagctttttcctaaaaatagttatcctcttttgtagtttttttccctcctttaaatctggctagcttttcttacttcagtttttatagaacaccaactaaatttgaaagtatgaagtctctagccctcttacactgtttctggctgtttaatccttgctgcctttgcaagtcctggtgaaagcaatggggagctttgctggctggttttgtagtctcaacaattccatgtctgtgtttagctgagtaactgctatcatttagaacagtaaaatttttatagatttcaaatttgaaaattcatgtacactcagttatctaataaggggccaccgacgctgtttttaaaactattttgaagttataaaaaggtagaacatctgactgatgatgttcacataaagagacagacagactatcatgttgcagacatgaaaacagcatgtcaggtttttcctttccttccatgccatgggctacccatctcttcccactagatcacctggtgaggagggagcacctggctgactcatgcagagtttggccaatcagagaattgtgtggtctccagctctactttccttaaacaaatcctttctgttttctgagctgcagtgctaaaacagatccctaaaaggtaatagcatcttccagactagtttaattatttcctttataagaatatgacataaatttttattatagaaataatgtcattataattttagtgctagtacttgtgggttttctgtatttgtatcaccttgaaatttgttccatgaatagaaaatacttctttattcatgttttcaatcacttagaattattttaaatttattttgggtttgtgagagataataagattaagaacttcatcatttcagtgactttcctccaactctctgaatctgctacctcttattatatgtcccttagcagtacttttccagttaggttcgttaccctcctcattagctaaacctctttatcttgtgcctcaaaagagcttttacttttcttagaaacatttataaaaaagaaaaaaactgacacgcattcattcaaaaaagtatttattgggctttagggattagatacacaacagtggaaaaatggcatcttagcacactcagaatttattgtgcagcagttgtgtattttaaggaatctgtagttaaaaggaagagatccaaaggtcctgataacatttcctaacgtttcagaagagttgtcattgagtagtgtttggatttcctctctgtatccctcaccctaccattttctcctttattcttctaagattgttagcgttgttactcaaaacatacacatacaacataccagatggtgctgttctaatggtatttgttcacgtaatttaacgttcttactgcttatactatatacatatttaattttgttgggagcaagaaggttttcaagaaaagataattttgtattagtgtaggaatatattagacaaatgtttagttggtcaaattatgcataagatatttgtaactttaaacattgcaaattgaccagctagctatggaagcataaaattaattgataattaatgttggaaatacatttctaaaatttatatttttatggtgttagcctgtaagagcattttagcatattgaaatgcatgctgcttaagatgtgtctggttcaaatatcaaaacttgctgggtcatttttacatagtagaaacatactgtctatgtgttgcccaattgctgtttgtccactctgaattctggaccctttttggactaagaattagttaaattcatgaactaagagaattagagatggggtagagtaggatcaggacagtggggttacaacagataggaaaggaaagtcagcatttgagtgtagagaaaaaaagaggatcatacagatgtcatcaaattataggctttaatacaggttgctttttttaatccaaaaggaaaagcacttatcctatcagaatgtctaccatgttttatagtaataatttgtgtaaaaaattgaatttttgaatagttttttgtattttttgtgatgaaaaactcataacataaaatttaccatattaactgtttctaaagaatacagttcagccatgtgaagtacatttacactgttgtgaaacagatctccagaactttttcatcttgcaaaactgaaactccatacccattaaacaactcccctttttgttttctcctcagtggaatagaattttgactccatataaatcaagaaacacctaaattctttagttgtttgtgtttgcaagatctaaggtcatggtaaacattaagttcttaaaatttttgggagggacagtgcacctctcctctgaattgttagcaattaaattgagtaggttttaaatgtctattcattggaagggtttgttatttcattttgagccagaggggagaggcacattttaaatatcagaattagattagctttgagtttgtacaattgggaacataatagattttcataaattatgtgtgccttgttggaagtgtcaactgtctttatgtctgcttgtaaaagtttcaaaatatgttttccctcaaaaaggcaacgttacttcatttgcttgaatattatgataggaatgcttactgatattacttgatagtcatatatagcctaggaaatttaacatatatataactatagcagtattaataatgatagttgtacttctttaaaacattaaatttgaggaaactttaatgctgtctcgtgtacattgctttactacagtgagggggaatatcctttagattgagcctcaatttactggttagtagtatgtgaaactctggtataaaaacgtaaactagacagtagagccgatgaattaaaattgtaaattgctacattggcattttctacctccttttctgtcagagtattactttttccagcatttattcttatttgtgagtaaagaggaaatgggaacctgaggttaaaattgacatttttgtttcattgagaatttaagcagtaggtacaggagaagtgacttgtcacattaatttggtgcctaaatctgtaactacaagttgtgatcgacatgtacaaaatgtctaagaaaggtcatatgctgaatattttacttttcctgtatagtctgcatgatttgtttcataaacccagcttatttcctccaaaaagcaaaatggtcctgtaatttttaaagtaaaataaacgtgccattttgtctgcaatctataatttcaggaagttattgaaagttctgactcagggctttttaacagttcaagcaattgtcagttatattttggaaactccatctgtgtaattctccagtgccttgaaagaattattaacttggcaacactattaaaactttataaaagatggtctttagtgcacgtgtatcattatatacacgttttaaagtcatattgcttagcttgttaataatgattctgcatgtgtgctgggtttgggtaattctttaaaggaagttttctagatttgcacttgatgtttgttttttaaaaactgattatttatggccgtgacactgttaccagaaaagtaattctaattaagttattatgcaaagtcatctataagtagcatctgggaagaggagatcgaggccacagtttgctattttagtatgaaaggaggatctgtttgggaaacatagattgtcttcccctcaaatgaggggaaaaaaaaagaccctttgttcaaatggattctgttgtaaaaaattatttttaaaggaaatcacaaattgtatgtcattcttaatgctagtcttatagaataaatccataaaattgtttttatgttcagtatgtttatgtcattctaaatgcagcaaattcaatgatagcagttcaattgactcatagcagtgttttgtattttttctaattctttagctttcaatattggattaaagtcttgtttgtgaatata

SEQ ID NO: 77230 - DNA, 6491 bp, Homo sapiens
  misc_feature (6310)..(6310): n is a, c, g, or t
  misc_feature (6315)..(6315): n is a, c, g, or t
  misc_feature (6325)..(6325): n is a, c, g, or t
  misc_feature (6488)..(6488): n is a, c, g, or t
atcttcaagttgtgaagactttattggactttggctgtcatcccagtctccaggattctgaaggtgatacccctcttcatgatgcaataagtaagaaacgtgatgatatcctagcagttcttttggaagctggagcagatgttaccatcacaaacaataatggatttaatgctctgcatcatgctgcactaaggggaaatcccagtgcaatgcgtgttttactatctaaattaccaagaccatggattgtggatgagaagaaagatgatggttatactgccttacatctggctgcccttaataatcacgtagaagtggctgaactgttggtacatcagggtaatgcaaacctggatatccagaatgtgaaccaacaaactgccctacaccttgctgttgaacgacagcatacccagattgttaggcttttggtccgtgcaggtgccaagcttgatattcaggataaggatggggatactcctttgcatgaagctctaaggcatcacactttgtctcagctacgtcagctccaagatatgcaagatgtggggaaggtggatgctgcctgggagccatccaaaaacacgttaataatgggacttggtacccagggggcagagaagaagagtgcagcatctattgcctgtttcttggcagccaatggtgctgacctgagcattcgaaataagaagggtcaatcgccacttgatctctgtcctgatccgaatctctgcaaagcactggcaaagtgtcataaggaaaaagtcagtggtcaagtgggttctcggagtccttctatgattagtaatgattctgaaaccttagaagagtgtatggtgtgctcagatatgaagagagatactctttttggtccatgtggacatattgctacctgttctttatgttctccacgtgtcaagaaatgcctcatctgtaaagaacaggttcaatccaggacaaagattgaagaatgtgtggtatgctctgacaagaaagcagctgttctttttcaaccctgtggccacatgtgtgcttgtgagaactgtgctaacctgatgaaaaagtgtgtgcagtgtcgagcagtagttgaacgaagagtgcctttcattatgtgctgtggagggaaaagttcagaagatgccactgatgatatctcaagtgggaatattccagtattacaaaaggacaaggataataccaatgtcaatgcagatgtgcaaaagttgcagcaacagttacaagacattaaagagcagacaatgtgccctgtgtgtctagatcgtctgaagaatatgattttcctttgtggtcacggaacctgtcaactctgtggagaccgcatgagtgaatgtcctatctgtcgcaaggctattgaacgaaggattcttttgtattaactaagacacatggtgtattttgttagctaatgtatctagtcatgagatcttaataggcttttgatctagttggaagttctgatgagttaatttctaatatcatagtttctttactagagtataattgggctgtaaatgtaccagaacaaaaaaccctacaaaatggtgttggaaattgtgttttttgtttttgttttaaatttgaaacatcaaattcatgtaactcataggataatttacctttggcttctaagaggaaagtcctttaaggatatccttttttaaaaaattgcatttttctcttataatttgtaaatttgttggatctcaaaagacataattctttgtgatcagttatccttcatttcatcgtggttttacacagtgagttgataacaggttctctgagaagtcatgcatcaaataaaagaggcaggtcaaacaattatgtcacatggtaaattataaaatgacagtacaagttccagatagttaagggaataccgaagggatgattctttttttaagataacaggaagttacccacatgtttgtttctgaattcttagagtaaatggaagcatagaatgagggaataatgactttgcatttctcttgttttctagattcaaaaggaacattgtttaacttgaatcagattaccagtttcaaggtgactgatagacaagaaaaggaaaaataagcaataatagtgggcaactgaagagaaaaaaaaaacgagtatctattaactggccactaacagttgcctttcttacattaatttatacactattttgttcagccagtgtttttaaaaaaaatctatgaaaagtgtacttccggttttctgtgattacttatctgggcttgatctgaccagtgaaatgacattgccctatttggacctctgaggttctatttagctttgcagatgtacatagtatcccagtgatctgcaaaattaatgccttttccaagaaaaaatcttttcttctctgtatcagttaattctgacagtgttagtgattctgtcttcattataggccttatttccattatctctttctttatagtattttttgttataaagaaaacagtctttctgtgtatacctacggatgagggtattatttaaactgccaacaatatccaagacatggtcaataacctaattataaatactttagaaagagtgaccaggacatgtatagaaatgtctgcttacctgtagactttaaaaacaaacaaaaaaaacaaacaaaatttttggagcatttaatcattttttttctccttttatctcctttgtaatcttattgtctcctgagtaaatatacacataaatgtttggggattcattgctgctagattatatcaggtgtttacatagtgtctactatatgctgttgataagctttttcctaaaaatagttatcctcttttgtagtttttttccctcctttaaatctggctagcttttcttacttcagtttttatagaacaccaactaaatttgaaagtatgaagtctctagccctcttacactgtttctggctgtttaatccttgctgcctttgcaagtcctggtgaaagcaatggggagctttgctggctggttttgtagtctcaacaattccatgtctgtgtttagctgagtaactgctatcatttagaacagtaaaatttttatagatttcaaatttgaaaattcatgtacactcagttatctaataaggggccaccgacgctgtttttaaaactattttgaagttataaaaaggtagaacatctgactgatgatgttcacataaagagacagacagactatcatgttgcagacatgaaaacagcatgtcaggtttttcctttccttccatgccatgggctacccatctcttcccactagatcacctggtgaggagggagcacctggctgactcatgcagagtttggccaatcagagaattgtgtggtctccagctctactttccttaaacaaatcctttctgttttctgagctgcagtgctaaaacagatccctaaaaggtaatagcatcttccagactagtttaattatttcctttataagaatatgacataaatttttattatagaaataatgtcattataattttagtgctagtacttgtgggttttctgtatttgtatcaccttgaaatttgttccatgaatagaaaatacttctttattcatgttttcaatcacttagaattattttaaatttattttgggtttgtgagagataataagattaagaacttcatcatttcagtgactttcctccaactctctgaatctgctacctcttattatatgtcccttagcagtacttttccagttaggttcgttaccctcctcattagctaaacctctttatcttgtgcctcaaaagagcttttacttttcttagaaacatttataaaaaagaaaaaaactgacacgcattcattcaaaaaagtatttattgggctttagggattagatacacaacagtggaaaaatggcatcttagcacactcagaatttattgtgcagcagttgtgtattttaaggaatctgtagttaaaaggaagagatccaaaggtcctgataacatttcctaacgtttcagaagagttgtcattgagtagtgtttggatttcctctctgtatccctcaccctaccattttctcctttattcttctaagattgttagcgttgttactcaaaacatacacatacaacataccagatggtgctgttctaatggtatttgttcacgtaatttaacgttcttactgcttatactatatacatatttaattttgttgggagcaagaaggttttcaagaaaagataattttgtattagtgtaggaatatattagacaaatgtttagttggtcaaattatgcataagatatttgtaactttaaacattgcaaattgaccagctagctatggaagcataaaattaattgataattaatgttggaaatacatttctaaaatttatatttttatggtgttagcctgtaagagcattttagcatattgaaatgcatgctgcttaagatgtgtctggttcaaatatcaaaacttgctgggtcatttttacatagtagaaacatactgtctatgtgttgcccaattgctgtttgtccactctgaattctggaccctttttggactaagaattagttaaattcatgaactaagagaattagagatggggtagagtaggatcaggacagtggggttacaacagataggaaaggaaagtcagcatttgagtgtagagaaaaaaagaggatcatacagatgtcatcaaattataggctttaatacaggttgctttttttaatccaaaaggaaaagcacttatcctatcagaatgtctaccatgttttatagtaataatttgtgtaaaaaattgaatttttgaatagttttttgtattttttgtgatgaaaaactcataacataaaatttaccatattaactgtttctaaagaatacagttcagccatgtgaagtacatttacactgttgtgaaacagatctccagaactttttcatcttgcaaaactgaaactccatacccattaaacaactcccctttttgttttctcctcagtggaatagaattttgactccatataaatcaagaaacacctaaattctttagttgtttgtgtttgcaagatctaaggtcatggtaaacattaagttcttaaaatttttgggagggacagtgcacctctcctctgaattgttagcaattaaattgagtaggttttaaatgtctattcattggaagggtttgttatttcattttgagccagaggggagaggcacattttaaatatcagaattagattagctttgagtttgtacaattgggaacataatagattttcataaattatgtgtgccttgttggaagtgtcaactgtctttatgtctgcttgtaaaagtttcaaaatatgttttccctcaaaaaggcaacgttacttcatttgcttgaatattatgataggaatgcttactgatattacttgatagtcatatatagcctaggaaatttaacatatatataactatagcagtattaataatgatagttgtacttctttaaaacattaaatttgaggaaactttaatgctgtctcgtgtacattgctttactacagtgagggggaatatcctttagattgagcctcaatttactggttagtagtatgtgaaactctggtataaaaacgtaaactagacagtagagccgatgaattaaaattgtaaattgctacattggcattttctacctccttttctgtcagagtattactttttccagcatttattcttatttgtgagtaaagaggaaatgggaacctgaggttaaaattgacatttttgtttcattgagaatttaagcagtaggtacaggagaagtgacttgtcacattaatttggtgcctaaatctgtaactacaagttgtgatcgacatgtacaaaatgtctaagaaaggtcatatgctgaatattttacttttcctgtatagtctgcatgatttgtttcataaacccagcttatttcctccaaaaagcaaaatggtcctgtaatttttaaagtaaaataaacgtgccattttgtctgcaatctataatttcaggaagttattgaaagttctgactcagggctttttaacagttcaagcaattgtcagttatattttggaaactccatctgtgtaattctccagtgccttgaaagaattattaacttggcaacactattaaaactttataaaagatggtctttagtgcacgtgtatcattatatacacgttttaaagtcatattgcttagcttgttaataatgattctgcatgtgtggcgggtggaanctaanggagttctanattgactgggtttgggttaaaaatgttttattgggggaccgttcggaaagatctataattatgcagcctaaagtcggggaggacaggccgtgtttaagaggtgggacaaatttcccagggaaacactccgtggaattacgtttgctaacaagtttcaaaaagntga

SEQ ID NO: 77231 - DNA, 7649 bp, Homo sapiens
atcttcaagttgtgaagactttattggactttggctgtcatcccagtctccaggattctgaaggtgatacccctcttcatgatgcaataagtaagaaacgtgatgatatcctagcagttcttttggaagctggagcagatgttaccatcacaaacaataatggatttaatgctctgcatcatgctgcactaaggggaaatcccagtgcaatgcgtgttttactatctaaattaccaagaccatggattgtggatgagaagaaagatgatggttatactgccttacatctggctgcccttaataatcacgtagaagtggctgaactgttggtacatcagggtaatgcaaacctggatatccagaatgtgaaccaacaaactgccctacaccttgctgttgaacgacagcatacccagattgttaggcttttggtccgtgcaggtgccaagcttgatattcaggataaggatggggatactcctttgcatgaagctctaaggcatcacactttgtctcagctacgtcagctccaagatatgcaagatgtggggaaggtggatgctgcctgggagccatccaaaaacacgttaataatgggacttggtacccagggggcagagaagaagagtgcagcatctattgcctgtttcttggcagccaatggtgctgacctgagcattcgaaataagaagggtcaatcgccacttgatctctgtcctgatccgaatctctgcaaagcactggcaaagtgtcataaggaaaaagtcagtggtcaagtgggttctcggagtccttctatgattagtaatgattctgaaaccttagaagagtgtatggtgtgctcagatatgaagagagatactctttttggtccatgtggacatattgctacctgttctttatgttctccacgtgtcaagaaatgcctcatctgtaaagaacaggttcaatccaggacaaagattgaagaatgtgtggtatgctctgacaagaaagcagctgttctttttcaaccctgtggccacatgtgtgcttgtgagaactgtgctaacctgatgaaaaagtgtgtgcagtgtcgagcagtagttgaacgaagagtgcctttcattatgtgctgtggagggaaaagttcagaagatgccactgatgatatctcaagtgggaatattccagtattacaaaaggacaaggataataccaatgtcaatgcagatgtgcaaaagttgcagcaacagttacaagacattaaagagcagacaatgtgccctgtgtgtctagatcgtctgaagaatatgattttcctttgtggtcacggaacctgtcaactctgtggagaccgcatgagtgaatgtcctatctgtcgcaaggctattgaacgaaggattcttttgtattaactaagacacatggtgtattttgttagctaatgtatctagtcatgagatcttaataggcttttgatctagttggaagttctgatgagttaatttctaatatcatagtttctttactagagtataattgggctgtaaatgtaccagaacaaaaaaccctacaaaatggtgttggaaattgtgttttttgtttttgttttaaatttgaaacatcaaattcatgtaactcataggataatttacctttggcttctaagaggaaagtcctttaaggatatccttttttaaaaaattgcatttttctcttataatttgtaaatttgttggatctcaaaagacataattctttgtgatcagttatccttcatttcatcgtggttttacacagtgagttgataacaggttctctgagaagtcatgcatcaaataaaagaggcaggtcaaacaattatgtcacatggtaaattataaaatgacagtacaagttccagatagttaagggaataccgaagggatgattctttttttaagataacaggaagttacccacatgtttgtttctgaattcttagagtaaatggaagcatagaatgagggaataatgactttgcatttctcttgttttctagattcaaaaggaacattgtttaacttgaatcagattaccagtttcaaggtgactgatagacaagaaaaggaaaaataagcaataatagtgggcaactgaagagaaaaaaaaaacgagtatctattaactggccactaacagttgcctttcttacattaatttatacactattttgttcagccagtgtttttaaaaaaaatctatgaaaagtgtacttccggttttctgtgattacttatctgggcttgatctgaccagtgaaatgacattgccctatttggacctctgaggttctatttagctttgcagatgtacatagtatcccagtgatctgcaaaattaatgccttttccaagaaaaaatcttttcttctctgtatcagttaattctgacagtgttagtgattctgtcttcattataggccttatttccattatctctttctttatagtattttttgttataaagaaaacagtctttctgtgtatacctacggatgagggtattatttaaactgccaacaatatccaagacatggtcaataacctaattataaatactttagaaagagtgaccaggacatgtatagaaatgtctgcttacctgtagactttaaaaacaaacaaaaaaaacaaacaaaatttttggagcatttaatcattttttttctccttttatctcctttgtaatcttattgtctcctgagtaaatatacacataaatgtttggggattcattgctgctagattatatcaggtgtttacatagtgtctactatatgctgttgataagctttttcctaaaaatagttatcctcttttgtagtttttttccctcctttaaatctggctagcttttcttacttcagtttttatagaacaccaactaaatttgaaagtatgaagtctctagccctcttacactgtttctggctgtttaatccttgctgcctttgcaagtcctggtgaaagcaatggggagctttgctggctggttttgtagtctcaacaattccatgtctgtgtttagctgagtaactgctatcatttagaacagtaaaatttttatagatttcaaatttgaaaattcatgtacactcagttatctaataaggggccaccgacgctgtttttaaaactattttgaagttataaaaaggtagaacatctgactgatgatgttcacataaagagacagacagactatcatgttgcagacatgaaaacagcatgtcaggtttttcctttccttccatgccatgggctacccatctcttcccactagatcacctggtgaggagggagcacctggctgactcatgcagagtttggccaatcagagaattgtgtggtctccagctctactttccttaaacaaatcctttctgttttctgagctgcagtgctaaaacagatccctaaaaggtaatagcatcttccagactagtttaattatttcctttataagaatatgacataaatttttattatagaaataatgtcattataattttagtgctagtacttgtgggttttctgtatttgtatcaccttgaaatttgttccatgaatagaaaatacttctttattcatgttttcaatcacttagaattattttaaatttattttgggtttgtgagagataataagattaagaacttcatcatttcagtgactttcctccaactctctgaatctgctacctcttattatatgtcccttagcagtacttttccagttaggttcgttaccctcctcattagctaaacctctttatcttgtgcctcaaaagagcttttacttttcttagaaacatttataaaaaagaaaaaaactgacacgcattcattcaaaaaagtatttattgggctttagggattagatacacaacagtggaaaaatggcatcttagcacactcagaatttattgtgcagcagttgtgtattttaaggaatctgtagttaaaaggaagagatccaaaggtcctgataacatttcctaacgtttcagaagagttgtcattgagtagtgtttggatttcctctctgtatccctcaccctaccattttctcctttattcttctaagattgttagcgttgttactcaaaacatacacatacaacataccagatggtgctgttctaatggtatttgttcacgtaatttaacgttcttactgcttatactatatacatatttaattttgttgggagcaagaaggttttcaagaaaagataattttgtattagtgtaggaatatattagacaaatgtttagttggtcaaattatgcataagatatttgtaactttaaacattgcaaattgaccagctagctatggaagcataaaattaattgataattaatgttggaaatacatttctaaaatttatatttttatggtgttagcctgtaagagcattttagcatattgaaatgcatgctgcttaagatgtgtctggttcaaatatcaaaacttgctgggtcatttttacatagtagaaacatactgtctatgtgttgcccaattgctgtttgtccactctgaattctggaccctttttggactaagaattagttaaattcatgaactaagagaattagagatggggtagagtaggatcaggacagtggggttacaacagataggaaaggaaagtcagcatttgagtgtagagaaaaaaagaggatcatacagatgtcatcaaattataggctttaatacaggttgctttttttaatccaaaaggaaaagcacttatcctatcagaatgtctaccatgttttatagtaataatttgtgtaaaaaattgaatttttgaatagttttttgtattttttgtgatgaaaaactcataacataaaatttaccatattaactgtttctaaagaatacagttcagccatgtgaagtacatttacactgttgtgaaacagatctccagaactttttcatcttgcaaaactgaaactccatacccattaaacaactcccctttttgttttctcctcagtggaatagaattttgactccatataaatcaagaaacacctaaattctttagttgtttgtgtttgcaagatctaaggtcatggtaaacattaagttcttaaaatttttgggagggacagtgcacctctcctctgaattgttagcaattaaattgagtaggttttaaatgtctattcattggaagggtttgttatttcattttgagccagaggggagaggcacattttaaatatcagaattagattagctttgagtttgtacaattgggaacataatagattttcataaattatgtgtgccttgttggaagtgtcaactgtctttatgtctgcttgtaaaagtttcaaaatatgttttccctcaaaaaggcaacgttacttcatttgcttgaatattatgataggaatgcttactgatattacttgatagtcatatatagcctaggaaatttaacatatatataactatagcagtattaataatgatagttgtacttctttcagtgagggggaatatcctttagattgagcctcaatttactggttagtagtatgtgaaactctggtataaaaacgtaaactagacagtagagccgatgaattaaaattgtaaattgctacattggcattttctacctccttttctgtcagagtattactttttccagcatttattcttatttgtgagtaaagaggaaatgggaacctgaggttaaaattgacatttttgtttcattgagaatttaagcagtaggtacaggagaagtgacttgtcacattaatttggtgcctaaatctgtaactacaagttgtgatcgacatgtacaaaatgtctaagaaaggtcatatgctgaatattttacttttcctgtatagtctgcatgatttgtttcataaacccagcttatttcctccaaaaagcaaaatggtcctgtaatttttaaagtaaaataaacgtgccattttgtctgcaatctataatttcaggaagttattgaaagttctgactcagggctttttaacagttcaagcaattgtcagttatattttggaaactccatctgtgtaattctccagtgccttgaaagaattattaacttggcaacactattaaaactttataaaagatggtctttagtgcacgtgtatcattatatacacgttttaaagtcatattgcttagcttgttaataatgattctgcatgtgtgctgggtttgggtaattctttaaaggaagttttctagatttgcacttgatgtttgttttttaaaaactgattatttatggccgtgacactgttaccagaaaagtaattctaattaagttattatgcaaagtcatctataagtagcatctgggaagaggagatcgaggccacagtttgctattttagtatgaaaggaggatctgtttgggaaacatagattgtcttcccctcaaatgaggggaaaaaaaaagaccctttgttcaaatggattctgttgtaaaaaattatttttaaaggaaatcacaaattgtatgtcattcttaatgctagtcttatagaataaatccataaaattgtttttatgttcagtatgtttatgtcattctaaatgcagcaaattcaatgatagcagttcaattgactcatagcagtgttttgtattttttctaattctttagctttcaatattggattaaagtcttgtttgtgaatatagtttccgtatggcaaatgatttcttgcttattagcttttgttaaagaatgcttagtaagagctaagcttttaaaagtaatgcaaacatttatcgttaataaaacctatggtgtaatatcatataatgcttttctttgatctttggagaattattcttttatagtagtatacatgaattttgatttttaaagcatttaaaaacaaatctcaatacattaaaaaacctgttattgttaaaaaggaaattaccatgcctttaagaaacaaggatgtacatcttcaattcagcataagtgtccacatctagaaggctctcattgcagttgtttacagttaaggtacctctatctaaagggccaaagaagcatttcatattttaacacctcacattctttcaggattaagacatatgaaaatagtctgaataggataaatttgataggaagtaacttaaccagtctggaagattcagctttttctataaaaagcttattcctcttcacaactcagatgtagatttcattttcaagaggtagatattttaaagcaatgatctatttgggttttagttttatgagtaaatcattaattgtatggtttgggggttattttattttccatgttaatataagcacttatttctgaagttattgagaggtcatctagctccagttcaaaagattatgtatatctgatgtttaagaggaaaaacatctgaaaaaatatcttttgtttatttgaaaaaagcatatatattccaactttaaaattgtgaatttattttgagtaacctctaattaactgtatttttttgtttctgttgctgtatagttagaaatttcatggcaatattttttactaaattgaaactataggttttaaaaataaagacattttagaaaatttgctt

SEQ ID NO: 77232 - DNA, 1949 bp, Homo sapiens
cggacgcggtgggtcgacccacgcgtccgggaaatgggaacctgaggttaaaattgacatttttgtttcattgagaatttaagcagtaggtacaggagaagtgacttgtcacattaatttggtgcctaaatctgtaactacaagttgtgatcgacatgtacaaaatgtctaagaaaggtcatatgctgaatattttacttttcctgtatagtctgcatgatttgtttcataaacccagcttatttcctccaaaaagcaaaatggtcctgtaatttttaaagtaaaataaacgtgccattttgtctgcaatctataatttcaggaagttattgaaagttctgactcagggctttttaacagttcaagcaattgtcagttatattttggaaactccatctgtgtaattctccagtgccttgaaagaattattaacttggcaacactattaaaactttataaaagatggtctttagtgcacgtgtatcattatatacacgttttaaagtcatattgcttagcttgttaataatgattctgcatgtgtgctgggtttgggtaattctttaaaggaagttttctagatttgcacttgatgtttgttttttaaaaactgattatttatggccgtgacactgttaccagaaaagtaattctaattaagttattatgcaaagtcatctataagtagcatctgggaagaggagatcgaggccacagtttgctattttagtatgaaaggaggatctgtttgggaaacatagattgtcttcccctcaaatgaggggaaaaaaaaagaccctttgttcaaatggattctgttgtaaaaaattatttttaaaggaaatcacaaattgtatgtcattcttaatgctagtcttatagaataaatccataaaattgtttttatgttcagtatgtttatgtcattctaaatgcagcaaattcaatgatagcagttcaattgactcatagcagtgttttgtattttttctaattctttagctttcaatattggattaaagtcttgtttgtgaatatagtttccgtatggcaaatgatttcttgcttattagcttttgttaaagaatgcttagtaagagctaagcttttaaaagtaatgcaaacatttatcgttaataaaacctatggtgtaatatcatataatgcttttctttgatctttggagaattattcttttatagtagtatacatgaattttgatttttaaagcatttaaaaacaaatctcaatacattaaaaaacctgttattgttaaaaaggaaattaccatgcctttaagaaacaaggatgtacatcttcaattcagcataagtgtccacatctagaaggctctcattgcagttgtttacagttaaggtacctctatctaaagggccaaagaagcatttcatattttaacacctcacattctttcaggattaagacatatgaaaatagtctgaataggataaatttgataggaagtaacttaaccagtctggaagattcagctttttctataaaaagcttattcctcttcacaactcagatgtagatttcattttcaagaggtagatattttaaagcaatgatctatttgggttttagttttatgagtaaatcattaattgtatggtttgggggttattttattttccatgttaatataagcacttatttctgaagttattgagaggtcatctagctccagttcaaaagattatgtatatctgatgtttaagaggaaaaacatctgaaaaaatatcttttgtttatttgaaaaaagcatatatattccaactttaaaattgtgaatttattttgagtaacctctaattaactgtatttttttgtttctgttgctgtatagttagaaatttcatggcaatattttttactaaattgaaactataggttttaaaaataaagacattttagaaaatttgctt

SEQ ID NO: 77233 - DNA, 4849 bp, Homo sapiens
ttctttactaaccctacaaaaaacctagtgtctataactaaagattctgaactgcccacctgcagctgtcttgatcgagttatacaaaaagacaaaggcccatattatacacaccttggggcaggaccaagtgttgctgctgtcagggaaatcatggagaataggtatggtcaaaaaggaaacgcaataaggatagaaatagtagtgtacaccggtaaagaagggaaaagctctcatgggtgtccaattgctaagtgggttttaagaagaagcagtgatgaagaaaaagttctttgtttggtccggcagcgtacaggccaccactgtccaactgctgtgatggtggtgctcatcatggtgtgggatggcatccctcttccaatggccgaccggctatacacagagctcacagagaatctaaagtcatacaatgggcaccctaccgacagaagatgcaccctcaatgaaaatcgtacctgtacatgtcaaggaattgatccagagacttgtggagcttcattctcttttggctgttcatggagtatgtactttaatggctgtaagtttggtagaagcccaagccccagaagatttagaattgatccaagctctcccttacatgaaaaaaaccttgaagataacttacagagtttggctacacgattagctccaatttataagcagtatgctccagtagcttaccaaaatcaggtggaatatgaaaatgttgcccgagaatgtcggcttggcagcaaggaaggtcgtcccttctctggggtcactgcttgcctggacttctgtgctcatccccacagggacattcacaacatgaataatggaagcactgtggtttgtaccttaactcgagaagataaccgctctttgggtgttattcctcaagatgagcagctccatgtgctacctctttataagctttcagacacagatgagtttggctccaaggaaggaatggaagccaagatcaaatctggggccatcgaggtcctggcaccccgccgcaaaaaaagaacgtgtttcactcagcctgttccccgttctggaaagaagagggctgcgatgatgacagaggttcttgcacataagataagggcagtggaaaagaaacctattccccgaatcaagcggaagaataactcaacaacaacaaacaacagtaagccttcgtcactgccaaccttagggagtaacactgagaccgtgcaacctgaagtaaaaagtgaaaccgaaccccattttatcttaaaaagttcagacaacactaaaacttattcgctgatgccatccgctcctcacccagtgaaagaggcatctccaggcttctcctggtccccgaagactgcttcagccacaccagctccactgaagaatgacgcaacagcctcatgcgggttttcagaaagaagcagcactccccactgtacgatgccttcgggaagactcagtggtgccaatgcagctgctgctgatggccctggcatttcacagcttggcgaagtggctcctctccccaccctgtctgctcctgtgatggagcccctcattaattctgagccttccactggtgtgactgagccgctaacgcctcatcagccaaaccaccagccctccttcctcacctctcctcaagaccttgcctcttctccaatggaagaagatgagcagcattctgaagcagatgagcctccatcagacgaacccctatctgatgaccccctgtcacctgctgaggagaaattgccccacattgatgagtattggtcagacagtgagcacatctttttggatgcaaatattggtggggtggccatcgcacctgctcacggctcggttttgattgagtgtgcccggcgagagctgcacgctaccactcctgttgagcaccccaaccgtaatcatccaacccgcctctcccttgtcttttaccagcacaaaaacctaaataagccccaacatggttttgaactaaacaagattaagtttgaggctaaagaagctaagaataagaaaatgaaggcctcagagcaaaaagaccaggcagctaatgaaggtccagaacagtcctctgaagtaaatgaattgaaccaaattccttctcataaagcattaacattaacccatgacaatgttgtcaccgtgtccccttatgctctcacacacgttgcggggccctataaccattgggtctgaaggcttttctccccctcttaatgcctttgctagtgcagtgtattttttcaaggtgctgttaaaagaaagtcatgttgtcgtttactatcttcatctcacccatttcaagtctgaggtaaaaaaataataatgataacaaaacggggtgggtattcttaactgtgactatattttgacaattggtagaaggtgcacattttaagcaaaaataaaagttttatagttttaaatacataaagaaatgtttcagttaggcattaaccttgatagaatcactcagtttggtgctttaaattaagtctgtttactatgaaacaagagtcatttttagaggattttaacaggttcatgttctatgatgtaaaatcaagacacacagtgttaactctacacagcttctggtgcttaaccacatccacacagttaaaaataagctgaattattatttcatggtgccattgttccaacatcttccaatcattgctagaaaattggcatattcctttgaaataaacttatgaaatgttttctctcttaaaatatttctcctgtgtaaaataaatcattgttgttagtaatggttggaggctgttcataaattgtaaatatatattttaaaagcactttctatttttaaaagtaacttgaaataatatagtataagaatcctattgtctattgtttgtgcatatttgcatacaagagaaatcatttatccttgctgtgtagagttccatcttgttaactgcagtatgtattctaatcatgtatatggtttgtgttcttttactgtgtcctctcacattcaagtattagcaacttgcagtatataaaatagttagataatgagaagttgttaattatctctaaaattggaattaggaagcatatcaccaatattgattaacattctctttggaactaggtaagagtggtctcttcttattgaacaacctcaatttagtttcatcccacctttctcagtataatccatgagaggtgtttccaaaaggagatgagggaacaggataggtttcagaagagtcaaatgcttctaatgtctcaaggtgataaaatacaaaaactaagtagacagatatttgtactgaagtctgatacagaattagaaaaaaaaaattcttgttgaaatattttgaaaacaaattccctactatcatcacatgcctccccaaccccaagtcaaaaacaagaggaatggtactacaaacatggctttgtccattaagagctaattcatttgtttatcttagcatactagatttgggaaaatgataactcatcttttctgataattgcctatgttctaggtaacaggaaaacaggcattaagtttattttagtcttcccattttcttcctattactttattgactcattttattgcaaaacaaaaaggattacccaaacaacatgtttcgaacaaggagaattttcaatgaaatacttgattctgttaaaatgcagaggtgctataacattcaaagtgtcagattccttgggagtatggaaaacctaatggtgcttctcccttggaaatgccataggaagcccacaaccgctaacacttacaattttggtgcaaaagcaaacagttccagcaggctctctaaagaaaaactcattgtaacttattaaaataatatctggtgcaaagtatctgttttgagcttttgactaatccaagtaaaggaatatgaagggattgtaaaaaacaaaatgtccattgatagaccatcgtgtacaagtagatttctgcttgttgaatatgtaaaatagggtaattcattgacttgttttagtattttgtgtgcctaaggtttcttatatacatataagtatataaataagtgattgtttattgcttcagctgcttcaacaagatatttactagtattagactatcaggaatacacccttgcgagattatgttttagattttaggccttagctcccactagaaattatttcttcaccagatttaatggataaagttttatggctctttatgcatccactcatctactcattcttcgagtctacacttattgaatgcctgcaaaatctaagtatcacttttatttttctttggatcaccacctatgacatagtaaacttgaagaataaaaactaccctcagaaatatttttaaaagaagtagcaaattatcttcagtataatccatggtaatgtatgcagtaattcaaattgatctctctctcaataggtttcttaacaatctaaacttgaaacatcaatgttaatttttggaactattgggatttgtgacgcttgttgcagtttaccaaaacaagtatttgaaaatatatagtatcaactgaaatgtttccattccgttgttgtagttaacatcatgaatggacttcttaagctgattaccccactgtgggaaccaaattggattcctactttgttggactctctttcctgattttaacaatttaccatcccattctctgccctgtgattttttttaaaagcttattcaatgttctgcagcattgtgattgtatgctggctacactgcttttagaatgctctttctcatgaagcaaggaaataaatttgtttgaaatgacattttctctcataaaactggtca

SEQ ID NO: 77234 - DNA, 135 bp, Homo sapiens
taaattacgaagagtgtctaatttttgaacttctgtacatctatatcttatatacattaagatgttcaaagccaaagccttcaagtacagattgcaattaattagtacattcccttcactgtgttttatactcag

SEQ ID NO: 77235 - DNA, 834 bp, Homo sapiens
cccaagtcaaaaacaagaggaatggtactacaaacatggctttgtccattaagagctaattcatttgtttatcttagcatactagatttgggaaaatgataactcatcttttctgataattgcctatgttctaggtaacaggaaaacaggcattaagtttattttagtcttcccattttcttcctattactttattgactcattttattgcaaaacaaaaaggattacccaaacaacatgtttcgaacaaggagaattttcaatgaaatacttgattctgttaaaatgcagaggtgctataacattcaaagtgtcagattccttgggagtatggaaaacctaatggtgcttctcccttggaaatgccataggaagcccacaaccgctaacacttacaattttggtgcaaaagcaaacagttccagcaggctctctaaagaaaaactcattgtaacttattaaaataatatctggtgcaaagtatctgttttgagcttttgactaatccaagtaaaggaatatgaagggattgtaaaaaacaaaatgtccattgatagaccatcgtgtacaagtagatttctgcttgttgaatatgtaaaatagggtaattcattgacttgttttagtattttgtgtgccttagatttccgttttaagacatgtatatttttgtgagcctaaggtttcttatatacatataagtatataaataagtgattgtttattgcttcagctgcttcaacaagatatttactagtattagactatcaggaatacacccttgcgagattatgttttagattttaggccttagctcccactagaaattatttc

SEQ ID NO: 77236 - DNA, 3920 bp, Homo sapiens
ttctttactaaccctacaaaaaacctagtgtctataactaaagattctgaactgcccacctgcagctgtcttgatcgagttatacaaaaagacaaaggcccatattatacacaccttggggcaggaccaagtgttgctgctgtcagggaaatcatggagaataggtatggtcaaaaaggaaacgcaataaggatagaaatagtagtgtacaccggtaaagaagggaaaagctctcatgggtgtccaattgctaagtgggttttaagaagaagcagtgatgaagaaaaagttctttgtttggtccggcagcgtacaggccaccactgtccaactgctgtgatggtggtgctcatcatggtgtgggatggcatccctcttccaatggccgaccggctatacacagagctcacagagaatctaaagtcatacaatgggcaccctaccgacagaagatgcaccctcaatgaaaatcgtacctgtacatgtcaaggaattgatccagagacttgtggagcttcattctcttttggctgttcatggagtatgtactttaatggctgtaagtttggtagaagcccaagccccagaagatttagaattgatccaagctctcccttacatgaaaaaaaccttgaagataacttacagagtttggctacacgattagctccaatttataagcagtatgctccagtagcttaccaaaatcaggtggaatatgaaaatgttgcccgagaatgtcggcttggcagcaaggaaggtcgtcccttctctggggtcactgcttgcctggacttctgtgctcatccccacagggacattcacaacatgaataatggaagcactgtggtttgtaccttaactcgagaagataaccgctctttgggtgttattcctcaagatgagcagctccatgtgctacctctttataagctttcagacacagatgagtttggctccaaggaaggaatggaagccaagatcaaatctggggccatcgaggtcctggcaccccgccgcaaaaaaagaacgtgtttcactcagcctgttccccgttctggaaagaagagggctgcgatgatgacagaggttcttgcacataagataagggcagtggaaaagaaacctattccccgaatcaagcggaagaataactcaacaacaacaaacaacagtaagccttcgtcactgccaaccttagggagtaacactgagaccgtgcaacctgaagtaaaaagtgaaaccgaaccccattttatcttaaaaagttcagacaacactaaaacttattcgctgatgccatccgctcctcacccagtgaaagaggcatctccaggcttctcctggtccccgaagactgcttcagccacaccagctccactgaagaatgacgcaacagcctcatgcgggttttcagaaagaagcagcactccccactgtacgatgccttcgggaagactcagtggtgccaatgcagctgctgctgatggccctggcatttcacagcttggcgaagtggctcctctccccaccctgtctgctcctgtgatggagcccctcattaattctgagccttccactggtgtgactgagccgctaacgcctcatcagccaaaccaccagccctccttcctcacctctcctcaagaccttgcctcttctccaatggaagaagatgagcagcattctgaagcagatgagcctccatcagacgaacccctatctgatgaccccctgtcacctgctgaggagaaattgccccacattgatgagtattggtcagacagtgagcacatctttttggatgcaaatattggtggggtggccatcgcacctgctcacggctcggttttgattgagtgtgcccggcgagagctgcacgctaccactcctgttgagcaccccaaccgtaatcatccaacccgcctctcccttgtcttttaccagcacaaaaacctaaataagccccaacatggttttgaactaaacaagattaagtttgaggctaaagaagctaagaataagaaaatgaaggcctcagagcaaaaagaccaggcagctaatgaaggtccagaacagtcctctgaagtaaatgaattgaaccaaattccttctcataaagcattaacattaacccatgacaatgttgtcaccgtgtccccttatgctctcacacacgttgcggggccctataaccattgggtctgaaggcttttctccccctcttaatgcctttgctagtgcagtgtattttttcaaggtgctgttaaaagaaagtcatgttgtcgtttactatcttcatctcacccatttcaagtctgaggtaaaaaaataataatgataacaaaacggggtgggtattcttaactgtgactatatttgtactgaagtctgatacagaattagaaaaaaaaaattcttgttgaaatattttgaaaacaaattccctactatcatcacatgcctccccaaccccaagtcaaaaacaagaggaatggtactacaaacatggctttgtccattaagagctaattcatttgtttatcttagcatactagatttgggaaaatgataactcatcttttctgataattgcctatgttctaggtaacaggaaaacaggcattaagtttattttagtcttcccattttcttcctattactttattgactcattttattgcaaaacaaaaaggattacccaaacaacatgtttcgaacaaggagaattttcaatgaaatacttgattctgttaaaatgcagaggtgctataacattcaaagtgtcagattccttgggagtatggaaaacctaatggtgcttctcccttggaaatgccataggaagcccacaaccgctaacacttacaattttggtgcaaaagcaaacagttccagcaggctctctaaagaaaaactcattgtaacttattaaaataatatctggtgcaaagtatctgttttgagcttttgactaatccaagtaaaggaatatgaagggattgtaaaaaacaaaatgtccattgatagaccatcgtgtacaagtagatttctgcttgttgaatatgtaaaatagggtaattcattgacttgttttagtattttgtgtgcctaaggtttcttatatacatataagtatataaataagtgattgtttattgcttcagctgcttcaacaagatatttactagtattagactatcaggaatacacccttgcgagattatgttttagattttaggccttagctcccactagaaattatttcttcaccagatttaatggataaagttttatggctctttatgcatccactcatctactcattcttcgagtctacacttattgaatgcctgcaaaatctaagtatcacttttatttttctttggatcaccacctatgacatagtaaacttgaagaataaaaactaccctcagaaatatttttaaaagaagtagcaaattatcttcagtataatccatggtaatgtatgcagtaattcaaattgatctctctctcaataggtttcttaacaatctaaacttgaaacatcaatgttaatttttggaactattgggatttgtgacgcttgttgcagtttaccaaaacaagtatttgaaaatatatagtatcaactgaaatgtttccattccgttgttgtagttaacatcatgaatggacttcttaagctgattaccccactgtgggaaccaaattggattcctactttgttggactctctttcctgattttaacaatttaccatcccattctctgccctgtgattttttttaaaagcttattcaatgttctgcagcattgtgattgtatgctggctacactgcttttagaatgctctttctcatgaagcaaggaaataaatttgtttgaaatgacattttctctcataaaactggtca

SEQ ID NO: 77237 - DNA, 241 bp, Homo sapiens
tctctagtagacatagtagataagaaagcaaaaacatgcaataaattactgtagttattgtgaagaagcccgtataggatggaggtacaggtcaattgtagttgaagggattcaggaaagacttcatagatgagggaagtcttgcttgaagtgactcctcaaagatgaataaatgcttgccatgtggtgagtgaggagggacctttcagacagaatatgcaatgagacaggggacaaaggc

SEQ ID NO: 77238 - DNA, 726 bp, Homo sapiens
cccccttcacacccacccaaaaagcatcattgactaaaattttaaactaataaccaacagggtattgataccaaaagcagctgttaaagaaatagcacttcaggccaggcacagtggctcacacctataatcccagcactttgagaggccaaggtgggaggatcacttgagcccaagaggtcaagaccagcctggacaacacagtgaaacctcatctctacaaaaaataaaaattagccaggcatggtggcacattcctgtagtaccagatactcaggaggctgaggtgggaggattgcttgagcccaggaggttgagggtgcaatgagtcgtgattgcaccactgcgctccagcctgggtggaatgacagagtgacaccgtgagacagagggagtgggtgagagtgagaccgtgtctcaaaaaaaaaaaaaaaagaaatgctactcgaaagataagacaccgtgaatgattattggaagaactattcaaatatgtaaaatccagtttttggaaagacaatgtcacctgcctcacctgctgcactcatgtttccttctgcaacctgcttcccttctgcccacaactgaagttcctcaccttgttctgctttttcatttttcaatatacttctcaccttctaataaacctcgtgaattgcttatctgttacatgtattgtttcttgtctcgatcttcctgctggaatgcaagctccatgaaggcaga

SEQ ID NO: 77239 - DNA, 339 bp, Homo sapiens
ctctcgttggggcttgtaactctagcgaattgcattttttcctaattacaggaaaaatagcaaattggcaaacatcaggaagtgggtacacctcctctgatttacaaggaagagtgtaaggtgactttatagctcaggaattcagtgaaataaatttatggttagaaaaattcatgttctttatgtgatgaaggtcctttaacttttaacacgcttctccagttaagctgagcaggactcacacggaaatggctgtctacagctgccgcaaattgatttatccccagataattgtcagagctgcagaccaaattgttagaaagaaacagttctttaatt

SEQ ID NO: 77240 - DNA, 292 bp, Homo sapiens
gattggaggaagaatccagagaattcccctcaaatacaccagtgcccttcagaagaatgaagtcaaaacacggagacagaatcctgggacctagggtgggaaagaatggagtctaagctctgcccacccattcagcaggtaggcaaggtgagcctgtctgccactgttcctgctctgaggataaggaggtgaaacaacctggtcaacagcattacctcctggtgctgacagttcctgtgtgggaaaacagacaatcaataagttaaaaacaaacaaacaaaaaaagatgata

SEQ ID NO: 77241 - DNA, 438 bp, Homo sapiens
cttgacgctgtccccaggctctgcggggccaggaatagggccactgggcctggggtccttgtagttcaagggtcaccctgaactgcggggctctaactatagagaccctggggcagtgacgcctgtgcaacctgcccgcctgtcactccctcccccaacccctcacacttgccctgcctccttgacctgccctgcccacccctcaccctcaccctcacgctgcccccttatcccgcccctggcacctgccctgcccttcccctcctgtgatggttaatactgagtgtcaacttgattggactgaaggatgcaaagtatcgatcctgggtgtgtctgtgagtgtgttgccaaagaagattaacatttgagtcagtggctgggaaaggcagacccatccttaatctgggtgggcaccatctaatcagctgccagctctgc

SEQ ID NO: 77242 - DNA, 427 bp, Homo sapiens
ctgccaacccgttcagcctcacagctcaaacagcatgttcccggcagtacccgaagccaggttctgtgaccttgggatgctttggtgggccacctgggtaatagcaaggtacctgatgtgcattacttcatttaatccatacaagaaatgtatgaaatcactactatcctgctatttcacagatgagaaacctgagacttagagagaatgtgacttgcttaaacccataaatgttggagccagaacccaagaaatttgacaagcaattttgaaccactttgttcactttctcaagcaatcctcccgcctcagcctcccaaagtgctgggattacaggcacgagccaccacacccagcagtattactgttctaatcaggcctcatcatatgagatgttgggtgtatgggactcagggctgagagagaa

SEQ ID NO: 77243 - DNA, 678 bp, Homo sapiens
caattaagtccaagttccagcgccctagaaggcaacaggcttaagaggcagaggagggatctgggggaggggcgagaaagagcgtttagaaagcgagaattgacttcagagaaagagcacaggactgggggaggggccctctggttctcgtctctgccctgccggagactgggacatccttttctccctgggtctgtgtccccgtcgctacatcccagcctggagggcatggcccagcggttgcataggtccctcggtttctgcagagcccgggagtcaccctattttggtaaaggtgaattgctcctccatgggtcgtgaaagaagatcatgtcagtggtggtgtttctgctcgtctcagaagggaagtctgtgacccgtgggagttgctggggagggcctggtctgggccaggcctcttctttgggttgccccctcacacactctggtcatccaggaagcctctgtggccctcggaatgtgtaaaagatggtggttttaggagctgctggttttgcaactgagtgctgacggcttatttcttgttaatgattctgtcaaaagtgtcttagcgatgctcttcagcccttcatcacccacccaaaaaagattaaagtggattcttcatcagctattttaaaatcacctaagaattatacaatcctttggagaatcaaa

SEQ ID NO: 77244 - DNA, 452 bp, Homo sapiens
cttcctcagccttctgccatcagacctgcaaacttgcctgcctacacttccttgctttcctccctccctccagttctaatgtcttctgattctctccaaggtgaattgctcctccatgggtcgtgaaagaagatcatgtcagtggtggtgtttctgctcgtctcagaagggaagtctgtgacccgtgggagttgctggggagggcctggtctgggccaggcctcttctttgggttgccccctcacacactctggtcatccaggaagcctctgtggccctcggaatgtgtaaaagatggtggttttaggagctgctggttttgcaactgagtgctgacggcttatttcttgttaatgattctgtcaaaagtgtcttagcgatgctcttcagcccttcatcacccacccaaaaaagattaaagtggattcttcatcagctattttaaaatcacc

SEQ ID NO: 77245 - DNA, 663 bp, Homo sapiens
tgctgggaggagctgcccaggtgtgctgaggggcctgtactcaggaagagaaacagggaatcctccacagcactagaaaaacaccccaactcaccaatgacagcaaagcagatattggaagtcattcagaaagaagggttaaaagaaacaagttctggaagacagaaagcccagattaaggttggcagtgtccgtttctgtttcagaccccggcatggcttggagacagcgttggtgtgtatgaaggatcttcctccaatgaaggatttgggacaactttccatgatgattatattagagcctcagctgctttcgtgttggtcatgaggtgatgctgaaccgaatgcttgaactagcaggagtggctgggattgcattggagtggttccgttcattccttccggtggaacctctccattagcctgtctgaatgcaatgcttcacactaacactcgaataggggatggaacattcttcaaaatccctggaaagtcaggcctctatgctctcaaaaaagaggagtcgtcatgcccagcagatggcacgttggatttagtctgtgaatctgaattggatggtacagatatggccgaggcaaatgcccatggagaagaaaatggagtcatgttcgggaccactctacaagtacagaagatgtgtata

SEQ ID NO: 77246 - DNA, 524 bp, Homo sapiens
tgctgggaggagctgcccaggtgtgctgaggggcctgtactcaggaagagaaacagggaatcctccacagcactagaaaaacaccccaactcaccaatgacagcaaagcagatattggaagtcattcagaaagaagggttaaaagaaacaagtttcagaccccggcatggcttggagacagcgttggtgtgtatgaaggatcttcctccaatgaaggatttgggacaactttccatgatgattatattagagcctcagctgctttcgtgttggtcatgaggtgatgctgaaccgaatgcttgaactagcaggagtggctgggattgcattggagtggttccgttcattccttccggtttgttcgaagcaggtaactgatgaagcatcttccactcgagattcaagccttactaacacagcagtgcaaagcaagttagtgtcttccttccagcagcacaccaaaaaggctcttaaacaggctttgaggcagcagcagaaaagaagaaatggagtctcaatgatgg

SEQ ID NO: 77247 - DNA, 451 bp, Homo sapiens
gagcaccccgtggaatcccccacgtcatcatcagaaccatcaatgagatgcaaacatgaaagacaagaggaagaagaaggaccgcacctgggccgaggctgcccgcctggcactagaaaaacaccccaactcaccaatgacagcaaagcagatattggaagtcattcagaaagaagggttaaaagaaacaagtggaacctctccattagcctgtctgaatgcaatgcttcacactaacactcgaataggggatggaacattcttcaaaatccctggaaagtcaggcctctatgctctcaaaaaagaggagtcgtcatgcccagcagatggcacgttggatttagtctgtgaatctgaattggatggtacagatatggccgaggcaaatgcccatggagaagaaaatggagtcatgttcgggaccactctacaagtacagaagatgtgtata

SEQ ID NO: 77248 - DNA, 887 bp, Homo sapiens
agctctgggccttgagactgggatgtagcttggcttacacctcaccttgctgggctctcacctgggctgccagcagaggtgttaagtggggcacagctgtggcagggaacagggaagaaagggaggaggccagctccccagacagcctagacctcgtatggtgagccaatatcagtgacacccaagtgtcctctagttctcagcccccaaggtggccctggagcagggacttcctccggcccggggaacccagggaagcccctttctctgctgcactgacaccggttctttgccttcaaaaaggaggaaacaaatgagctgatgtgaagactgaaattaccctggactacagatggcagtggggtagtggtgggacagttcagggctccagatggagggggacagttcagggctccagatggaggggaagatgctccctctgggcagttctaggtacccagctcctacaggggtcactgccaaggccaagatgccccaggaaggtggcacacgccccggggagggcattgtttcatgtgtgactacaacctctgaataaacacaggcgcagactctcaggctaaatatagcctggcaagtgtgagaggtgggtggggagctggtttggggggagcaagatgcacccaggatggaggggcacccttccctgagtcacctctgctggtgctggggaaccagcgttacctttagatgggccaggccccggattcacatggaggggaaccatactctacagtttgtagagggcagaggttggaggtggggaggtgcacacaggatggactctggagcccatcagactgggttcactactgagcctcagtttcctcatctgaaaaaatgggataatagcacttacctaccca

SEQ ID NO: 77249 - DNA, 313 bp, Homo sapiens
tgtctcaggcacgctctgattatctgagataatattctcagaggattcctttgaaacactagtgataacattatggaggtcttgggccactgaggttctcttcagtgggttttttttttttttttttttttgggaattgggattttggtggggtcgccaaggtgggagtgagggggcggcaatctcgggttaatgggcaccctctgcttcgggggtcaaaggctgtcctcgtgcctcagcttccggagtagccaaaataaggggggggtgcaccaccccaagaaattttctgtgtatattaagaaaagagggg

SEQ ID NO: 77250 - DNA, 314 bp, Homo sapiens
ctgtaaaaaaatttttttttcttcctgtgagaaattgagactcttaaaagttaaagtctactaatgaaagattatttgcttgtgcctgttttctacattcatttttctttaaaggttgactcttatttttaccctcccaaatccagactcttctatgtactctccttaaattttaaactcccaagctttgtatagaagtcgataatctggtccagatgctgaaaagaagacaaagctttcacatttgcaatattggcttcattttctggacttctgttgttttaatcatgagtgttcatgtttctttaaaacag

SEQ ID NO: 77251 - DNA, 419 bp, Homo sapiens
tgtcctctctctcttcttagatgatctcatccatttccatgactacaaccactcaatgattcccaaatttatatctctaggtccaggcctgtctctagaaacatttactggggtgtcccgtcggcactgtagacatttgagacaatgccatttcaacgcagacttcctcctgatttctctcactcccaaattgttgagttcattcatttgttgaatgaatatttattattctattcagccatacaaatagttgacttattgattatttactggatgtgtcagactctcgtttaagctttaatctttataacaccgtcgtgaattagatactattcttgtttccattttacaggtgaggaaattgaggcccagaaagtttaagaagtagcatgcctaaattaaagagcagtaagtggtag

SEQ ID NO: 77252 - DNA, 544 bp, Homo sapiens
ctaaagtcaaattatgtggtttaagtcaccctctgtacagcaactttaaatctactttctgtacttccattttgtttctgtgtaactgaaaacttcaaacactctcattctaattctacactattcctggaaatcctttctctttgatatatttatctaatttcatattctaatgtgtttttcctttcagacacaacaatcaactactcaaagatgccatctaatgcactatgccactaagtattgtggccagagagttattttaagtgtaataaattatcttaaaattgagggccgggcatagtggctcatgcctgtaatcctagcactttgggaggccgaggcgggtgaattgcctgaggtcaggagttcgagaccagcctgggccacacagtgaaacccagtctctactaaaatacaaaaaatcagctggccgtggcggcgtgcgcctgtagtcccagccactcgggaggctgagacaggagaattgcttgaacccggcaggcagaagttgcagtgagccgagatcgcgccactgcactcc

SEQ ID NO: 77253 - DNA, 1957 bp, Homo sapiens
gccctttccttttacttccttgcgagtcatagagctgtagggggatagacgtcttcccgcactcaggcgccggttgaggctgcgctcctggcgaaggacaggtgctcctttcagccggttaacgttcagctcaagaccggattaagtctcttgctctccaaataaaattgtaaaggtttggaaatatagaaccacatttttaccaaaaacctactagagagcattcgtcagcttgcccttttcgccccgaaaaacgactttttcattcacagcctgtctcttcctctttttaaatttatgccgacagaggaagaagctgatatttaacaaataacaagaggttgcgataaatagaatttaaggtgggaaagcagccgccaaactgacaaatcgtcttcgagaccgacaagaaaatagtagtccggaatttggctaatggatggagaaggtggtcgtttttcatagacccttacggagaatatctagtgaagctaaagagatcaccataaacttatgcattcaaacgcatttctggaacagaggtcgtaaccgattttgtttccatcatcagtcctgaacagttgattatttatataatcaactgttatttatataaaggtaataaaaatattacctttcctcctcctttacaatgaatatctgttagaacacctgccagtgtaacaatcagactacaaggctacaggattatgattactgtctcggatgatgagcccggggtcctacaaatcatgacccccgccggcccctcattctgcccatatttgccaaacgtctgcatcagtaatttgaataatttaaaatagttccaaaacagcaaagctcagcagttacgcaaagaaacaagaatggaaaacatcccctcaggcacagagaagtgtccacccctttgggtggaggaattatacaaatcaggagaaagataaggacaatagcagttcatcacgatttatcccgcctctgcaatgttctagacaaattaactcggagcgctccaatggacccgcatttgtctctttactattcaatcgctgtaagatatacggagactgcatcactttaaatgggagtatcaattgctttgtggttatgctggattttgtgttattgctcagtcactaaagtaagaaaaatctatatggcttgtcaaatttatgcctattgtatttcgccccctgctggtttagctcgtgtgcaagcttgaatttgtgtgtgtgtagaaactagaaattgattttaaacgaacacatgcttgttttcattttacagctctactaaacagaaatatcaaaataagaacatatgactagaccttaaagcagaccctacactaagaacatgtttaaactaaatgaatttaaactgcactccagcctgcgcgacagagtgaaaccctgtctaaaaaaaaattaaattaaattgcacaccccccatcagcttacaattttgtaatagggaaattgagtacctatttggccaactaacttgtaattggtaatcttacatgtaattccgaagacagtgccctaatgctcatgacattttattacaaagggaaagtatttgagtgtttttaaggtgataaatctgtgggaaatataaagtccatttcatttggagtcaatgatagtattgtttttatttaccttttaaaaattatggccataactgcattacctaagatttggcatcaagaaaagaagaagaaaaaaattaccagttaacatttgttgtatttacttctagtttttttttcctgtgcgtactttttacaaacttgtaatcataatttaagtagattttgtgtcccttttgtgttgtaagcatttccacccatcgtttaatgtaaaaccttaattttaattggctgcttagtagtcaatggaatgaccactatatggatagttttcagtattataaaataatacttagatga

SEQ ID NO: 77254 - DNA, 599 bp, Homo sapiens
acctactcagaaggaaaataatacttggtttagagatttaaatgctgtaatttacaagtaaactctctcaccaaatgaattttaaataagtgtcagaggcaagcatttaaaatttgtgaagggaaagaagatttgaaaattgcagtggtttcttttactggaggaaacagaatcccaacttaattggattgcgttacaggttgccgctgtaagtgcctttgcccagactctgcgaagatacacgtcgcttaatcacctggcccaggcagctcgtgcagtgcttcagaacacttcccaaatcaaccagatgcttagtgacctcaaccgtgtcgactttgccaatgtccaggagcaggcttcctgggtgtgccagtgtgatgacaacatggttcagagactagaaacagacttcaagatgactcttcagcagcagagcaccctggagcagtgggctgcgtggcttgacaatgtgatgatgcaagcactgaaaccctatgaaggaagacccagttttcctaaagccgccaggcagtttctgctaaaatggtctttctacaggtatcatctaggtttttcctaggctttcttcttcatattct

SEQ ID NO: 77255 - DNA, 3164 bp, Homo sapiens
  misc_feature (15)..(16): n is a, c, g, or t
  misc_feature (18)..(18): n is a, c, g, or t
agcggtacttctgcnncnactacaaacagtactttaaagacaggccttccactgccattcagagagccatggaggatactctagtttctttgggaagataaacactcaatctgctagttaagagacaaagctcaagagaaataagctgaagctgtaacctccatttcaaacttgtggttctgcagaccatcatgcagacatcagagactgggtcggacacaggctcgacagtgaccttacaaacatctgtggctagtcaagcagcagtgcctacgcaggtggtacagcaagtaccagtacaacaacaggtacagcaggtacagactgtgcagcaggtacaacatgtctatcccgctcaggtgcagtatgtggaaggaagcgatactgtctataccaatggagcaatccgaacaacaacgtatccttacacagagacacagatgtacagccaaaatactggagggaattactttgatactcaagggagttccgcccaggtgactaccgtggtctcatcccacagtatggtgggcactggtgggattcagatgggcgtcacaggaggacaactcatcagcagctctggaggaacctatctgatcggcaactcaatggagaattctggtcactcagtgacacacacaactcgggcctccccagcgacaattgaaatggcgattgagacgctgcaaaagtctgacggtctgtccactcacagaagctctcttctcaacagccatctccagtggctgttggacaattatgagacagcagaaggagtgagccttcccagaagcactctgtacaaccactaccttcgacactgtcaggaacacaaactggacccagtcaatgctgcctcttttggaaaattaataagatcaatttttatggggctacgaaccaggagattgggcactagaggaaactccaaataccactactatgggattcgtgtcaagccagattcccctcttaatcgtctgcaagaagacatgcagtatatggctatgagacaacaacccatgcaacagaaacaaaggtacaagcctatgcagaaagtggatggggttgcagatggtttcacaggaagtggtcaacagacaggcacatctgttgagcaaactgtaattgcccaaagccaacatcatcaacagtttttagatgcatctcgagcacttccagagtttggagaagttgaaatctcttctctgccagatggtactacctttgaggatatcaagtcactgcagagtctttatagagagcactgtgaggcaatattggacgttgttgtgaatcttcaatttagcctgatagaaaaattgtggcaaacattctggcgctattctccctctactccaactgatggcactaccattaccgaatcgagcaatctgagtgaaatagaaagtcgacttccgaaagcaaagctgataactctgtgcaaacatgagtctatcctgaaatggatgtgtaactgtgaccatgggatgtaccaggctttggtggagattctcatccccgacgtccttagacctattcctagtgccttgacccaagccattcgaaattttgcaaaaagccttgaaggttggctttccaatgccatgaacaatattccacagagaatgatacaaaccaaggttgccgctgtaagtgcctttgcccagactctgcgaagatacacgtcgcttaatcacctggcccaggcagctcgtgcagtgcttcagaacacttcccaaatcaaccagatgcttagtgacctcaaccgtgtcgactttgccaatgtccaggagcaggcttcctgggtgtgccagtgtgatgacaacatggttcagagactagaaacagacttcaagatgactcttcagcagcagagcaccctggagcagtgggctgcgtggcttgacaatgtgatgatgcaagcactgaaaccctatgaaggaagacccagttttcctaaagccgccaggcagtttctgctaaaatggtctttctacagctcaatggttattcgggacttaaccttacgcagtgctgctagctttggctccttccacctgatccgtctactctacgacgaatatatgttttacttagtagaacatcgtgttgctcaggcaacaggagagactcctatagcagtcatgggcgaggtaagagaggctgaaagagctgtgacccactgggttattaaaaataagccagaattacacttcagtctaaatacattattgattaaaaccatggttcctaaccaagtcagcctcagagccaggagggactgtggagttattgcaagagttccttaaattcctctgttcttatgtgcttaatcaaaagattctaaaattgtggattatatcatgtgaaagttcatggaatgtgtctctatattatacaggtacctatgtaaaagaaaaacttgagaaccactggaatatgaaaaatattttaagtgggaaaaagattggtgctcctgataaagcaaagggctaggaatacaatggaaaggattaaatatgtattttgtagactctttcccggtctccaagaacaaagtaaatgattctattttagaaggataaaaatggtaatgatgataactaacattttttggacacttactatgtgcgaggcacagttctatgttttttacatgtaataaagcacttaatgcaagtctttgagatacgttctactttattctgttttacaataagcatccgaggtttatgcagaaagctaaggcacagaaaggttaaatgattactcagctaaaaaatggtagagatttttttttcaaacacagtctgattttcaaacccatatgcttctaaccactaatgatgtaagggggaaaattctcttcttcagaatttctgaatagtcatcaaaatggcttatcaaaaagcttaaactctgaatataacaagggctggttaatataatgaggaatagatgcaaatgctcagatggttcagcactggcttattttgttatattgaatgcaggaggcgggggtagtttataccttgtcgaatcataccagattattaaatgtgacaaattacccaaggcggtaaaaaagacatgttcacttttaagctatgtgtatgtgcttatataaataaaaaagagtgaaaacagatattattcaa

SEQ ID NO: 77256 - DNA, 3220 bp, Homo sapiens
  misc_feature (171)..(171): n is a, c, g, or t
ctccccgtgcgagtgtctccctctccctctcgctctctctctctctccctctctctctctctttgtgagttatagcaaccgtgccttgtgaatcaagcgccatagtcaccgtagtcctggcgactgttacccatcaacaacaactactcctctcctcctcctcctcctctncctcctcctcctccccaccacaccatctccatcacccaccaacaacaccacaataatccacagccaagagaccatcatgcagacatcagagactgggtcggacacaggctcgacagtgaccttacaaacatctgtggctagtcaagcagcagtgcctacgcaggtggtacagcaagtaccagtacaacaacaggtacagcaggtacagactgtgcagcaggtacaacatgtctatcccgctcaggtgcagtatgtggaaggaagcgatactgtctataccaatggagcaatccgaacaacaacgtatccttacacagagacacagatgtacagccaaaatactggagggaattactttgatactcaagggagttccgcccaggtgactaccgtggtctcatcccacagtatggtgggcactggtgggattcagatgggcgtcacaggaggacaactcatcagcagctctggaggaacctatctgatcggcaactcaatggagaattctggtcactcagtgacacacacaactcgggcctccccagcgacaattgaaatggcgattgagacgctgcaaaagtctgacggtctgtccactcacagaagctctcttctcaacagccatctccagtggctgttggacaattatgagacagcagaaggagtgagccttcccagaagcactctgtacaaccactaccttcgacactgtcaggaacacaaactggacccagtcaatgctgcctcttttggaaaattaataagatcaatttttatggggctacgaaccaggagattgggcactagaggaaactccaaataccactactatgggattcgtgtcaagccagattcccctcttaatcgtctgcaagaagacatgcagtatatggctatgagacaacaacccatgcaacagaaacaaaggtacaagcctatgcagaaagtggatggggttgcagatggtttcacaggaagtggtcaacagacaggcacatctgttgagcaaactgtaattgcccaaagccaacatcatcaacagtttttagatgcatctcgagcacttccagagtttggagaagttgaaatctcttctctgccagatggtactacctttgaggatatcaagtcactgcagagtctttatagagagcactgtgaggcaatattggacgttgttgtgaatcttcaatttagcctgatagaaaaattgtggcaaacattctggcgctattctccctctactccaactgatggcactaccattaccgaatcgagcaatctgagtgaaatagaaagtcgacttccgaaagcaaagctgataactctgtgcaaacatgagtctatcctgaaatggatgtgtaactgtgaccatgggatgtaccaggctttggtggagattctcatccccgacgtccttagacctattcctagtgccttgacccaagccattcgaaattttgcaaaaagccttgaaggttggctttccaatgccatgaacaatattccacagagaatgatacaaaccaaggttgccgctgtaagtgcctttgcccagactctgcgaagatacacgtcgcttaatcacctggcccaggcagctcgtgcagtgcttcagaacacttcccaaatcaaccagatgcttagtgacctcaaccgtgtcgactttgccaatgtccaggagcaggcttcctgggtgtgccagtgtgatgacaacatggttcagagactagaaacagacttcaagatgactcttcagcagcagagcaccctggagcagtgggctgcgtggcttgacaatgtgatgatgcaagcactgaaaccctatgaaggaagacccagttttcctaaagccgccaggcagtttctgctaaaatggtctttctacagctcaatggttattcgggacttaaccttacgcagtgctgctagctttggctccttccacctgatccgtctactctacgacgaatatatgttttacttagtagaacatcgtgttgctcaggcaacaggagagactcctatagcagtcatgggcgaggtaagagaggctgaaagagctgtgacccactgggttattaaaaataagccagaattacacttcagtctaaatacattattgattaaaaccatggttcctaaccaagtcagcctcagagccaggagggactgtggagttattgcaagagttccttaaattcctctgttcttatgtgcttaatcaaaagattctaaaattgtggattatatcatgtgaaagttcatggaatgtgtctctatattatacaggtacctatgtaaaagaaaaacttgagaaccactggaatatgaaaaatattttaagtgggaaaaagattggtgctcctgataaagcaaagggctaggaatacaatggaaaggattaaatatgtattttgtagactctttcccggtctccaagaacaaagtaaatgattctattttagaaggataaaaatggtaatgatgataactaacattttttggacacttactatgtgcgaggcacagttctatgttttttacatgtaataaagcacttaatgcaagtctttgagatacgttctactttattctgttttacaataagcatccgaggtttatgcagaaagctaaggcacagaaaggttaaatgattactcagctaaaaaatggtagagatttttttttcaaacacagtctgattttcaaacccatatgcttctaaccactaatgatgtaagggggaaaattctcttcttcagaatttctgaatagtcatcaaaatggcttatcaaaaagcttaaactctgaatataacaagggctggttaatataatgaggaatagatgcaaatgctcagatggttcagcactggcttattttgttatattgaatgcaggaggcgggggtagtttataccttgtcgaatcataccagattattaaatgtgacaaattacccaaggcggtaaaaaagacatgttcacttttaagctatgtgtatgtgcttatataaataaaaaagagtgaaaacagatattattcaa

SEQ ID NO: 77257 - DNA, 3287 bp, Homo sapiens
  misc_feature (171)..(171): n is a, c, g, or t
ctccccgtgcgagtgtctccctctccctctcgctctctctctctctccctctctctctctctttgtgagttatagcaaccgtgccttgtgaatcaagcgccatagtcaccgtagtcctggcgactgttacccatcaacaacaactactcctctcctcctcctcctcctctncctcctcctcctccccaccacaccatctccatcacccaccaacaacaccacaataatccacagccaaggccacttggtcattctggcattttatggtagagaatacgttgagtttggctctggaaggaatatgagagaccatcatgcagacatcagagactgggtcggacacaggctcgacagtgaccttacaaacatctgtggctagtcaagcagcagtgcctacgcaggtggtacagcaagtaccagtacaacaacaggtacagcaggtacagactgtgcagcaggtacaacatgtctatcccgctcaggtgcagtatgtggaaggaagcgatactgtctataccaatggagcaatccgaacaacaacgtatccttacacagagacacagatgtacagccaaaatactggagggaattactttgatactcaagggagttccgcccaggtgactaccgtggtctcatcccacagtatggtgggcactggtgggattcagatgggcgtcacaggaggacaactcatcagcagctctggaggaacctatctgatcggcaactcaatggagaattctggtcactcagtgacacacacaactcgggcctccccagcgacaattgaaatggcgattgagacgctgcaaaagtctgacggtctgtccactcacagaagctctcttctcaacagccatctccagtggctgttggacaattatgagacagcagaaggagtgagccttcccagaagcactctgtacaaccactaccttcgacactgtcaggaacacaaactggacccagtcaatgctgcctcttttggaaaattaataagatcaatttttatggggctacgaaccaggagattgggcactagaggaaactccaaataccactactatgggattcgtgtcaagccagattcccctcttaatcgtctgcaagaagacatgcagtatatggctatgagacaacaacccatgcaacagaaacaaaggtacaagcctatgcagaaagtggatggggttgcagatggtttcacaggaagtggtcaacagacaggcacatctgttgagcaaactgtaattgcccaaagccaacatcatcaacagtttttagatgcatctcgagcacttccagagtttggagaagttgaaatctcttctctgccagatggtactacctttgaggatatcaagtcactgcagagtctttatagagagcactgtgaggcaatattggacgttgttgtgaatcttcaatttagcctgatagaaaaattgtggcaaacattctggcgctattctccctctactccaactgatggcactaccattaccgaatcgagcaatctgagtgaaatagaaagtcgacttccgaaagcaaagctgataactctgtgcaaacatgagtctatcctgaaatggatgtgtaactgtgaccatgggatgtaccaggctttggtggagattctcatccccgacgtccttagacctattcctagtgccttgacccaagccattcgaaattttgcaaaaagccttgaaggttggctttccaatgccatgaacaatattccacagagaatgatacaaaccaaggttgccgctgtaagtgcctttgcccagactctgcgaagatacacgtcgcttaatcacctggcccaggcagctcgtgcagtgcttcagaacacttcccaaatcaaccagatgcttagtgacctcaaccgtgtcgactttgccaatgtccaggagcaggcttcctgggtgtgccagtgtgatgacaacatggttcagagactagaaacagacttcaagatgactcttcagcagcagagcaccctggagcagtgggctgcgtggcttgacaatgtgatgatgcaagcactgaaaccctatgaaggaagacccagttttcctaaagccgccaggcagtttctgctaaaatggtctttctacagctcaatggttattcgggacttaaccttacgcagtgctgctagctttggctccttccacctgatccgtctactctacgacgaatatatgttttacttagtagaacatcgtgttgctcaggcaacaggagagactcctatagcagtcatgggcgaggtaagagaggctgaaagagctgtgacccactgggttattaaaaataagccagaattacacttcagtctaaatacattattgattaaaaccatggttcctaaccaagtcagcctcagagccaggagggactgtggagttattgcaagagttccttaaattcctctgttcttatgtgcttaatcaaaagattctaaaattgtggattatatcatgtgaaagttcatggaatgtgtctctatattatacaggtacctatgtaaaagaaaaacttgagaaccactggaatatgaaaaatattttaagtgggaaaaagattggtgctcctgataaagcaaagggctaggaatacaatggaaaggattaaatatgtattttgtagactctttcccggtctccaagaacaaagtaaatgattctattttagaaggataaaaatggtaatgatgataactaacattttttggacacttactatgtgcgaggcacagttctatgttttttacatgtaataaagcacttaatgcaagtctttgagatacgttctactttattctgttttacaataagcatccgaggtttatgcagaaagctaaggcacagaaaggttaaatgattactcagctaaaaaatggtagagatttttttttcaaacacagtctgattttcaaacccatatgcttctaaccactaatgatgtaagggggaaaattctcttcttcagaatttctgaatagtcatcaaaatggcttatcaaaaagcttaaactctgaatataacaagggctggttaatataatgaggaatagatgcaaatgctcagatggttcagcactggcttattttgttatattgaatgcaggaggcgggggtagtttataccttgtcgaatcataccagattattaaatgtgacaaattacccaaggcggtaaaaaagacatgttcacttttaagctatgtgtatgtgcttatataaataaaaaagagtgaaaacagatattattcaa

SEQ ID NO: 77258 - DNA, 4252 bp, Homo sapiens
  misc_feature (15)..(16): n is a, c, g, or t
  misc_feature (18)..(18): n is a, c, g, or t
agcggtacttctgcnncnactacaaacagtactttaaagacaggccttccactgccattcagagagccatggaggatactctagtttctttgggaagataaacactcaatctgctagttaagagacaaagctcaagagaaataagctgaagctgtaacctccatttcaaacttgtggttctgcagaccatcatgcagacatcagagactgggtcggacacaggctcgacagtgaccttacaaacatctgtggctagtcaagcagcagtgcctacgcaggtggtacagcaagtaccagtacaacaacaggtacagcaggtacagactgtgcagcaggtacaacatgtctatcccgctcaggtgcagtatgtggaaggaagcgatactgtctataccaatggagcaatccgaacaacaacgtatccttacacagagacacagatgtacagccaaaatactggagggaattactttgatactcaagggagttccgcccaggtgactaccgtggtctcatcccacagtatggtgggcactggtgggattcagatgggcgtcacaggaggacaactcatcagcagctctggaggaacctatctgatcggcaactcaatggagaattctggtcactcagtgacacacacaactcgggcctccccagcgacactccagtggctgttggacaattatgagacagcagaaggagtgagccttcccagaagcactctgtacaaccactaccttcgacactgtcaggaacacaaactggacccagtcaatgctgcctcttttggaaaattaataagatcaatttttatggggctacgaaccaggagattgggcactagaggaaactccaaataccactactatgggattcgtgtcaagccagattcccctcttaatcgtctgcaagaagacatgcagtatatggctatgagacaacaacccatgcaacagaaacaaaggtacaagcctatgcagaaagtggatggggttgcagatggtttcacaggaagtggtcaacagacaggcacatctgttgagcaaactgtaattgcccaaagccaacatcatcaacagtttttagatgcatctcgagcacttccagagtttggagaagttgaaatctcttctctgccagatggtactacctttgaggatatcaagtcactgcagagtctttatagagagcactgtgaggcaatattggacgttgttgtgaatcttcaatttagcctgatagaaaaattgtggcaaacattctggcgctattctccctctactccaactgatggcactaccattaccgaatcgagcaatctgagtgaaatagaaagtcgacttccgaaagcaaagctgataactctgtgcaaacatgagtctatcctgaaatggatgtgtaactgtgaccatgggatgtaccaggctttggtggagattctcatccccgacgtccttagacctattcctagtgccttgacccaagccattcgaaattttgcaaaaagccttgaaggttggctttccaatgccatgaacaatattccacagagaatgatacaaaccaaggttgccgctgtaagtgcctttgcccagactctgcgaagatacacgtcgcttaatcacctggcccaggcagctcgtgcagtgcttcagaacacttcccaaatcaaccagatgcttagtgacctcaaccgtgtcgactttgccaatgtccaggagcaggcttcctgggtgtgccagtgtgatgacaacatggttcagagactagaaacagacttcaagatgactcttcagcagcagagcaccctggagcagtgggctgcgtggcttgacaatgtgatgatgcaagcactgaaaccctatgaaggaagacccagttttcctaaagccgccaggcagtttctgctaaaatggtctttctacagctcaatggttattcgggacttaaccttacgcagtgctgctagctttggctccttccacctgatccgtctactctacgacgaatatatgttttacttagtagaacatcgtgttgctcaggcaacaggagagactcctatagcagtcatgggcgagtttggtgatttaaatgccgtgtctcctggaaatctggataaagatgaaggcagtgaagtagaaagtgaaatggatgaagaactggatgactcttcagagcctcaagccaaaagagagaaaacagagctgagccaggcatttccagtgggctgcatgcagcctgttctcgagactggcgtgcaaccaagcctcctgaatccaattcacagcgagcacattgtcacaagtactcagactatcagacagtgcagcgctacaggaaatacctacactgcagtctaaagaatattaaagcgtatttttccagcttacattaaccctgttgatattgggcttaagttgaaaatttaataagcctgaaggtcgactgttgtcaaattctatctgtgctgaacattaactttttggagttgtgaaatggaatgggtgtatgtattttgccagatctttttttttaacgtaaacaaattatttgcttcttaataatgaattttttcccttagtttcaggtgtcaagaaggatttttacaacacttaatgtcaatgttttgttttcttataattaaaaagtaatttacattttttgtagcttaaaatattttattgttgattgttagtcttggtgtatgatttcatgtgtaagttttttaattagatgcacttctgtgaaatatcaaaagaaatgatttttttgatttacactggaggcatgcccatttggcagcagatgcatcaaatttgcttttgaaaggtgcttttcattggacagaaccataagacactattttgataacattttgagtacggagagagaatacagagcatttttattatagtgctagagggtttggaaggtcatctatttttctctgaggaaaaattgagctgtacatttatcagttcagagtaaatgacagaattgcaagagattatgctaatatgtacataatttgtgtacataattattaaaccatgttaacaatgcaagcttccgttaaacattgaattttaactattatttgcataccaattcctctgtttaaagactactgattctgtatttgggaccactgcacagatgcattctgctgttaagtgggggctgttatagttagatactgaagcagaaaaaaaagacttgactttttttttttaagtgtacatgctacttatgctgagctggacatacaggaaaccattccatttggatgactttcttttattccaggtctttttcctaatagtagttcaatatgctgctattataaacgagaatttatagaatgcaaggaatgtagcaacctacataacgttatttccttcaaaactatttcctggtttctaaagtatgtggatttaaattgtaaacagaacctgaaggcagtgtaactggcacacctcactgttacttatccccaattctgtaggatttggataggtggctggatggaccattgccattgaagaatgtacatcagggatcatcgtacctcggctattacatggtgccttaaaacagaactgaagctaaggtttagtaaggtttattttgttcatgtgactaactcttcaatccatttgacaaagtgtgcctgtcattttcagattcctgaagtaaggacaggtgacatgttcttcaaaggaaatttagggaaaacaaaggaaaacaaaaagacaaaaatcagtttccctctttgagtgaccgtggatctattttttattcttagagctgaatattacttgattacaaatcagattgcttaagggtgtggaatagcaggctagttttaataccaacttgttaacataaaatcatatatgttttagaccattcttatttagttacaattttagaaagttaacaaagtaagcaggtacttatcgaagtgcatcttttcagtctaaatgtttgtctgtgtgtctaggtgctggtgagtccacatggacacatgagtgcccatggggcaggagtctgctataaagtcagaaggtgagatcctagagagttacacccagccccattttaatttgcatgaaaagccaaggttcttttaagcactcaaattatttaatggttaaaacacaagaaaggcacatctgttcatttaaatagttgtaaaaaactaatcagcaaaaataaatagataataaagccaaaaaaaaggaaa

SEQ ID NO: 77259 - DNA, 2832 bp, Homo sapiens
cgggccggactctgggctgtagctcatccccgacgtccttatgacctattctagtgccttgacccaagccattcgaaattttgcaaaaagccttgaaggttggctttccaatgccatgaacaatattccacagagaatgatacaaaccaaggttgccgctgtaagtgcctttgcccagactctgcgaagatacacgtcgcttaatcacctggcccaggcagctcgtgcagtgcttcagaacacttcccaaatcaaccagatgcttagtgacctcaaccgtgtcgactttgccaatgtccaggagcaggcttcctgggtgtgccagtgtgatgacaacatggttcagagactagaaacagacttcaagatgactcttcagcagcagagcaccctggagcagtgggctgcgtggcttgacaatgtgatgatgcaagcactgaaaccctatgaaggaagacccagttttcctaaagccgccaggcagtttctgctaaaatggtctttctacagctcaatggttattcgggacttaaccttacgcagtgctgctagctttggctccttccacctgatccgtctactctacgacgaatatatgttttacttagtagaacatcgtgttgctcaggcaacaggagagactcctatagcagtcatgggcgagtttggtgatttaaatgccgtgtctcctggaaatctggataaagatgaaggcagtgaagtagaaagtgaaatggatgaagaactggatgactcttcagagcctcaagccaaaagagagaaaacagagctgagccaggcatttccagtgggctgcatgcagcctgttctcgagactggcgtgcaaccaagcctcctgaatccaattcacagcgagcacattgtcacaagtactcagactatcagacagtgcagcgctacaggaaatacctacactgcagtctaaagaatattaaagcgtatttttccagcttacattaaccctgttgatattgggcttaagttgaaaatttaataagcctgaaggtcgactgttgtcaaattctatctgtgctgaacattaactttttggagttgtgaaatggaatgggtgtatgtattttgccagatctttttttttaacgtaaacaaattatttgcttcttaataatgaattttttcccttagtttcaggtgtcaagaaggatttttacaacacttaatgtcaatgttttgttttcttataattaaaaagtaatttacattttttgtagcttaaaatattttattgttgattgttagtcttggtgtatgatttcatgtgtaagttttttaattagatgcacttctgtgaaatatcaaaagaaatgatttttttgatttacactggaggcatgcccatttggcagcagatgcatcaaatttgcttttgaaaggtgcttttcattggacagaaccataagacactattttgataacattttgagtacggagagagaatacagagcatttttattatagtgctagagggtttggaaggtcatctatttttctctgaggaaaaattgagctgtacatttatcagttcagagtaaatgacagaattgcaagagattatgctaatatgtacataatttgtgtacataattattaaaccatgttaacaatgcaagcttccgttaaacattgaattttaactattatttgcataccaattcctctgtttaaagactactgattctgtatttgggaccactgcacagatgcattctgctgttaagtgggggctgttatagttagatactgaagcagaaaaaaaagacttgactttttttttttaagtgtacatgctacttatgctgagctggacatacaggaaaccattccatttggatgactttcttttattccaggtctttttcctaatagtagttcaatatgctgctattataaacgagaatttatagaatgcaaggaatgtagcaacctacataacgttatttccttcaaaactatttcctggtttctaaagtatgtggatttaaattgtaaacagaacctgaaggcagtgtaactggcacacctcactgttacttatccccaattctgtaggatttggataggtggctggatggaccattgccattgaagaatgtacatcagggatcatcgtacctcggctattacatggtgccttaaaacagaactgaagctaaggtttagtaaggtttattttgttcatgtgactaactcttcaatccatttgacaaagtgtgcctgtcattttcagattcctgaagtaaggacaggtgacatgttcttcaaaggaaatttagggaaaacaaaggaaaacaaaaagacaaaaatcagtttccctctttgagtgaccgtggatctattttttattcttagagctgaatattacttgattacaaatcagattgcttaagggtgtggaatagcaggctagttttaataccaacttgttaacataaaatcatatatgttttagaccattcttatttagttacaattttagaaagttaacaaagtaagcaggtacttatcgaagtgcatcttttcagtctaaatgtttgtctgtgtgtctaggtgctggtgagtccacatggacacatgagtgcccatggggcaggagtctgctataaagtcagaaggtgagatcctagagagttacacccagccccattttaatttgcatgaaaagccaaggttcttttaagcactcaaattatttaatggttaaaacacaagaaaggcacatctgttcatttaaatagttgtaaaaaactaatcagcaaaaataaatagataataaagccaaaaaaaaggaaa

SEQ ID NO: 77260 - DNA, 4199 bp, Homo sapiens
  misc_feature (15)..(16): n is a, c, g, or t
  misc_feature (18)..(18): n is a, c, g, or t
agcggtacttctgcnncnactacaaacagtactttaaagacaggccttccactgccattcagagagccatggaggatactctagtttctttgggaagataaacactcaatctgctagttaagagacaaagctcaagagaaataagctgaagctgtaacctccatttcaaacttgtggttctgcagaccatcatgcagacatcagagactgggtcggacacaggctcgacagtgaccttacaaacatctgtggctagtcaagcagcagtgcctacgcaggtggtacagcaagtaccagtacaacaacaggtacagcaggtacagactgtgcagcaggtacaacatgtctatcccgctcaggtgcagtatgtggaaggaagcgatactgtctataccaatggagcaatccgaacaacaacgtatccttacacagagacacagatgtacagccaaaatactggagggaattactttgatactcaagggagttccgcccaggtgactaccgtggtctcatcccacagtatggtgggcactggtgggattcagatgggcgtcacaggaggacaactcatcagcagctctggaggaacctatctgatcggcaactcaatggagaattctggtcactcagtgacacacacaactcgggcctccccagcgacactccagtggctgttggacaattatgagacagcagaaggagtgagccttcccagaagcactctgtacaaccactaccttcgacactgtcaggaacacaaactggacccagtcaatgctgcctcttttggaaaattaataagatcaatttttatggggctacgaaccaggagattgggcactagaggaaactccaaataccactactatgggattcgtgtcaagccagattcccctcttaatcgtctgcaagaagacatgcagtatatggctatgagacaacaacccatgcaacagaaacaaaggtacaagcctatgcagaaagtggatggggttgcagatggtttcacaggaagtggtcaacagacaggcacatctgttgagcaaactgtaattgcccaaagccaacatcatcaacagtttttagatgcatctcgagcacttccagagtttggagaagttgaaatctcttctctgccagatggtactacctttgaggatatcaagtcactgcagagtctttatagagagcactgtgaggcaatattggacgttgttgtgaatcttcaatttagcctgatagaaaaattgtggcaaacattctggcgctattctccctctactccaactgatggcactaccattaccgaatcgagcaatctgagtgaaatagaaagtcgacttccgaaagcaaagctgataactctgtgcaaacatgagtctatcctgaaatggatgtgtaactgtgaccatgggatgtaccaggctttggtggagattctcatccccgacgtccttagacctattcctagtgccttgacccaagccattcgaaattttgcaaaaagccttgaaggttggctttccaatgccatgaacaatattccacagagaatgatacaaaccaaggttgccgctgtaagtgcctttgcccagactctgcgaagatacacgtcgcttaatcacctggcccaggcagctcgtgcagtgcttcagaacacttcccaaatcaaccagatgcttagtgacctcaaccgtgtcgactttgccaatgtccaggagcaggcttcctgggtgtgccagtgtgatgacaacatggttcagagactagaaacagacttcaagatgactcttcagcagcagagcaccctggagcagtgggctgcgtggcttgacaatgtgatgatgcaagcactgaaaccctatgaaggaagacccagttttcctaaagccgccaggcagtttctgctaaaatggtctttctacagctcaatggttattcgggacttaaccttacgcagtgctgctagctttggctccttccacctgatccgtctactctacgacgaatatatgttttacttagtagaacatcgtgttgctcaggcaacaggagagactcctatagcagtcatgggcgagtttggtgatttaaatgccgtgtctcctggaaatctggataaagatgaaggcagtgaagtagaaagtgaaatggatgaagaactggatgactcttcagagcctcaagccaaaagagagaaaacagagctgagccaggcatttccagtgggctgcatgcagcctgttctcgagactggcgtgcaaccaagcctcctgaatccaattcacagcgagcacattgtcacaagtactcagactatcagacagtgcagcgctacaggaaatacctacactgcagtctaaagaatattaaagcgtatttttccagcttacattaaccctgttgatattgggcttaagttgaaaatttaataagcctgaaggtcgactgttgtcaaattctatctgtgctgaacattaactttttggagttgtgaaatggaatgggtgtatgtattttgccagatctttttttttaacgtaaacaaattatttgcttcttaataatgaattttttcccttagtttcaggtgtcaagaaggatttttacaacacttaatgtcaatgttttgttttcttataattaaaaagtaatttacattttttgtagcttaaaatattttattgttgattgttagtcttggtgtatgatttcatgtgtaagttttttaattagatgcacttctgtgaaatatcaaaagaaatgatttttttgatttacactggaggcatgcccatttggcagcagatgcatcaaatttgcttttgaaaggtgcttttcattggacagaaccataagacactattttgataacattttgagtacggagagagaatacagagcatttttattatagtgctagagggtttggaaggtcatctatttttctctgaggaaaaattgagctgtacatttatcagttcagagtaaatgacagaattgcaagagattatgctaatatgtacataatttgtgtacataattattaaaccatgttaacaatgcaagcttccgttaaacattgaattttaactattatttgcataccaattcctctgtttaaagactactgattctgtatttgggaccactgcacagatgcattctgctgttaagtgggggctgttatagttagatactgaagcagaaaaaaaagacttgactttttttttttaagtgtacatgctacttatgctgagctggacatacaggaaaccattccatttggatgactttcttttattccaggtctttttcctaatagtagttcaatatgctgctattataaacgagaatttatagaatgcaaggaatgtagcaacctacataacgttatttccttcaaaagcagtgtaactggcacacctcactgttacttatccccaattctgtaggatttggataggtggctggatggaccattgccattgaagaatgtacatcagggatcatcgtacctcggctattacatggtgccttaaaacagaactgaagctaaggtttagtaaggtttattttgttcatgtgactaactcttcaatccatttgacaaagtgtgcctgtcattttcagattcctgaagtaaggacaggtgacatgttcttcaaaggaaatttagggaaaacaaaggaaaacaaaaagacaaaaatcagtttccctctttgagtgaccgtggatctattttttattcttagagctgaatattacttgattacaaatcagattgcttaagggtgtggaatagcaggctagttttaataccaacttgttaacataaaatcatatatgttttagaccattcttatttagttacaattttagaaagttaacaaagtaagcaggtacttatcgaagtgcatcttttcagtctaaatgtttgtctgtgtgtctaggtgctggtgagtccacatggacacatgagtgcccatggggcaggagtctgctataaagtcagaaggtgagatcctagagagttacacccagccccattttaatttgcatgaaaagccaaggttcttttaagcactcaaattatttaatggttaaaacacaagaaaggcacatctgttcatttaaatagttgtaaaaaactaatcagcaaaaataaatagataataaagccaaaaaaaaggaaa

SEQ ID NO: 77261 - DNA, 2841 bp, Homo sapiens
  misc_feature (15)..(16): n is a, c, g, or t
  misc_feature (18)..(18): n is a, c, g, or t
agcggtacttctgcnncnactacaaacagtactttaaagacaggccttccactgccattcagagagccatggaggatactctagtttctttgggaagataaacactcaatctgctagttaagagacaaagctcaagagaaataagctgaagctgtaacctccatttcaaacttgtggttctgcagaccatcatgcagacatcagagactgggtcggacacaggctcgacagtgaccttacaaacatctgtggctagtcaagcagcagtgcctacgcaggtggtacagcaagtaccagtacaacaacaggtacagcaggtacagactgtgcagcaggtacaacatgtctatcccgctcaggtgcagtatgtggaaggaagcgatactgtctataccaatggagcaatccgaacaacaacgtatccttacacagagacacagatgtacagccaaaatactggagggaattactttgatactcaagggagttccgcccaggtgactaccgtggtctcatcccacagtatggtgggcactggtgggattcagatgggcgtcacaggaggacaactcatcagcagctctggaggaacctatctgatcggcaactcaatggagaattctggtcactcagtgacacacacaactcgggcctccccagcgacactccagtggctgttggacaattatgagacagcagaaggagtgagccttcccagaagcactctgtacaaccactaccttcgacactgtcaggaacacaaactggacccagtcaatgctgcctcttttggaaaattaataagatcaatttttatggggctacgaaccaggagattgggcactagaggaaactccaaataccactactatgggattcgtgtcaagccagattcccctcttaatcgtctgcaagaagacatgcagtatatggctatgagacaacaacccatgcaacagaaacaaaggtacaagcctatgcagaaagtggatggggttgcagatggtttcacaggaagtggtcaacagacaggcacatctgttgagcaaactgtaattgcccaaagccaacatcatcaacagtttttagatgcatctcgagcacttccagagtttggagaagttgaaatctcttctctgccagatggtactacctttgaggatatcaagtcactgcagagtctttatagagagcactgtgaggcaatattggacgttgttgtgaatcttcaatttagcctgatagaaaaattgtggcaaacattctggcgctattctccctctactccaactgatggcactaccattaccgaatcgagcaatctgagtgaaatagaaagtcgacttccgaaagcaaagctgataactctgtgcaaacatgagtctatcctgaaatggatgtgtaactgtgaccatgggatgtaccaggctttggtggagattctcatccccgacgtccttagacctattcctagtgccttgacccaagccattcgaaattttgcaaaaagccttgaaggttggctttccaatgccatgaacaatattccacagagaatgatacaaaccaaggttgccgctgtaagtgcctttgcccagactctgcgaagatacacgtcgcttaatcacctggcccaggcagctcgtgcagtgcttcagaacacttcccaaatcaaccagatgcttagtgacctcaaccgtgtcgactttgccaatgtccaggagcaggcttcctgggtgtgccagtgtgatgacaacatggttcagagactagaaacagacttcaagatgactcttcagcagcagagcaccctggagcagtgggctgcgtggcttgacaatgtgatgatgcaagcactgaaaccctatgaaggaagacccagttttcctaaagccgccaggcagtttctgctaaaatggtctttctacagctcaatggttattcgggacttaaccttacgcagtgctgctagctttggctccttccacctgatccgtctactctacgacgaatatatgttttacttagtagaacatcgtgttgctcaggcaacaggagagactcctatagcagtcatgggcgaggtacctatgtaaaagaaaaacttgagaaccactggaatatgaaaaatattttaagtgggaaaaagattggtgctcctgataaagcaaagggctaggaatacaatggaaaggattaaatatgtattttgtagactctttcccggtctccaagaacaaagtaaatgattctattttagaaggataaaaatggtaatgatgataactaacattttttggacacttactatgtgcgaggcacagttctatgttttttacatgtaataaagcacttaatgcaagtctttgagatacgttctactttattctgttttacaataagcatccgaggtttatgcagaaagctaaggcacagaaaggttaaatgattactcagctaaaaaatggtagagatttttttttcaaacacagtctgattttcaaacccatatgcttctaaccactaatgatgtaagggggaaaattctcttcttcagaatttctgaatagtcatcaaaatggcttatcaaaaagcttaaactctgaatataacaagggctggttaatataatgaggaatagatgcaaatgctcagatggttcagcactggcttattttgttatattgaatgcaggaggcgggggtagtttataccttgtcgaatcataccagattattaaatgtgacaaattacccaaggcggtaaaaaagacatgttcacttttaagctatgtgtatgtgcttatataaataaaaaagagtgaaaacagatattattcaa

SEQ ID NO: 77262 - DNA, 898 bp, Homo sapiens
  misc_feature (171)..(171): n is a, c, g, or t
ctccccgtgcgagtgtctccctctccctctcgctctctctctctctccctctctctctctctttgtgagttatagcaaccgtgccttgtgaatcaagcgccatagtcaccgtagtcctggcgactgttacccatcaacaacaactactcctctcctcctcctcctcctctncctcctcctcctccccaccacaccatctccatcacccaccaacaacaccacaataatccacagccaagagaccatcatgcagacatcagagactgggtcggacacaggctcgacagtgaccttacaaacatctgtggctagtcaagcagcagtgcctacgcaggtggtacagcaagtaccagtacaacaacaggtacagcaggtacagactgtgcagcaggtacaacatgtctatcccgctcaggtgcagtatgtggaaggaagcgatactgtctataccaatggagcaatccgaacaacaacgtatccttacacagagacacagatgtacagccaaaatactggagggaattactttgatactcaagggagttccgcccaggtgactaccgtggtctcatcccacagtatggtgggcactggtgggattcagatgggcgtcacaggaggacaactcatcagcagctctggaggaacctatctgatcggcaactcaatggagaattctggtcactcagtgacacacacaactcgggcctccccagcgacactttttctgttttcctgtgtccctttttccctaggccaactcagtccctgaaatgaaactcctcagacagattaccatgaaccgtctgtttcctacactaaatcataaattgactgaaggttctgggcctcattttcaaagcatttaataaaatgggactttgaatgacaaaaaatc

SEQ ID NO: 77263 - DNA, 2880 bp, Homo sapiens
acctactcagaaggaaaataatacttggtttagagatttaaatgctgtaatttacaagtaaactctctcaccaaatgaattttaaataagtgtcagaggcaagcatttaaaatttgtgaagggaaagaagatttgaaaattgcagtggtttcttttactggaggaaacagaatcccaacttaattggattgcgttacaggttgccgctgtaagtgcctttgcccagactctgcgaagatacacgtcgcttaatcacctggcccaggcagctcgtgcagtgcttcagaacacttcccaaatcaaccagatgcttagtgacctcaaccgtgtcgactttgccaatgtccaggagcaggcttcctgggtgtgccagtgtgatgacaacatggttcagagactagaaacagacttcaagatgactcttcagcagcagagcaccctggagcagtgggctgcgtggcttgacaatgtgatgatgcaagcactgaaaccctatgaaggaagacccagttttcctaaagccgccaggcagtttctgctaaaatggtctttctacagctcaatggttattcgggacttaaccttacgcagtgctgctagctttggctccttccacctgatccgtctactctacgacgaatatatgttttacttagtagaacatcgtgttgctcaggcaacaggagagactcctatagcagtcatgggcgagtttggtgatttaaatgccgtgtctcctggaaatctggataaagatgaaggcagtgaagtagaaagtgaaatggatgaagaactggatgactcttcagagcctcaagccaaaagagagaaaacagagctgagccaggcatttccagtgggctgcatgcagcctgttctcgagactggcgtgcaaccaagcctcctgaatccaattcacagcgagcacattgtcacaagtactcagactatcagacagtgcagcgctacaggaaatacctacactgcagtctaaagaatattaaagcgtatttttccagcttacattaaccctgttgatattgggcttaagttgaaaatttaataagcctgaaggtcgactgttgtcaaattctatctgtgctgaacattaactttttggagttgtgaaatggaatgggtgtatgtattttgccagatctttttttttaacgtaaacaaattatttgcttcttaataatgaattttttcccttagtttcaggtgtcaagaaggatttttacaacacttaatgtcaatgttttgttttcttataattaaaaagtaatttacattttttgtagcttaaaatattttattgttgattgttagtcttggtgtatgatttcatgtgtaagttttttaattagatgcacttctgtgaaatatcaaaagaaatgatttttttgatttacactggaggcatgcccatttggcagcagatgcatcaaatttgcttttgaaaggtgcttttcattggacagaaccataagacactattttgataacattttgagtacggagagagaatacagagcatttttattatagtgctagagggtttggaaggtcatctatttttctctgaggaaaaattgagctgtacatttatcagttcagagtaaatgacagaattgcaagagattatgctaatatgtacataatttgtgtacataattattaaaccatgttaacaatgcaagcttccgttaaacattgaattttaactattatttgcataccaattcctctgtttaaagactactgattctgtatttgggaccactgcacagatgcattctgctgttaagtgggggctgttatagttagatactgaagcagaaaaaaaagacttgactttttttttttaagtgtacatgctacttatgctgagctggacatacaggaaaccattccatttggatgactttcttttattccaggtctttttcctaatagtagttcaatatgctgctattataaacgagaatttatagaatgcaaggaatgtagcaacctacataacgttatttccttcaaaactatttcctggtttctaaagtatgtggatttaaattgtaaacagaacctgaaggcagtgtaactggcacacctcactgttacttatccccaattctgtaggatttggataggtggctggatggaccattgccattgaagaatgtacatcagggatcatcgtacctcggctattacatggtgccttaaaacagaactgaagctaaggtttagtaaggtttattttgttcatgtgactaactcttcaatccatttgacaaagtgtgcctgtcattttcagattcctgaagtaaggacaggtgacatgttcttcaaaggaaatttagggaaaacaaaggaaaacaaaaagacaaaaatcagtttccctctttgagtgaccgtggatctattttttattcttagagctgaatattacttgattacaaatcagattgcttaagggtgtggaatagcaggctagttttaataccaacttgttaacataaaatcatatatgttttagaccattcttatttagttacaattttagaaagttaacaaagtaagcaggtacttatcgaagtgcatcttttcagtctaaatgtttgtctgtgtgtctaggtgctggtgagtccacatggacacatgagtgcccatggggcaggagtctgctataaagtcagaaggtgagatcctagagagttacacccagccccattttaatttgcatgaaaagccaaggttcttttaagcactcaaattatttaatggttaaaacacaagaaaggcacatctgttcatttaaatagttgtaaaaaactaatcagcaaaaataaatagataataaagccaaaaaaaaggaaa

SEQ ID NO: 77264 - DNA, 864 bp, Homo sapiens
  misc_feature (171)..(171): n is a, c, g, or t
ctccccgtgcgagtgtctccctctccctctcgctctctctctctctccctctctctctctctttgtgagttatagcaaccgtgccttgtgaatcaagcgccatagtcaccgtagtcctggcgactgttacccatcaacaacaactactcctctcctcctcctcctcctctncctcctcctcctccccaccacaccatctccatcacccaccaacaacaccacaataatccacagccaagagaccatcatgcagacatcagagactgggtcggacacaggctcgacagtgaccttacaaacatctgtggctagtcaagcagcagtgcctacgcaggtggtacagcaagtaccagtacaacaacaggtacagcaggtacagactgtgcagcaggtacaacatgtctatcccgctcaggtgcagtatgtggaaggaagcgatactgtctataccaatggagcaatccgaacaacaacgtatccttacacagagacacagatgtacagccaaaatactggagggaattactttgatactcaagggagttccgcccaggtgactaccgtggtctcatcccacagtatggtgggcactggtgggattcagatgggcgtcacaggaggacaactcatcagcagctctggaggaacctatctgatcggcaactcaatggagaattctggtcactcagtgacacacacaactcgggcctccccagcgacagccaactcagtccctgaaatgaaactcctcagacagattaccatgaaccgtctgtttcctacactaaatcataaattgactgaaggttctgggcctcattttcaaagcatttaataaaatgggactttgaatgacaaaaaatc

SEQ ID NO: 77265 - DNA, 678 bp, Homo sapiens
  misc_feature (171)..(171): n is a, c, g, or t
ctccccgtgcgagtgtctccctctccctctcgctctctctctctctccctctctctctctctttgtgagttatagcaaccgtgccttgtgaatcaagcgccatagtcaccgtagtcctggcgactgttacccatcaacaacaactactcctctcctcctcctcctcctctncctcctcctcctccccaccacaccatctccatcacccaccaacaacaccacaataatccacagccaaggccacttggtcattctggcattttatggtagagaatacgttgagtttggctctggaaggaatatgagagaccatcatgcagacatcagagactgggtcggacacaggctcgacagtgaccttacaaacatctgtggctagtcaagcagcagtgcctacgcaggtggtacagcaagtaccagtacaacaacaggtacagcaggtacagactgtgcagcaggtacaacatgtctatcccgctcaggtgcagtatgtggaaggaagcgatactgtctataccaatggagcaatgtccagggccccctggagcatgattttggaatcttcaccataaacttaaactactgttggcatttataccaaatgaaaaagacgcctgccacttcgacctttatgctctcagggaaaataaatggctttgtagacactgctagaggtca

SEQ ID NO: 77266 - DNA, 244 bp, Homo sapiens
aatgacactgtttcactgtttctctaaaatcacgttcttttgtgatagactgtcagtggttcccccatatctgtccctgccttgctaaatttagcagaatccctgaggacatggcctctgagaatagcagctgcatttcccagactcccttgcagctagcaaggttgtgtgactaagccctggccagtaggcatggaagtgaagactgtaatgtccaagtaatccttggaaagaaaagaacgtg

SEQ ID NO: 77267 - DNA, 366 bp, Homo sapiens
  misc_feature (18)..(18): n is a, c, g, or t
  misc_feature (29)..(29): n is a, c, g, or t
  misc_feature (69)..(69): n is a, c, g, or t
  misc_feature (92)..(92): n is a, c, g, or t
  misc_feature (101)..(101): n is a, c, g, or t
cggccatcccagtcctgnccctgcagaanaccctccctccccaatgtggccccaccgtcatgcccccantcagcatttcccagaactgagcntattgtctntccccctgtttaacagtgtaggttttaatatttttcaggtccgttgaggccaacagatcaggagatgatggccattgagacattttatattggggtaaagaaatttcatatattaactgtgcttcactgtttttccctcttctgatgtaattcttgttactgcttttcgccacaagggggcttaagaacctcatttattatttaaattaatgagagcttaaaagttgtggaggctcttgacagataatgattccgtgtgaaatat

SEQ ID NO: 77268 - DNA, 258 bp, Homo sapiens
tccagcctgggcaacatagcgaaatcctgtaattaaaaaaaaaaaaaaaaaaaagatatagttttgtcattgtttgtttcctctctatacttactattgtacttaatcagctatttaacaaaaacctattgattagccacattgtgctcagttctaggaaagccttaaaaaacaagaaagatgtcactgccacagtcacacgctagtttatacactagtggggaaaatggacaaatacataagccgttaaccttttag

SEQ ID NO: 77269 - DNA, 565 bp, Homo sapiens
ggagattggttccaggaccccctccccccacccctgaggatacaaaattcacagatgctcaagtccctgctatacagtggtataatatttgcatagaacctgcacacatctttccttaccctttaaatcatctccaggttacagatacctagcacaacataaatgctgcataaatagctgttataccgtgtgtgtctgtgttttaaacattgtttatttgagacagggtctcactctgtcaccaggctacagtgcagaggcacagtcacagctcattgcagcctcaacctcctgggctcaagcagtcctccacctcagcctcccaaagtgctaggatgacaggtgtgagccactgtgccccaccaaaaaaaatgttttttcaaatattttctatctgtggttggattcagaccacatgaacactgagggctgactgtagttttgaatgtctgttactgaggaggcaccagcataaagtattttatcacttcagacgctgacaatctagtatttttaatttttaaatcttttgaaagctaatacatataggtgatttgtaaaaaaa

SEQ ID NO: 77270 - DNA, 473 bp, Homo sapiens
gggaccttgtctcaaacaaaggcacaaacatgtatacaatgaagagtcatttcctcttccatgctgttcccagctaccctattatcctcagaggcaagcatgcctaccagttcttggaaactgctgaagtttgaaaaggataaatggagacctaacaggaaggccccagaaccaaggtgctagtgaggggtgacccaagggagcagtattgcacatgcaacccttttacattgtggccaacagctcagaatggggatgcggtgtgatgtggctgccaggaagtgaaaggcatctcaggctacataaatggatatccaggaggaaggaggaggtaagctgctctgcctacgtgtcacggtcagccagcacctggagaattgtgtttagttgcgaacatggagctgtcatggaaatgtggacaaactggagcctgttcagaggacagccctaagatgggtgagacccagcatatc

SEQ ID NO: 77271 - DNA, 344 bp, Homo sapiens
cataaacaacaaagcataaaaaaatcttaacctagtggactaaaagatttcttgcttttttcatttctgctaatggcctctctcccttggcactgccagaactggtccattaaaggtgaatcgagcctcagtttgcaggcaggacgtggtccaaaagatcatttgtaagttggttgtttggaccaaagaatgtgtttccccctagaaaccatttttctcagggtgactgggttctcagttttgcttgtacagtgccgttcaacttccactgaagctgagctctgggtctttgagggcaggttctctgcagtgcaggagggagaaaacaggtcacctgctgctgc

SEQ ID NO: 77272 - DNA, 1006 bp, Homo sapiens
cttgcgggccggtggccccgggcaggccacttctgacgcgggtgcgaggccttccgcgggcgtgcacggttgggccggagccgcgccgggggccgggacacgcctggggtcagcgctggcgtcgccgctcgggtggggtgggccgggttcgggtccagtctcctccccacgggcggcccgcgccccgtcttccagtgacccccacatcccttgcgccccgagctggaacttcggcaggttctgccccgggccgcgcgcgctttctggggaccagggctgtggttcctgctccgcgtcgtgcctttagacaccgccgggcgttcgtcctccatccctccccccttttccccactccgcggttgacgagggccgcccccaagtggccatgtcccccggcatggacgacccctcagtgcccctgagggcccagggtctcgcccccgtcccgaggcaggccatgtttgaatttatttggagaaattcgcccagcccaggggacctctttctgcagctctggccttccagtaggagagggtccctggggctctcaggcctgacaacttggcatcactgaattctctaaccatgtctgtccatgacttgaactccttttcttttagaaagatctttgcaaaccccttgtgggcgtgcccctcccatggcccccgtgcctcttgcctgggctttgggcttgtctgaaagggctaaaagggggtgatgcctggccgggcgggtggctcacgcctgcagtcccagcactttgggaggccgaggtgggcggatcacctgaagtcaggagttcaagaccatcctggccaacatagtgaaacccatctctactaaaaatacaaaaattagcaaggcttggtggcaggcacctgtagtcccagctacttgggaggctgaggcaggagcaggagaattgcttgaacctgggaggcagaggttgcagtgagctgagatcgtgccactgcacttcagcctgggtgacagagagagactgtct

SEQ ID NO: 77273 - DNA, 405 bp, Homo sapiens
acctatgaacacagggcactagagccactttagactaattttctgatctttaattattttaacactccagaggaggactggttttctcctgtgtttttttaatgtatggcaagtggaacctctaatcgaccaccctgtttttcatcctaactcaggcttgcagtaaaattatcagttcccactttctttgctgcattctcaaatgcaacacatgagaccagctttcccttgccaatttacaatgctgttaactatatgtcctttattatacatttcattaaagttttctattatttggtttctttctacttctccctacagttctggcaatatttgctttttatatttagaagcctcccttttgggtgcataaatatataaagctatattctcttgagaaattaa

SEQ ID NO: 77274 - DNA, 397 bp, Homo sapiens
gtttcctttctccatgaaatcctgcctgtgctaccaaatcaggaaggtggaacaaagctctacctcttaccaaatcctcccagactccttaataatatccaaccaaaaccataggaaattaacccaaatgatctgtatctgcctgtgtttctgttaaatttgaacggtgtaattcatacatttcatgcctccaaagtcatacgagctgccagttagctagtacaaaaatcacagttgtccgaggaaaagattttaatacgaaagatacatagatgttaagctgttggtactgaccaagagtgattacaagtgcattcagagcagaaccagtggggcagtagcagtctcagactcaggacaacatattaacagtgtgcatatccatccagtagatcca

SEQ ID NO: 77275 - DNA, 139 bp, Homo sapiens
gcagtgactaaacgaacggcaggacaccttgctgctctgttaccaggaagagcaccttagcacgctctcatcttcccctgcagtcaggactaggagacaggctggagaaggggcacaagagttgggaccagaaggcctg

SEQ ID NO: 77276 - DNA, 349 bp, Homo sapiens
gctaaatactagtaactctaaacttagtgaattttctaggcagcagctttcctctgctgtctagactggtaaagaacaaactaaagccaagcgcagtggctcatgcctgtattcccagcactttgggaggccaaggcgggcaaatcacctgaggtcaggagctcaagaccagcctgaccaacatggtgaaaccctgtctacactaaaaatacaaaaattagctgggcgtggtggtgcacacctgtaatcccagctacttaggaagctgaagcaagagaattgcttgaacccaggaggcagaggtcacagtgagccaagactgtgccactgtgctccagcctgggcgacg

SEQ ID NO: 77277 - DNA, 372 bp, Homo sapiens
gtttatattcctggaacattgccaatatctattttaggtggccactggagggcagtatctctctgtgatttttctctgtcccttagatgggaactggcctttgtttttaggtcctttagtaatctaaagtttgcttcatctgttttcaaaaatgcttccaagaataaataaataaagacagagtgcctagaaaatggataattattgtgtatattgcatgattttactcccagctaccagtatgaaagctgtgtttactaacaagaaaatttacctttgttaagttttccataatgatagttataaaatccatgtaaaatatgtcttggtgcagtacgtataaataaatatactttccacagagtggtataa

SEQ ID NO: 77278 - DNA, 706 bp, Homo sapiens
actgactgccaccatgtgctattccaggaagtcagccttgaggactggctgtgcttactgagcacacaccagcccactgccacatggcagccaaatgcacaccaagcacaaacaccaagctgcaatgttgatgccttgggagcaaagaatgccctgatgtgctcagctgagcactactctgtcctggagcagtgacagtcctgattgcccagtaattgcttggtggtactgaatttatacattgtattattcagagattattgattccttcaggacaaggcaccttcagtttgaatcactgccaccagatcaagtggtccctcattacgtatatagaagactctgacagactctctctggcatggaatagccaaaaggaaagaatatgaaaatcaagttagtattgctttatccagtaaaaaaaatctggactgcattgtcaggatacagtttttctataccctattctcttgacacccttcaaaacaggagataggaaaaaagagaaaaatcaatcttcacgaaaataaagaaatggtggcattacaaaccacctagtagaaaatgcactggaatttggaagaacaatgaaagcagactcacacctcctcagactttggcccagatttgggtttctctaaaggcaaatgttgcatcctgagaggccctgcagtaataagacagccacatgttgtaagggaagtgt

SEQ ID NO: 77279 - DNA, 805 bp, Homo sapiens
acacccagatagagacatatacaatatcaatttattgataaactcaacatagaaaaaaatgtgaaattaccccaaattgatacacagggttaatatatttactatcaaggcacttcgtagatactgacaagattatccaaacaattatgtagaaaagcaaaaaacaaaacaaaccaacagaaatcccaaaaaacctggaatagctcaaacatctgaaaaaaaagatagagcagcatgctcccgggaggtgaaggttgcagtgagctgagatcacgccattgcactccagcttaggcaacaagagtgaaactccatctcaaaaaaataaataataaaataaataaataaaataaagataaagggttggaatcacttcacgttacttcaagtcctctaatatagtgaaagcattttttcctttttcatatttacaataaaacgtttatacctgccattgtcttgtgcatactcttgtcaaaaaatattgtctccaaacaacagtctcatttttgtgtcccctaaaattttcactagagtgacattcggaaaaaatgtattaagcatagcatctggccgggcatggtggctcatgcctgtaatcccaacactttgggaggccgaagcgggtggatcacctgaagtcaggagttcaagaccatgcctggccaacatggtgaaaccccatctctattacaaatacaaaaattagccaggtgtggtgatggtgcatgtctgtaatcccagctattcgggaggccgaggcaggagaatcacttgagcctgggaggcggaggctgcaatgagc

SEQ ID NO: 77280 - DNA, 917 bp, Homo sapiens
cggggtaggagcgagcgcgcccgggaactcggtggagcgagcgcgcccgggaactcggtggaggccgcggtggcggggtggggcggggctgagggcagggcggggcctgtgggagtcgtggcgcaaagagctcggggtaggagcgcgcgcccggaaactcagcggtggccgcggcgaaggggcggggctgagggtgggacggggcttgtgggaggcgtggcgcgaagatttcagagttggagcgcgcgcgaccccggactccacggaggccgcggcgagcaggcggagctgcgggtcgggacgctctgcgtggggcggggcgcaagggaggtttcgagcccggaaggtccggcgcccagagctaacgggagtcccaggttaaacactttaagatgagaaaaattgatctctgtctgagctctgaagggtccgaagtgattttagctacatcaagtgatgaaaaacacccacctgaaaatatcattgatgggaatccagaaacgttttggaccaccacaggaatgtttccccaggaattcattatttgtttccacaaacatgtaaggattgaaaggcttgtaatccaaagttactttgtacagaccttgaagattgaaaaaagcacgtctaaagagccagttgattttgagcaatggattgaaaaagatttggtacacacagaggggcagcttcaaaatgaagaaattgtggcacatgatggctccgctacttacttgagattcattattgtatcagcctttgatcattttgcatctgtgcatagcgtttctgcagaaggaacagtagtctcaaatctttcctcataatgataacaaaatgctcttgcatgattttttaacaatatatttaaacaggaagttgtcactgatatactttattaaaaggatttttatcaa

SEQ ID NO: 77281 - DNA, 660 bp, Homo sapiens
caaggctgggccggggaggcgcgcgtgcgcgggccccggcacgaaggcggggccggacctggaggcggggccaggcccagggcaggcgacccgagggccgagggtttggaactcgcagaggttaaacactttaagatgagaaaaattgatctctgtctgagctctgaagggtccgaagtgattttagctacatcaagtgatgaaaaacacccacctgaaaatatcattgatgggaatccagaaacgttttggaccaccacaggaatgtttccccaggaattcattatttgtttccacaaacatgtaaggattgaaaggcttgtaatccaaagttactttgtacagaccttgaagattgaaaaaagcacgtctaaagagccagttgattttgagcaatggattgaaaaagatttggtacacacagaggggcagcttcaaaatgaagaaattgtggcacatgatggctccgctacttacttgagattcattattgtatcagcctttgatcattttgcatctgtgcatagcgtttctgcagaaggaacagtagtctcaaatctttcctcataatgataacaaaatgctcttgcatgattttttaacaatatatttaaacaggaagttgtcactgatatactttattaaaaggatttttatcaa

SEQ ID NO: 77282 - DNA, 572 bp, Homo sapiens
ggctcagcaccccgggcacaaagctaggaagggttaaacactttaagatgagaaaaattgatctctgtctgagctctgaagggtccgaagtgattttagctacatcaagtgatgaaaaacacccacctgaaaatatcattgatgggaatccagaaacgttttggaccaccacaggaatgtttccccaggaattcattatttgtttccacaaacatgtaaggattgaaaggcttgtaatccaaagttactttgtacagaccttgaagattgaaaaaagcacgtctaaagagccagttgattttgagcaatggattgaaaaagatttggtacacacagaggggcagcttcaaaatgaagaaattgtggcacatgatggctccgctacttacttgagattcattattgtatcagcctttgatcattttgcatctgtgcatagcgtttctgcagaaggaacagtagtctcaaatctttcctcataatgataacaaaatgctcttgcatgattttttaacaatatatttaaacaggaagttgtcactgatatactttattaaaaggatttttatcaa

SEQ ID NO: 77283 - DNA, 943 bp, Homo sapiens
cggggtaggagcgagcgcgcccgggaactcggtggagcgagcgcgcccgggaactcggtggaggccgcggtggcggggtggggcggggctgagggcagggcggggcctgtgggagtcgtggcgcaaagagctcggggtaggagcgcgcgcccggaaactcagcggtggccgcggcgaaggggcggggctgagggtgggacggggcttgtgggaggcgtggcgcgaagatttcagagttggagcgcgcgcgaccccggactccacggaggccgcggcgagcaggcggagctgcgggtcgggacgctctgcgtggggcggggcgcaagggaggtttcgagcccggaaggtccggcgcccagagctaacgggagtcccaggttaaacactttaagatgagaaaaattgatctctgtctgagctctgaagggtccgaagtgattttagctacatcaagtgatgaaaaacacccacctgaaaatatcattgatgggaatccagaaacgttttggaccaccacaggaatgtttccccaggaattcattatttgtttccacaaacatgtaaggattgaaaggcttgtaatccaaagttactttgtacagaccttgaagattgaaaaaagcacgtctaaagagccagttgattttgagcaatggattgaaaaagatttggtacacacagaggggcagcttcaaaatgaagaaattgtggcacatgatggctccgctacttacttgagattcattattgtatcagcctttgatcattttgcatctgtgcatagcgtttctgcagaaggaacagtagtctcaaatctttcctcataatgataacaaaatgctcttgcatgattttttaacaatatatttaaacaggaagttgtcactgatatactttattaaaaggatttttatcaacaattgtttcagtttttatttacatt

SEQ ID NO: 77284 - DNA, 1059 bp, Homo sapiens
  misc_feature (1053)..(1053): n is a, c, g, or t
cggggtaggagcgagcgcgcccgggaactcggtggagcgagcgcgcccgggaactcggtggaggccgcggtggcggggtggggcggggctgagggcagggcggggcctgtgggagtcgtggcgcaaagagctcggggtaggagcgcgcgcccggaaactcagcggtggccgcggcgaaggggcggggctgagggtgggacggggcttgtgggaggcgtggcgcgaagatttcagagttggagcgcgcgcgaccccggactccacggaggccgcggcgagcaggcggagctgcgggtcgggacgctctgcgtggggcggggcgcaagggaggtttcgagcccggaaggtccggcgcccagagctaacgggagtcccaggttaaacactttaagatgagaaaaattgatctctgtctgagctctgaagggtccgaagtgattttagctacatcaagtgatgaaaaacacccacctgaaaatatcattgatgggaatccagaaacgttttggaccaccacaggaatgtttccccaggaattcattatttgtttccacaaacatgtaaggattgaaaggcttgtaatccaaagttactttgtacagaccttgaagattgaaaaaagcacgtctaaagagccagttgattttgagcaatggattgaaaaagatttggtacacacagaggggcagcttcaaaatgaagaaattgtggcacatgatggctccgctacttacttgagattcattattgtatcagcctttgatcattttgcatctgtgcatagcgtttctgcagaaggaacagtagtctcaaatctttcctcataatgataacaaaatgctcttgcatgattttttaacaatatatttaaacaggaagttgtcactgatatactttattaaaaggatttttatcaaaaaaaaaaaaaaaaaaaaaaaaacatgtcggccgcttgggccagtcaacttagacttgaacaggcttatcatgcggccgaattgagtcatttggcaattcgcctataggagaggtttcaatggcgcgcttacccgngctggg

SEQ ID NO: 77285 - DNA, 714 bp, Homo sapiens
  misc_feature (95)..(95): n is a, c, g, or t
ttcttttcccaagttggaagcaaagggtcaattctggtcactgcaattcttccttcggggttccacgaatttccgccccagactttccaaggaantggattcacagtggggtccaaccaggccagcttaatttggtatttaatgtgaaccggggtttctccggtgtgggtaagcttgttcccaacctcccacctcaggttattctgccgcccccagcactttgggagactagctttgaggctagttcaagaccagcctgggcaacacggtgagaccctgtccctacaaaaaatgagagttgcagtttttagctccagttgctatttttcatcaaatcaaggctggtatttagctgatatgtaccacaactattatatgtagctggccttatgtgttgttatatatttagaatattactcttgcatcaagctgtttcttttgctaactgcttgttaacagttaactagcactgctaaaagcatttatattgatttttttcccatacaggcacatgatggctccgctacttacttgagattcattattgtatcagcctttgatcattttgcatctgtgcatagcgtttctgcagaaggaacagtagtctcaaatctttcctcataatgataacaaaatgctcttgcatgattttttaacaatatatttaaacaggaagttgtcactgatatactttattaaaaggatttttatcaa

SEQ ID NO: 77286 - DNA, 884 bp, Homo sapiens
aaaccagtttagaaggaagatgactgtattcctgataagtctcttctctcattaatcgtggaggttctagagtcatacctaaagtttgaattccatttctggcacttatgagctgtatatcattgaacaccttgcttggctcctctaaacctgttttctcaccagtaaagtgggttaaagtacctttctcataagattgtagtcaaaagtgaatggataaatatgtttgactcatcataggctctccataaatgtttatgaccaagaccaccaatagtagtattatcgccatacacacaaaaaaatcggaacaatgccaaattcagaaaagctctacttgctctgtgttgtatggttgcgaacatttggaagattagttacacaagactatattttaccatagggttttttggaaacatacagagtaacttccatgttgtttctgatcccagtgctctgtgtagttccactgtgcatgataatctcaggcagagggaaaaagaaatatagggacaaaaacatacagccagattaacactttacttactttgtttacaatgttagtacagaccttgaagattgaaaaaagcacgtctaaagagccagttgattttgagcaatggattgaaaaagatttggtacacacagaggggcagcttcaaaatgaagaaattgtggcacatgatggctccgctacttacttgagattcattattgtatcagcctttgatcattttgcatctgtgcatagcgtttctgcagaaggaacagtagtctcaaatctttcctcataatgataacaaaatgctcttgcatgattttttaacaatatatttaaacaggaagttgtcactgatatactttattaaaaggatttttatcaa

SEQ ID NO: 77287 - DNA, 1507 bp, Homo sapiens
cggggtaggagcgagcgcgcccgggaactcggtggagcgagcgcgcccgggaactcggtggaggccgcggtggcggggtggggcggggctgagggcagggcggggcctgtgggagtcgtggcgcaaagagctcggggtaggagcgcgcgcccggaaactcagcggtggccgcggcgaaggggcggggctgagggtgggacggggcttgtgggaggcgtggcgcgaagatttcagagttggagcgcgcgcgaccccggactccacggaggccgcggcgagcaggcggagctgcgggtcgggacgctctgcgtggggcggggcgcaagggaggtttcgagcccggaaggtccggcgcccagagctaacgggagtcccaggttaaacactttaagatgagaaaaattgatctctgtctgagctctgaagggtccgaagtgattttagctacatcaagtgatgaaaaacacccacctgaaaatatcattgatgggaatccagaaacgttttggaccaccacaggaatgtttccccaggaattcattatttgtttccacaaacatgtaaggattgaaaggcttgtaatccaaagttactttgtacagaccttgaagattgaaaaaagcacgtctaaagagccagttgattttgagcaatggattgaaaaagatttggtacacacagaggggcagcttcaaaatgaagaaattgtggcacatgatggctccgctacttacttgagattcattattgtatcagcctttgatcattttgcatctgtgcatagcgtttctgcagaaggaacagtagtctcaaatctttcctcataatgataacaaaatgctcttgcatgattttttaacaatatatttaaacaggaagttgtcactgatatactttattaaaaggatttttatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacttgggggggggccccgtccccaatttccccttttggggggccgtttaaaattaaatggcccgttttttaaaaacttgtgaatgggaaaaccctggggttccccaaattaaaccccttggaaaaaattccccttttccccagtggggtaaatacgaaaaagcccccacccgttggcttttccaaaaattggcccaccctaatgggaaatgggaaattttgaccgtaaatttttggtaaaattcccgtaaaattttggaaaacaacctatttttaaccaaatggcccaaaatgggaaaatccctttttaattaaaagaaattaccccgataagggtcggagggttgtcccatttggaaacaagagtcctttttaaaaaacgggccttcaacctaaaagggcaaaaaaccctttttatggcgagggccacttttggaaccctccccctataagttttttgggtcagggccctaaaaca

SEQ ID NO: 77288 - DNA, 830 bp, Homo sapiens
agcacagatgtctcaatagccccatacaagtaatgtgcagaaacgcttgtgtcatatggccctgtacacatttgtaaatattcataatacactcctagaagggaacatgcttaattacaacatatgtgctgtctgggacagttggctcacacgtgtaatcccagcacggaggcagaggcggacagatcacctagggtcagtagttcaagcccagcctggctaacatggcaaaagccgcccagctaatttcgtatttttagtagagacagggtttctccatgttggttaggctgttctcaaactcccaacctcaggtgatctgtcggccccagcactttgggagactagctttgaggctagttcaagaccagcctgggcaacacggtgagaccctgtccctacaaaaaatgagagttgcagtttttagctccagttgctatttttcatcaaatcaaggctggtatttagctgatatgtaccacaactattatatgtagctggccttatgtgttgttatatatttagaatattactcttgcatcaagctgtttcttttgctaactgcttgttaacagttaactagcactgctaaaagcatttatattgatttttttcccatacaggcacatgatggctccgctacttacttgagattcattattgtatcagcctttgatcattttgcatctgtgcatagcgtttctgcagaaggaacagtagtctcaaatctttcctcataatgataacaaaatgctcttgcatgattttttaacaatatatttaaacaggaagttgtcactgatatactttattaaaaggatttttatcaa

SEQ ID NO: 77289 - DNA, 912 bp, Homo sapiens
ccttttttcttactttctaagattaaatttcaaggaatagaattactgggtgcaaggttgtaaacatacttatagcttttaaaatatattggctaattgctttccagagaaattatataaatataaaaatgtagtcatgcttcagggtagcgtattctgaggcaacattaaccaaaggaaacttctttattatgattgttgcccaggctggagtgcagtggtgcgatctctgctcactgcaatctctgcctcccgggttcaagcgattctcctgcctcagcctctcaagtagctgggattacaggtgcgtgccaccacgcccagctaatttcgtatttttagtagagacagggtttctccatgttggttaggctgttctcaaactcccaacctcaggtgatctgtcggccccagcactttgggagactagctttgaggctagttcaagaccagcctgggcaacacggtgagaccctgtccctacaaaaaatgagagttgcagtttttagctccagttgctatttttcatcaaatcaaggctggtatttagctgatatgtaccacaactattatatgtagctggccttatgtgttgttatatatttagaatattactcttgcatcaagctgtttcttttgctaactgcttgttaacagttaactagcactgctaaaagcatttatattgatttttttcccatacaggcacatgatggctccgctacttacttgagattcattattgtatcagcctttgatcattttgcatctgtgcatagcgtttctgcagaaggaacagtagtctcaaatctttcctcataatgataacaaaatgctcttgcatgattttttaacaatatatttaaacaggaagttgtcactgatatactttattaaaaggatttttatcaa

SEQ ID NO: 77290 - DNA, 1420 bp, Homo sapiens
agcacagatgtctcaatagccccatacaagtaatgtgcagaaacgcttgtgtcatatggccctgtacacatttgtaaatattcataatacactcctagaagggaacatgcttaattacaacatatgtgctgtctgggacagttggctcacacgtgtaatcccagcacggaggcagaggcggacagatcacctagggtcagtagttcaagcccagcctggctaacatggcaaaagccgcccagctaatttcgtatttttagtagagacagggtttctccatgttggttaggctgttctcaaactcccaacctcaggtgatctgtcggccccagcactttgggagactagctttgaggctagttcaagaccagcctgggcaacacggtgagaccctgtccctacaaaaaatgagagttgcagtttttagctccagttgctatttttcatcaaatcaaggctggtatttagctgatatgtaccacaactattatatgtagctggccttatgtgttgttatatatttagaatattactcttgcatcaagctgtttcttttgctaactgcttgttaacagttaactagcactgctaaaagcatttatattgatttttttcccatacaggcacatgatggctccgctacttacttgagattcattattgtatcagcctttgatcattttgcatctgtgcatagcgtttctgcagaaggaacagtagtctcaaatctttcctcataatgataacaaaatgctcttgcatgattttttaacaatatatttaaacaggaagttgtcactgatatactttattaaaaggatttttatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacttgggggggggccccgtccccaatttccccttttggggggccgtttaaaattaaatggcccgttttttaaaaacttgtgaatgggaaaaccctggggttccccaaattaaaccccttggaaaaaattccccttttccccagtggggtaaatacgaaaaagcccccacccgttggcttttccaaaaattggcccaccctaatgggaaatgggaaattttgaccgtaaatttttggtaaaattcccgtaaaattttggaaaacaacctatttttaaccaaatggcccaaaatgggaaaatccctttttaattaaaagaaattaccccgataagggtcggagggttgtcccatttggaaacaagagtcctttttaaaaaacgggccttcaacctaaaagggcaaaaaaccctttttatggcgagggccacttttggaaccctccccctataagttttttgggtcagggccctaaaaca

SEQ ID NO: 77291 - DNA, 1502 bp, Homo sapiens
ccttttttcttactttctaagattaaatttcaaggaatagaattactgggtgcaaggttgtaaacatacttatagcttttaaaatatattggctaattgctttccagagaaattatataaatataaaaatgtagtcatgcttcagggtagcgtattctgaggcaacattaaccaaaggaaacttctttattatgaaaaatactttagaaagacactttttttttttttttttgagacggaattttgctcttgttgcccaggctggagtgcagtggtgcgatctctgctcactgcaatctctgcctcccgggttcaagcgattctcctgcctcagcctctcaagtagctgggattacaggtgcgtgccaccacgcccagctaatttcgtatttttagtagagacagggtttctccatgttggttaggctgttctcaaactcccaacctcaggtgatctgtcggccccagcactttgggagactagctttgaggctagttcaagaccagcctgggcaacacggtgagaccctgtccctacaatggtatttagctgatatgtaccacaactattatatgtagctggccttatgtgttgttatatatttagaatattactcttgcatcaagctgtttcttttgctaactgcttgttaacagttaactagcactgctaaaagcatttatattgatttttttcccatacaggcacatgatggctccgctacttacttgagattcattattgtatcagcctttgatcattttgcatctgtgcatagcgtttctgcagaaggaacagtagtctcaaatctttcctcataatgataacaaaatgctcttgcatgattttttaacaatatatttaaacaggaagttgtcactgatatactttattaaaaggatttttatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacttgggggggggccccgtccccaatttccccttttggggggccgtttaaaattaaatggcccgttttttaaaaacttgtgaatgggaaaaccctggggttccccaaattaaaccccttggaaaaaattccccttttccccagtggggtaaatacgaaaaagcccccacccgttggcttttccaaaaattggcccaccctaatgggaaatgggaaattttgaccgtaaatttttggtaaaattcccgtaaaattttggaaaacaacctatttttaaccaaatggcccaaaatgggaaaatccctttttaattaaaagaaattaccccgataagggtcggagggttgtcccatttggaaacaagagtcctttttaaaaaacgggccttcaacctaaaagggcaaaaaaccctttttatggcgagggccacttttggaaccctccccctataagttttttgggtcagggccctaaaaca

SEQ ID NO: 77292 - DNA, 1331 bp, Homo sapiens
cggggtaggagcgagcgcgcccgggaactcggtggagcgagcgcgcccgggaactcggtggaggccgcggtggcggggtggggcggggctgagggcagggcggggcctgtgggagtcgtggcgcaaagagctcggggtaggagcgcgcgcccggaaactcagcggtggccgcggcgaaggggcggggctgagggtgggacggggcttgtgggaggcgtggcgcgaagatttcagagttggagcgcgcgcgaccccggactccacggaggccgcggcgagcaggcggagctgcgggtcgggacgctctgcgtggggcggggcgcaagggaggtttcgagcccggaaggtccggcgcccagagctaacgggagtcccaggttaaacactttaagatgagaaaaattgatctctgtctgagctctgaagggtccgaagtgattttagctacatcaagtgatgaaaaacacccacctgaaaatatcattgatggatttggtacacacagaggggcagcttcaaaatgaagaaattgtggcacatgatggctccgctacttacttgagattcattattgtatcagcctttgatcattttgcatctgtgcatagcgtttctgcagaaggaacagtagtctcaaatctttcctcataatgataacaaaatgctcttgcatgattttttaacaatatatttaaacaggaagttgtcactgatatactttattaaaaggatttttatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacttgggggggggccccgtccccaatttccccttttggggggccgtttaaaattaaatggcccgttttttaaaaacttgtgaatgggaaaaccctggggttccccaaattaaaccccttggaaaaaattccccttttccccagtggggtaaatacgaaaaagcccccacccgttggcttttccaaaaattggcccaccctaatgggaaatgggaaattttgaccgtaaatttttggtaaaattcccgtaaaattttggaaaacaacctatttttaaccaaatggcccaaaatgggaaaatccctttttaattaaaagaaattaccccgataagggtcggagggttgtcccatttggaaacaagagtcctttttaaaaaacgggccttcaacctaaaagggcaaaaaaccctttttatggcgagggccacttttggaaccctccccctataagttttttgggtcagggccctaaaaca

SEQ ID NO: 77293 - DNA, 979 bp, Homo sapiens
cggggtaggagcgagcgcgcccgggaactcggtggagcgagcgcgcccgggaactcggtggaggccgcggtggcggggtggggcggggctgagggcagggcggggcctgtgggagtcgtggcgcaaagagctcggggtaggagcgcgcgcccggaaactcagcggtggccgcggcgaaggggcggggctgagggtgggacggggcttgtgggaggcgtggcgcgaagatttcagagttggagcgcgcgcgaccccggactccacggaggccgcggcgagcaggcggagctgcgggtcgggacgctctgcgtggggcggggcgcaagggaggtttcgagcccggaaggtccggcgcccagagctaacgggagtcccaggttaaacactttaagatgagaaaaattgatctctgtctgagctctgaagggtccgaagtgattttagctacatcaagtgatgaaaaacacccacctgaaaatatcattgatgggaatccagaaacgttttggaccaccacaggaatgtttccccaggaattcattatttgtttccacaaacatgtaaggattgaaaggcttgtaatccaaagttactttgtacagaccttgaagattgaaaaaagcacgtctaaagagccagttgattttgagcaatggattgaaaaagatttggtacacacagaggggcagcttcaaaatgaagaaattgtggcacatgatggctccgctacttacttgagattcattattgtatcagcctttgatcattttgcatctgtgcatagcgtttctgcagaaggaacagtagtctcaaatctttcctcataatgataacaaaatgctcttgcatgattttttaacaatatatttaaacaggaagttgtcactgatatactttattaaaaggatttttatcaaaaaaaaaaaccctttctctacctccctccacctattcttctctatcttcaatcttatctaaa

SEQ ID NO: 77294 - DNA, 305 bp, Homo sapiens
caaggctgggccggggaggcgcgcgtgcgcgggccccggcacgaaggcggggccggacctggaggcggggccaggcccagggcaggcgacccgagggccgagggtttggaactcgcagaggtgggccctgcgcgtgcgtgctcgcgggagggtgggtcccctgggtcctgcgggccccggggatagagctgagctgggggagggtaggcagcgcgcgccccgggactggcctggggaaaggcgcacaggagtggtttcgcatcttggcccgcgaagtaatgggagccggagagggcggggccgat

SEQ ID NO: 77295 - DNA, 980 bp, Homo sapiens
cggggtaggagcgagcgcgcccgggaactcggtggagcgagcgcgcccgggaactcggtggaggccgcggtggcggggtggggcggggctgagggcagggcggggcctgtgggagtcgtggcgcaaagagctcggggtaggagcgcgcgcccggaaactcagcggtggccgcggcgaaggggcggggctgagggtgggacggggcttgtgggaggcgtggcgcgaagatttcagagttggagcgcgcgcgaccccggactccacggaggccgcggcgagcaggcggagctgcgggtcgggacgctctgcgtggggcggggcgcaagggaggtttcgagcccggaaggtccggcgcccagagctaacgggagtcccaggttaaacactttaagatgagaaaaattgatctctgtctgagctctgaagggtccgaagtgattttagctacatcaagtgatgaaaaacacccacctgaaaatatcattgatgggaatccagaaacgttttggaccaccacaggaatgtttccccaggaattcattatttgtttccacaaacatgtaaggattgaaaggcttgtaatccaaagttactttgtacagaccttgaagattgaaaaaagcacgtctaaagagccagttgattttgagcaatggattgaaaaaggtatgtgtttcaccagcattgttctgagcatgaaggagtagataatattcctttgattctgcatttctcatctagctgcactttggtgaaaaaagatgactttaatgatccttgtgacacatttagggtctagaaagacccaggtttgaatacaaagctgcttcttcatttactggttatataagtattaacatgtgacttaatttttctcagtttcagaatccttattaggaaaatggtgatgatatctatcattcaaggttttggtgaactagtgtctggcatataatagacaataaatattagtttctcat

SEQ ID NO: 77296 - DNA, 905 bp, Homo sapiens
gctggctgggctaggcagcatcacggggttctgcagcccaactgcacatcaggctggtgacagtcacgcagcctattacttcatgtgtcatcagaggatcgctagaacacagcacttcaagtgtgcagatttagtgagccatagtctaaagacaaatagagccactgaatcctaaatttcaatcaatcatctccgttactcgtcttattggtattaatcctttgaaattatgtggggtgggagttaaagctaataactaattatgttaatgctaaaactaagatttttctggcaagggaaaatcctcccaagtcccagcactttgggaggccgaggtgggcagatgacctgaggtcaggagtttgagaccagcctggccaacatggtgaaacgccatctctactaaaattgaaaaattagctgggcatggtggcaggtgcctgtaatcccagctattggggaggctgaagcaggagaatcgcttgaaacaggaggcagagattgcagtgagccgagattgtgccactgcactccagcctgggcaacaggaacaaaactctatctcaaaaaataaaacaagatttttctgagaaaaaggtgtaaaaccgtatactaaatttgaaatagaaatataagcgtgaactcatttgttgttcttttaccgtatacacattttctacctctgccccagtagcagtagacacatcaagcacctagaaagtggtctctaatacatgaaaaccatgaattcatagtggtggtttcaaagccaaaaccaacaacaaacacatgtaattcggtcactcttggaggtacctagggcactaactcctaacactgggaatggacacttgaaggaagatcagcaattatcctgtcttttctctacaaattgcaattcaggg

SEQ ID NO: 77297 - DNA, 2513 bp, Homo sapiens
  misc_feature (2513)..(2513): n is a, c, g, or t
gcgtcaagcttggcacgaggccatggagcagctgctgcgcgccgagctgcgcaccgcgaccctgcgggccttcggcggccccggcgccggctgcatcagcgagggccgagcctacgacacggacgcaggcccagtgttcgtcaaagtcaaccgcaggacgcaggcccggcagatgtttgagggggaggtggccagcctggaggccctccggagcacgggcctggtgcgggtgccgaggcccatgaaggtcatcgacctgccgggaggtggggccgcctttgtgatggagcatttgaagatgaagagcttgagcagtcaagcatcaaaacttggagagcagatggcagatttgcatctttacaaccagaagctcagggagaagttgaaggaggaggagaacacagtgggccgaagaggtgagggtgctgagcctcagtatgtggacaagttcggcttccacacggtgacgtgctgcggcttcatcccgcaggtgaatgagtggcaggatgactggccgacctttttcgcccggcaccggctccaggcgcagctggacctcattgagaaggactatgctgaccgagaggcacgagaactctggtcccggctacaggtgaagatcccggatctgttttgtggcctagagattgtccccgcgttgctccacggggatctctggtcgggaaacgtggctgaggacgacgtggggcccattatttacgacccggcttccttctatggccattccgagtttgaactggcaatcgccttgatgtttggggggttccccagatccttcttcaccgcctaccaccggaagatccccaaggctccgggcttcgaccagcggctgctgctctaccagctgtttaactacctgaaccactggaaccacttcgggcgggagtacaggagcccttcgttgggcaccatgcgaaggctgctcaagtagcggcccctgccctcccttcccctgtccccgtccccgtctccgtctccccgtcctgtccccccgtctccatactccgccgttaaccctcgatcctccttcgtaccgggttactctatgataagagttgcacttcaaatacacagataaagaaaacacaggctatgtcccatcgttcccagacgctacggctagcccactcgcgcgaacgaccacctcgctcgagacccgagcacagagaacgagcacacacaagcacagagagacaccacgcaggacgccgcgacccgcacagacggagacaagcagctcgccccacggccccacacaccagcacacaacagaacacagagagcgacagcgcaacggacgccagcagaccaaccgacgacaccacccgaacaccaacaaacgcttaaccacacaatcaactaccatcactcaacccagccccacgccaaaaccagacagtcacaccatagctagccacgcaaatccatctcacaaccaactccgcaacacacactcctcgccaacatgaccacacaaattaagcacccaacgagctacaccaaacgaaataagaaccttactctccccgcaccatccactcaacaccaataacacctaccacacctagtagtagtctacatactaactaccgcacacccaactgcaccccacccgaacgagcaggagacgacgcaccagcgacgccccctagacgcgacgacacccacagcgagcccgcgcacccgcgcaaccatggcgacggcgaccgagagaacgacccgagaggagtggacgcggacaggagcgacgacggacacacccgacccgcagccgcacagcgcaagccgcgcaccggagacggaccgcggagaacgacagtcccgacccgcacgagccgatacagcaaccgcgccccagcggacgcccgaccgaggcgccgacgcgcaaccacacctcctccgacaatcgatggaagagagcgacagagcacccaagcagacatgccagacgagagggcccacagcgcaggcacagccgccggcataccgatacaagcgcacacacgaaggacgacgccccacatctcagaaggactgcagcaggacaggtcgcgcacaggagtggggcacccgtgcctcggtggccggcagccacgtgcgcgcgcagccgacacaactcacccgagcagcgcgtctcgcagtcaccgcgcagatagcgacgacgagactcacgagctgcgacggttgaggcagaagtacacggaggcgacgacagcatcgagaggacagcggtgcagacgtatgagaagacagaggcagggtctagacggcacaggatctcgcgagagaggcgtcgggatagacgaggcgacgcggctcgccggcaggagctcatggaggcagcaggagagcgcgaagagacgcgagagagcgcagcgagggataccggcggagagagtagcacgatgacgaaggccagcgcagagaaagaagatggacatcaggaagcaggtagcagggctgcgagggaaggtgaggcatagagcgctcgn

SEQ ID NO: 77298 - DNA, 2248 bp, Homo sapiens
  misc_feature (2248)..(2248): n is a, c, g, or t
cccgatgttgtcaacgtggtcgagcatttgaagatgaagagcttgagcagtcaagcatcaaaacttggagagcagatggcagatttgcatctttacaaccagaagctcagggagaagttgaaggaggaggagaacacagtgggccgaagaggtgagggtgctgagcctcagtatgtggacaagttcggcttccacacggtgacgtgctgcggcttcatcccgcaggtgaatgagtggcaggatgactggccgacctttttcgcccggcaccggctccaggcgcagctggacctcattgagaaggactatgctgaccgagaggcacgagaactctggtcccggctacaggtgaagatcccggatctgttttgtggcctagagattgtccccgcgttgctccacggggatctctggtcgggaaacgtggctgaggacgacgtggggcccattatttacgacccggcttccttctatggccattccgagtttgaactggcaatcgccttgatgtttggggggttccccagatccttcttcaccgcctaccaccggaagatccccaaggctccgggcttcgaccagcggctgctgctctaccagctgtttaactacctgaaccactggaaccacttcgggcgggagtacaggagcccttcgttgggcaccatgcgaaggctgctcaagtagcggcccctgccctcccttcccctgtccccgtccccgtctccgtctccccgtcctgtccccccgtctccatactccgccgttaaccctcgatcctccttcgtaccgggttactctatgataagagttgcacttcaaatacacagataaagaaaacacaggctatgtcccatcgttcccagacgctacggctagcccactcgcgcgaacgaccacctcgctcgagacccgagcacagagaacgagcacacacaagcacagagagacaccacgcaggacgccgcgacccgcacagacggagacaagcagctcgccccacggccccacacaccagcacacaacagaacacagagagcgacagcgcaacggacgccagcagaccaaccgacgacaccacccgaacaccaacaaacgcttaaccacacaatcaactaccatcactcaacccagccccacgccaaaaccagacagtcacaccatagctagccacgcaaatccatctcacaaccaactccgcaacacacactcctcgccaacatgaccacacaaattaagcacccaacgagctacaccaaacgaaataagaaccttactctccccgcaccatccactcaacaccaataacacctaccacacctagtagtagtctacatactaactaccgcacacccaactgcaccccacccgaacgagcaggagacgacgcaccagcgacgccccctagacgcgacgacacccacagcgagcccgcgcacccgcgcaaccatggcgacggcgaccgagagaacgacccgagaggagtggacgcggacaggagcgacgacggacacacccgacccgcagccgcacagcgcaagccgcgcaccggagacggaccgcggagaacgacagtcccgacccgcacgagccgatacagcaaccgcgccccagcggacgcccgaccgaggcgccgacgcgcaaccacacctcctccgacaatcgatggaagagagcgacagagcacccaagcagacatgccagacgagagggcccacagcgcaggcacagccgccggcataccgatacaagcgcacacacgaaggacgacgccccacatctcagaaggactgcagcaggacaggtcgcgcacaggagtggggcacccgtgcctcggtggccggcagccacgtgcgcgcgcagccgacacaactcacccgagcagcgcgtctcgcagtcaccgcgcagatagcgacgacgagactcacgagctgcgacggttgaggcagaagtacacggaggcgacgacagcatcgagaggacagcggtgcagacgtatgagaagacagaggcagggtctagacggcacaggatctcgcgagagaggcgtcgggatagacgaggcgacgcggctcgccggcaggagctcatggaggcagcaggagagcgcgaagagacgcgagagagcgcagcgagggataccggcggagagagtagcacgatgacgaaggccagcgcagagaaagaagatggacatcaggaagcaggtagcagggctgcgagggaaggtgaggcatagagcgctcgn

SEQ ID NO: 77299 - DNA, 1928 bp, Homo sapiens
  misc_feature (1928)..(1928): n is a, c, g, or t
actctgaggatccccggctgactacggagtgaagatcccggatctgttttgtggcctagagattgtccccgcgttgctccacggggatctctggtcgggaaacgtggctgaggacgacgtggggcccattatttacgacccggcttccttctatggccattccgagtttgaactggcaatcgccttgatgtttggggggttccccagatccttcttcaccgcctaccaccggaagatccccaaggctccgggcttcgaccagcggctgctgctctaccagctgtttaactacctgaaccactggaaccacttcgggcgggagtacaggagcccttcgttgggcaccatgcgaaggctgctcaagtagcggcccctgccctcccttcccctgtccccgtccccgtctccgtctccccgtcctgtccccccgtctccatactccgccgttaaccctcgatcctccttcgtaccgggttactctatgataagagttgcacttcaaatacacagataaagaaaacacaggctatgtcccatcgttcccagacgctacggctagcccactcgcgcgaacgaccacctcgctcgagacccgagcacagagaacgagcacacacaagcacagagagacaccacgcaggacgccgcgacccgcacagacggagacaagcagctcgccccacggccccacacaccagcacacaacagaacacagagagcgacagcgcaacggacgccagcagaccaaccgacgacaccacccgaacaccaacaaacgcttaaccacacaatcaactaccatcactcaacccagccccacgccaaaaccagacagtcacaccatagctagccacgcaaatccatctcacaaccaactccgcaacacacactcctcgccaacatgaccacacaaattaagcacccaacgagctacaccaaacgaaataagaaccttactctccccgcaccatccactcaacaccaataacacctaccacacctagtagtagtctacatactaactaccgcacacccaactgcaccccacccgaacgagcaggagacgacgcaccagcgacgccccctagacgcgacgacacccacagcgagcccgcgcacccgcgcaaccatggcgacggcgaccgagagaacgacccgagaggagtggacgcggacaggagcgacgacggacacacccgacccgcagccgcacagcgcaagccgcgcaccggagacggaccgcggagaacgacagtcccgacccgcacgagccgatacagcaaccgcgccccagcggacgcccgaccgaggcgccgacgcgcaaccacacctcctccgacaatcgatggaagagagcgacagagcacccaagcagacatgccagacgagagggcccacagcgcaggcacagccgccggcataccgatacaagcgcacacacgaaggacgacgccccacatctcagaaggactgcagcaggacaggtcgcgcacaggagtggggcacccgtgcctcggtggccggcagccacgtgcgcgcgcagccgacacaactcacccgagcagcgcgtctcgcagtcaccgcgcagatagcgacgacgagactcacgagctgcgacggttgaggcagaagtacacggaggcgacgacagcatcgagaggacagcggtgcagacgtatgagaagacagaggcagggtctagacggcacaggatctcgcgagagaggcgtcgggatagacgaggcgacgcggctcgccggcaggagctcatggaggcagcaggagagcgcgaagagacgcgagagagcgcagcgagggataccggcggagagagtagcacgatgacgaaggccagcgcagagaaagaagatggacatcaggaagcaggtagcagggctgcgagggaaggtgaggcatagagcgctcgn

SEQ ID NO: 77300 - DNA, 401 bp, Homo sapiens
tttagtagataatgtctttttgcacataacttattgttggatttgctttatttttccaacctgccaatctgtcatttaccaagagtatttatttttgacattcgtatttaatgtgcttagtcatatagttttgagtctgtcatcttgcaatttgttttttgtttcatctgccctttgttctctctttacctgccttcctctgggttgagtattttatgtttctgtcttacctcctttgttggcttactaggtatctttgctgggttttgaatggtccctctagggtttaggcagcacttggctccgaattgcaacagtggcctcttttcccttgttgtccaggtgaatgagtggcaggatgactggccgacctttttcgcccggcaccggctccaggcgca

SEQ ID NO: 77301 - DNA, 1004 bp, Homo sapiens
gcgtcaagcttggcacgaggccatggagcagctgctgcgcgccgagctgcgcaccgcgaccctgcgggccttcggcggccccggcgccggctgcatcagcgagggccgagcctacgacacggacgcaggcccagtgttcgtcaaagtcaaccgcaggacgcaggcccggcagatgtttgagggggaggtggccagcctggaggccctccggagcacgggcctggtgcgggtgccgaggcccatgaaggtcatcgacctgccgggaggtggggccgcctttgtgatggagcatttgaagatgaagagcttgagcagtcaagcatcaaaacttggagagcagatggcagatttgcatctttacaaccagaagctcagggagaagttgaaggaggaggagaacacagtgggccgaagaggtgagggtgctgagcctcagtatgtggacaagttcggcttccacacggtgacgtgctgcggcttcatcccgcaggtgaatgagtggcaggatgactggccgacctttttcgcccggcaccggctccaggcgcagctggacctcattgagaaggactatgctgaccgagaggcacgagaactctggtcccggctacaggtgaagatcccggatctgttttgtggcctagagattgtccccgcgttgctccacggggatctctggtcgggaaacgtggctgaggacgacgtggggcccattatttacgacccggcttccttctatggccattccgagtttgaactggcaatcgccttgatgtttggggggttccccagatccttcttcaccgcctaccaccggaagatccccaaggctccgggcttcgaccagcggctgctgctctaccagctgtttaactacctgaaccactggaaccacttcgggcgggagtacaggagcccttcgttgggcaccatgcgaaggctgctcaagtagcggcccctgccctcccttcccccgtagtcaaagcgatggtctagagtcacct

SEQ ID NO: 77302 - DNA, 461 bp, Homo sapiens
aataatgatgaccactgtcacttgtttgggcacgtgctgaccatctgtataaaactctggactaaccccctttagataaaatatttgtgatcctcgaagcattctgaaaaatgctactatttttaatttccaaagaggaaaacaggtctcagagggttaagtaacttgtccgaagtggctgagctggggttaaactcctctgaccctgcaggccatgctcttgtcactgctcaaagaacatcttccttccctcccccacacccacattcccttattccttcacaccgtctgtcactcattcattcacccattcattcattcctcaaatgctgtgagcacaggctgggtatgaagctggggctgcatgctcagctacccagacacacgaagcagggtggccaccctcagtgagcccacagtctcacgggaggcagagcagctgggatgctcgcagaggggcc

SEQ ID NO: 77303 - DNA, 387 bp, Homo sapiens
caccctgaactatttcttggatgaaattaccaccctcccacttttggcaatgagacagcaagcttggaatttggagtccatgttaaatccaggtcccagccaggcacagtggctcacgcctgtaattccagcattttgggaggctgagatgggaggatcacttgagcccaggagtttgaggccagcctggtcaacacaaggagacttcatctctataaataataaaaaaattaaaaattagctgggtgtggtggtgcacacctgtagtcccagctactcaggaggctgagatgggaagatggcttgagcctgggaatttgaggctatagtgagccatgattgcaccactgcactccagactgggagacacagcaagaccttgtctca

SEQ ID NO: 77304 - DNA, 467 bp, Homo sapiens
gaaatatgatctatttttgccaagctgatctatatcagcttaaacttgaactttgagggcagacaaaacagaatcgtactatcatcctaaagactacttcctccctctagtgaccaggaatgggaatatcacagctacaggcatttagaaaacttgattctcaatgtatatgcatacctccctctaggggatatttgggaaattttcagtagtaattttggttattacgatgaatagggctgcagctggtattcattaagggcattagggatgctagacatcgtgaatgtgagggatagtgccctatataaaataattttccagctcaaaacattcatgtagatgaaaaattcattattttttaagtctagaacatagcagttcagtcatgtttcacttaacaatgagacattctgagaaatgtgtcattaggcaatttcatcattgtgcaaacatcatacaatata

SEQ ID NO: 77305 - DNA, 2272 bp, Homo sapiens
gaaagctggtgtggagggagaagcgagtgtggtccggagaaagaaggcgtggagaagagggagggagcgagagcgagagaataaatatataaataaatacgagaacgaaatccactccgcagtctccgggctcggaaactttggccccgagcgccagagcgccagagcgcgagagcgcggcgctcgccactctgaggctggcggcctcgattccggccgcgttcccccggcccccctccgtccgcggggcctggtctccgggttctgccaggcgcatcagcccgcacaacttctggccgaggccagccggcagaggcggacttggggttggagtgtttgtttgtttgaacttcctcgtcgtcgccaccttccctccccccaacctccaccccacctcacccccctccccagcttctggacgcgtttgactgcagccaggggtggggggtgggggtagggagtgtgtgtggaggggagggagaagaggttaaaaaaaagaagacgaagaagacggaaagaaagagatcgcagcaggggtgaagggagcggacgggaagcgatttttgccgactttggattcgtccccggcgtgcgcaagaatggcggcccttcccggcacggtaccgagaatgatgcggccggctccggggcagaactacccccgcacgggattccctttggaagtgtccaccccgcttggccaaggccgggtcaatcagctgggaggggtcttcatcaatgggcgacccctgcctaaccacatccgccacaagatagtggagatggcccaccatggcatccggccctgtgtcatctcccgacagctgcgtgtctcccacggctgcgtctccaagattctttgccgctaccaggagaccgggtccatccggcctggggccatcggcggcagcaagcccagacaggtggcgactccggatgtagagaaaaagattgaggagtacaagagggaaaacccaggcatgttcagctgggagatccgggacaggctgctgaaggatgggcactgtgaccgaagcactgtgccctcaggtttagtgagttcgattagccgcgtgctcagaatcaagttcgggaagaaagaggaggaggatgaagcggacaagaaggaggacgacggcgaaaagaaggccaaacacagcatcgacggcatcctgggcgacaaagggaaccggctggacgagggctcggatgtggagtcggaacctgacctcccactgaagcgcaagcagcgacgcagtcggaccacattcacggccgagcagctggaggagctggagaaggcctttgagaggacccactacccagacatatacacccgcgaggagctggcgcagaggaccaagctgacagaggcgcgtgtgcaggtctggttcagtaaccgccgcgcccgttggcgtaagcaggcaggagccaaccagctggcggcgttcaaccaccttctgccaggaggcttcccacccaccggcatgcccacgctgcccccctaccagctgccggactccacctaccccaccaccaccatctcccaagatgggggcagcactgtgcaccggcctcagcccctgccaccgtccaccatgcaccagggcgggctggctgcagcggctgcagccgccgacaccagctctgcctacggagcccgccacagcttctccagctactctgacagcttcatgaatccggcggcgccctccaaccacatgaacccggtcagcaacggcctgtctcctcaggtgatgagcatcttgggcaaccccagtgcggtgcccccgcagccacaggctgacttctccatctccccgctgcatggcggcctggactcggccacctccatctcagccagctgcagccagcgggccgactccatcaagccaggggacagcctgcccacctcccaggcctactgcccacccacctacagcaccaccggctacagcgtggaccccgtggccggctatcagtacggccagtacggccagagtgagtgcctggtgccctgggcgtcccccgtccccattccttctcccacccccagggcctcctgcttgtttatggagagctacaaggtggtgtcagggtggggaatgtccatttcacagatggaaaaattgaagtccagccagatggaacagttcacctaaaatgacactgagttgggcaaaacccaggacatctcctggctaagcctctgcttccgtactatggctccaacagaaataaaatacacagcacaaatatcaaaaaaaaaaaa

SEQ ID NO: 77306 - DNA, 914 bp, Homo sapiens
agtgaatattataaagatgttaattctctctatagtcactttttaaatacaataccaataaaaactctagcaagtgtatttacagtagtttaattttttcgaacacttctaaagatgaccctaacatttatattgaaatgtatatggtcaaaagtaactaaggcaatcatgaaggacatttcatgaatttcatttccagataaaaataaatgatatttaagataacttaatattagcttaagtgtatacaaaaagaccaatggaatagaataaggagtccagaaatatattcctaaatatatatggccaattaatttatcacaaaattgacactgcagtgtagtgggcaaagctttgatagttttcttaatgggtgttactaggtcaatttgatattcttatgggaaaaataaatcttgaacctgactcataccatacacaaattaactctggttaaatacagatttaattatgcaagtgaataatcataaaacttcttgaaaataccataggaaaatatcttcaaagtcttgaggatatacaactattttttaataagatacacatcccattgatcataatgaagagtttggtaaacaaggttgtattagaattaataaattcaattcatcaaaagacaccaataagagattttaaaaactagagagtgattgaaaatattagcaacagaaatatatatacataacaaaaaagacttgcatccagaacatataactctcaattattgacaaggaatagtcaggtcagataattttttttaaagatgaaatacttaagttggcatttcataaagatgatatcaaaatgactaataaacatatgaatagccccacctcattcatgttagaaaactacaaatgaaaacaataatgagatatcattttactcccatg

SEQ ID NO: 77307 - DNA, 352 bp, Homo sapiens
ccagcgggttagttactactgtttccctgttttacagataaggaaactgaatataagtaatgtatttgttggtacacagctaataaatgagagcaggatttacacccaggtagccccactccatggtctgtcctcttaaacactgtgctatgttatctcttaatacaatttacagaaaactaaaggattcaaaagcaaattcatggtgtgattaataaccagataatttggttatggccctgttctatctacacaataatctggaaaaaaaagattaagttctgtgttagagccagatcatggatgccatcttggtacccatcactcaagtataatatagtgtctggaagtc

SEQ ID NO: 77308 - DNA, 502 bp, Homo sapiens
aaaaaattcagagtccagaggcatctagtaaagtggacggggtgtggggaaggccctgccgcatctgccttctgctcttctcatgcgacatctcaacccagagcaggaggccccagggggaaaacccagcacctgccacagggaatcagggctgagaaaaggccggcatttcggccttcctgccgaatcatttccagctgccctggtcacctaagtgacaagatgatgcatcaatgtcaataatgctggaagggactatccacagacacggcgatattctccccaggaggcatgagggtggcctcgccaggcagctggagccactgagaattaaggggccctcttcaggatctctgtctccccttcccaatgaatatgtatttatgtgtgtgtgtgtgtgtgtgtatatatatatatatatttttttttttttttttgagccggagtctcgctgtgtcccccaggctggagtgcagtggtgcgatctcagctcactgcaacc

SEQ ID NO: 77309 - DNA, 900 bp, Homo sapiens
cccggctcttgctttcctcccacccggatctaggcgcgcaggggccaagcagggacgcagcccagtggctccagccacgccgtcctgcccccttctgcagaaactgatgctctgagaggccaagcagtttgcccaagattacacagtcatagccgtgcctgggagaaccttctcttcaactctgccgcaccactgtcaagctcacctttcttctaaggttttattttagagttaacatcctccaaaaagccttcctcaggagttgaaggtgcccctaatatcacagccatggcatcctgtacactggaccttattgtctgtctgcctgttgtaccttgtatgagtctataagcaaaacctataagaagccacatctggctattctatgtactcaaaaaataattggcaagtgaaagaatgaggaaaaggagaaaaaattcagaaggcccctaccccttccaatgggtcaagtcaggaatttcctacctgcatgtgattccctgtgtcctagagggttttatttactcctcagaccttggaaactgttaaccagagtctctgtttggagatcttatctgtgtgcttctccatgggtgttgtttccctgtctctgcagccatgcattcctcagctctttaagtggtggagcctgtctgcctggatagagtgcaaaagctacagtgtaatcttgctttctttcagggccactgaccagaggaaataaaaactggactgattgggctctcctgatgtagaccagccagtggccctctaagtttccttctatgtttaaaattccttatctgacattgctagctgatcagcaggcccacaggtcagctgagggcttatctccagggctggagcttcaaagagatacatgcacacgactcccctggg

SEQ ID NO: 77310 - DNA, 419 bp, Homo sapiens
  misc_feature (26)..(28): n is a, c, g, or t
ggggggggggggaaaaattagggggnnncacagagagggggctgctgccactgctgccaacactgcccagcttgtgaggccaggaggagcccctgtcccactcggtgctgctgctcttctgacccctgctgtgaggaatgggattcttggtcgaaaaaattggttttccttttttgtataaatgaaaagaatccaggagaagctgccaccctcccctcccagcgtgatgcgctaccttgcttcggcgtcttgtcgccctttccgcctttggtccagggacagcccagcagatcctcctggttctgacctggggggtgtttgcatcacccccttttacttgtattaaaaaaaaatgatgggttgaaaatgtactgaggattaaaaatgtacttttttataaataaagtgtttaaaacaaa

SEQ ID NO: 77311 - DNA, 352 bp, Homo sapiens
  misc_feature (23)..(23): n is a, c, g, or t
ggaggtttctctgatttctcccnttatctagcaacacgtgctgctgctcttctgacccctgctgtgaggaatgggattcttggtcgaaaaaattggttttccttttttgtataaatgaaaagaatccaggagaagctgccaccctcccctcccagcgtgatgcgctaccttgcttcggcgtcttgtcgccctttccgcctttggtccagggacagcccagcagatcctcctggttctgacctggggggtgtttgcatcacccccttttacttgtattaaaaaaaaatgatgggttgaaaatgtactgaggattaaaaatgtacttttttataaataaagtgtttaaaacaaa

SEQ ID NO: 77312 - DNA, 245 bp, Homo sapiens
aacaacccctcccctcccctccctggtgctgccaccctcccctcccagcgtgatgcgctaccttgcttcggcgtcttgtcgccctttccgcctttggtccagggacagcccagcagatcctcctggttctgacctggggggtgtttgcatcacccccttttacttgtattaaaaaaaaatgatgggttgaaaatgtactgaggattaaaaatgtacttttttataaataaagtgtttaaaacaaa

SEQ ID NO: 77313 - DNA, 2031 bp, Homo sapiens
gctccctggtgctgctattgaaccccctgccagctccatttctgccctggcaaccctgggcccagcaggtgggtcgtcgttgtctggccctcactgccctggccccagcccaggctgcccagtagccacgtagcagaagtctgaagccatgccagccctggtgcggctctcccctctacacatttggggtactggatagggtgaagttaggggagaaaattgtggagtctttccagccacagggcagagggaggtggaggagctgggctgcttttcccagcagtattagtgtcccccaggacaggggaccttttccacattacatcactgccccatcccaccttacaacactctggcccctctgcttggtccccttttcccccaggcaggaggcaatcccaggggcctgcctgatagaggcatttcctgtccctgtctcctcctgcatctcctttatcctgcactgccaccctctattccccattctgtgttggactttgaaggccccaagcccagccaaagcactgagttcccccttaagacacctccacaccctccccacaagcaaagcacaaattttggggtccatgtagcatgggccacgtaggaggctcctgacttgccaggggcccagcctcagcatacccaccgagcagctgccagcctgggctgagggtgggcatgaggcaggagtcagcacttggacctagggatgtgaggttttctgtgccccaagtttgtgggaaggtgggcactactgctgggcccacagacacagccagctggcaaaagggaggtctagcccagcagagagatgaggacattttgcttctccttcatgcccacagcatgagctgagcttctgctttgctggaaatgaaataaacttggtatgaattgtgccaaggcctccccagttgtcatcctgcctcttgttgccctccctgtccttgccccccaccccacacccatgcccctgtttccttacagattttgatattgttctaatgtgtaatagaaccagccgagtccccttttatcagaagggtctgaaaagcagcagcacagagtaggtgaacacaggcctgcaagtgcgaccacctcagacccagtacgtgtgcccacagtggacacactcacacctccaacacacccacgcgcaggcatgtgtacacgcatgtacacacgcatgcatgcacagccagatggccactcagcacagatgtggcagagggaatggtctgatcctgctgaaagccattaaggagaaacgaatttcccagtgcccgggctgcaagagagccttataggggccctgtttcctgggcatgcgcttcctctgccagccaacccccacttgcccaagtcactggtgcaataacttttctgccttcctcagagcagagaaattgggaattgtgttaggtgggtgtgggcagctctgctgagccaagcagacacggatgtcccctcttctgggaggagggtagtgctcccaggcctcaggagtccagacagagacccccaaagcctgactgccaacagaaaccctctcctagtgaggggcaggtgggtgtgccccaggtccccacacccacagggaggcttcacacactgcccagtaccggggatgccaggaggcaggcccctctgctgctgccactgctgccaacactgcccagcttgtgaggccaggaggagcccctgtcccactcggtgctgctgctcttctgacccctgctgtgaggaatgggattcttggtcgaaaaaattggttttccttttttgtataaatgaaaagaatccaggagaagctgccaccctcccctcccagcgtgatgcgctaccttgcttcggcgtcttgtcgccctttccgcctttggtccagggacagcccagcagatcctcctggttctgacctggggggtgtttgcatcacccccttttacttgtattaaaaaaaaatgatgggttgaaaatgtactgaggattaaaaatgtacttttttataaataaagtgtttaaaacaaa

SEQ ID NO: 77314 - DNA, 1990 bp, Homo sapiens
agctgactcttgagtatcccataaatctggatatcggagtttctggccctcactgccctggccccagcccaggctgcccagtagccacgtagcagaagtctgaagccatgccagccctggtgcggctctcccctctacacatttggggtactggatagggtgaagttaggggagaaaattgtggagtctttccagccacagggcagagggaggtggaggagctgggctgcttttcccagcagtattagtgtcccccaggacaggggaccttttccacattacatcactgccccatcccaccttacaacactctggcccctctgcttggtccccttttcccccaggcaggaggcaatcccaggggcctgcctgatagaggcatttcctgtccctgtctcctcctgcatctcctttatcctgcactgccaccctctattccccattctgtgttggactttgaaggccccaagcccagccaaagcactgagttcccccttaagacacctccacaccctccccacaagcaaagcacaaattttggggtccatgtagcatgggccacgtaggaggctcctgacttgccaggggcccagcctcagcatacccaccgagcagctgccagcctgggctgagggtgggcatgaggcaggagtcagcacttggacctagggatgtgaggttttctgtgccccaagtttgtgggaaggtgggcactactgctgggcccacagacacagccagctggcaaaagggaggtctagcccagcagagagatgaggacattttgcttctccttcatgcccacagcatgagctgagcttctgctttgctggaaatgaaataaacttggtatgaattgtgccaaggcctccccagttgtcatcctgcctcttgttgccctccctgtccttgccccccaccccacacccatgcccctgtttccttacagattttgatattgttctaatgtgtaatagaaccagccgagtccccttttatcagaagggtctgaaaagcagcagcacagagtaggtgaacacaggcctgcaagtgcgaccacctcagacccagtacgtgtgcccacagtggacacactcacacctccaacacacccacgcgcaggcatgtgtacacgcatgtacacacgcatgcatgcacagccagatggccactcagcacagatgtggcagagggaatggtctgatcctgctgaaagccattaaggagaaacgaatttcccagtgcccgggctgcaagagagccttataggggccctgtttcctgggcatgcgcttcctctgccagccaacccccacttgcccaagtcactggtgcaataacttttctgccttcctcagagcagagaaattgggaattgtgttaggtgggtgtgggcagctctgctgagccaagcagacacggatgtcccctcttctgggaggagggtagtgctcccaggcctcaggagtccagacagagacccccaaagcctgactgccaacagaaaccctctcctagtgaggggcaggtgggtgtgccccaggtccccacacccacagggaggcttcacacactgcccagtaccggggatgccaggaggcaggcccctctgctgctgccactgctgccaacactgcccagcttgtgaggccaggaggagcccctgtcccactcggtgctgctgctcttctgacccctgctgtgaggaatgggattcttggtcgaaaaaattggttttccttttttgtataaatgaaaagaatccaggagaagctgccaccctcccctcccagcgtgatgcgctaccttgcttcggcgtcttgtcgccctttccgcctttggtccagggacagcccagcagatcctcctggttctgacctggggggtgtttgcatcacccccttttacttgtattaaaaaaaaatgatgggttgaaaatgtactgaggattaaaaatgtacttttttataaataaagtgtttaaaacaaa

SEQ ID NO: 77315 - DNA, 1994 bp, Homo sapiens
gctccctggtgctgctattgaaccccctgccagctccatttctgccctggcaaccctgggcccagcaggtgggtcgtcgttgtctggccctcactgccctggccccagcccaggctgcccagtagccacgtagcagaagtctgaagccatgccagccctggtgcggctctcccctctacacatttggggtactggatagggtgaagttaggggagaaaattgtggagtctttccagccacagggcagagggaggtggaggagctgggctgcttttcccagcagtattagtgtcccccaggacaggggaccttttccacattacatcactgccccatcccaccttacaacactctggcaatcccaggggcctgcctgatagaggcatttcctgtccctgtctcctcctgcatctcctttatcctgcactgccaccctctattccccattctgtgttggactttgaaggccccaagcccagccaaagcactgagttcccccttaagacacctccacaccctccccacaagcaaagcacaaattttggggtccatgtagcatgggccacgtaggaggctcctgacttgccaggggcccagcctcagcatacccaccgagcagctgccagcctgggctgagggtgggcatgaggcaggagtcagcacttggacctagggatgtgaggttttctgtgccccaagtttgtgggaaggtgggcactactgctgggcccacagacacagccagctggcaaaagggaggtctagcccagcagagagatgaggacattttgcttctccttcatgcccacagcatgagctgagcttctgctttgctggaaatgaaataaacttggtatgaattgtgccaaggcctccccagttgtcatcctgcctcttgttgccctccctgtccttgccccccaccccacacccatgcccctgtttccttacagattttgatattgttctaatgtgtaatagaaccagccgagtccccttttatcagaagggtctgaaaagcagcagcacagagtaggtgaacacaggcctgcaagtgcgaccacctcagacccagtacgtgtgcccacagtggacacactcacacctccaacacacccacgcgcaggcatgtgtacacgcatgtacacacgcatgcatgcacagccagatggccactcagcacagatgtggcagagggaatggtctgatcctgctgaaagccattaaggagaaacgaatttcccagtgcccgggctgcaagagagccttataggggccctgtttcctgggcatgcgcttcctctgccagccaacccccacttgcccaagtcactggtgcaataacttttctgccttcctcagagcagagaaattgggaattgtgttaggtgggtgtgggcagctctgctgagccaagcagacacggatgtcccctcttctgggaggagggtagtgctcccaggcctcaggagtccagacagagacccccaaagcctgactgccaacagaaaccctctcctagtgaggggcaggtgggtgtgccccaggtccccacacccacagggaggcttcacacactgcccagtaccggggatgccaggaggcaggcccctctgctgctgccactgctgccaacactgcccagcttgtgaggccaggaggagcccctgtcccactcggtgctgctgctcttctgacccctgctgtgaggaatgggattcttggtcgaaaaaattggttttccttttttgtataaatgaaaagaatccaggagaagctgccaccctcccctcccagcgtgatgcgctaccttgcttcggcgtcttgtcgccctttccgcctttggtccagggacagcccagcagatcctcctggttctgacctggggggtgtttgcatcacccccttttacttgtattaaaaaaaaatgatgggttgaaaatgtactgaggattaaaaatgtacttttttataaataaagtgtttaaaacaaa

SEQ ID NO: 77316 - DNA, 2375 bp, Homo sapiens
gctccctggtgctgctattgaaccccctgccagctccatttctgccctggcaaccctgggcccagcaggtgggtcgtcgttgtctggccctcactgccctggccccagcccaggctgcccagtagccacgtagcagaagtctgaagccatgccagccctggtgcggctctcccctctacacatttggggtactggatagggtgaagttaggggagaaaattgtggagtctttccagccacagggcagagggaggtggaggagctgggctgcttttcccagcagtattagtgtcccccaggacaggggaccttttccacattacatcactgccccatcccaccttacaacactctggcccctctgcttggtccccttttcccccaggcaggaggcaatcccaggggcctgcctgatagaggcatttcctgtccctgtctcctcctgcatctcctttatcctgcactgccaccctctattccccattctgtgttggactttgaaggccccaagcccagccaaagcactgagttcccccttaagacacctccacaccctccccacaagcaaagcacaaattttggggtccatgtagcatgggccacgtaggaggctcctgacttgccaggggcccagcctcagcatacccaccgagcagctgccagcctgggctgagggtgggcatgaggcaggagtcagcacttggacctagggatgtgaggttttctgtgccccaagtttgtgggaaggtgggcactactgctgggcccacagacacagccagctggcaaaagggaggtctagcccagcagagagatgaggacattttgcttctccttcatgcccacagcatgagctgagcttctgctttgctggaaatgaaataaacttggtatgaattgtgccaaggcctccccagttgtcatcctgcctcttgttgccctccctgtccttgccccccaccccacacccatgcccctgtttccttacagattttgatattgttctaatgtgtaatagaaccagccgagtccccttttatcagaagggtctgaaaagcagcagcacagagtaggtgaacacaggcctgcaagtgcgaccacctcagacccagtacgtgtgcccacagtggacacactcacacctccaacacacccacgcgcaggcatgtgtacacgcatgtacacacgcatgcatgcacagccagatggccactcagcacagatgtggcagagggaatggtctgatcctgctgaaagccattaaggagaaacgaatttcccagtgcccgggctgcaagagagccttataggggccctgtttcctgggcatgcgcttcctctgccagccaacccccacttgcccaagtcactggtgcaataacttttctgccttcctcagagcagagaaattgggaattgtgttaggtgggtgtgggcagctctgctgagccaagcagacacggatgtcccctcttctgggaggagggtagtgctcccaggcctcaggagtccagacagagacccccaaagcctgactgccaacagaaaccctctcctagtgaggggcaggtgggtgtgccccaggtccccacacccacagggaggcttcacacactgcccagtaccggggatgccaggaggcaggcccctctgctgctgccactgctgccaacactgcccagcttgtgaggccaggaggagcccctgtcccactcggtgctgctgctcttctgacccctgctgtgaggaatgggattcttggtcgaaaaaattggttttccttttttgtataaatgaaaagaatccaggagaagctgccaccctcccctcccagcgtgatgcgctaccttgcttcggcgtcttgtcgccctttccgcctttggtccagggacagcccagcagatcctcctggttctgacctggggggtgtttgcatcacccccttttacttgtattaaaaaaaaatgatgggttgaaaatgtactgaggattaaaaatgtacttttttataaataaagtgtttaaaacaaaaaaacgacaaaagcaaagaaaagaaaagaaaaagacaagataaaagaaaaagaagaacagaagaagggaaaagacaaaacaaacaaagagaggcacaagcagaccacagggacggggcacagacagcgaacgcacgcggaggggcggcagagcgacgaggcgcgcagcgatacgcagaaaagggggacgaaagcaagagggcgcgcgcaccacagccggcagagcagggccggcgcgagcagacacgcaccccgaggcgaagcccagcggcacccggaccggggagacacacacacccgcgcggggaacacaaggccgccagacccacgacggaggacaggcaa

SEQ ID NO: 77317 - DNA, 1967 bp, Homo sapiens
gctccctggtgctgctattgaaccccctgccagctccatttctgccctggcaaccctgggcccagcaggtgggtcgtcgttgtctggccctcactgccctggccccagcccaggctgcccagtagccacgtagcagaagtctgaagccatgccagccctggtgcggctctcccctctacacatttggggtactggatagggtgaagttaggggagaaaattgtggagtctttccagccacagggcagagggaggtggaggagctgggctgcttttcccagcagtattagtgtcccccaggacaggggaccttttccacattacatcactgccccatcccaccttacaacactctggcccctctgcttggtccccttttcccccaggcaggaggcaatcccaggggcctgcctgatagaggcatttcctgtccctgtctcctcctgcatctcctttatcctgcactgccaccctctattccccattctgtgttggactttgaaggccccaagcccagccaaagcactgagttcccccttaagacacctccacaccctccccacaagcaaagcacaaattttggggtccatgtagcatgggccacgtaggaggctcctgacttgccaggggcccagcctcagcatacccaccgagcagctgccagcctgggctgagggtgggcatgaggcaggagtcagcacttggacctagggatgtgaggttttctgtgccccaagtttgtgggaaggtgggcactactgctgggcccacagacacagccagctggcaaaagggaggtctagcccagcagagagatgaggacattttgcttctccttcatgcccacagcatgagctgagcttctgctttgctggaaatgaaataaacttggtatgaattgtgccaaggcctccccagttgtcatcctgcctcttgttgccctccctgtccttgccccccaccccacacccatgcccctgtttccttacagattttgatattgttctaatgtgtaatagaaccagccgagtccccttttatcagaagggtctgaaaagcagcagcacagagtaggtgaacacaggcctgcaagtgcgaccacctcagacccagtacgtgtgcccacagtggacacactcacacctccaacacacccacgcgcaggcatgtgtacacgcatgtacacacgcatgcatgcacagccagatggccactcagcacagatgtggcagagggaatggtctgatcctgctgaaagccattaaggagaaacgaatttcccagtgcccgggctgcaagagagccttataggggccctgtttcctgggcatgcgcttcctctgccagccaacccccacttgcccaagtcactggtgcaataacttttctgccttcctcagagcagagaaattgggaattgtgttaggtgggtgtgggcagctctgctgagccaagcagacacggatgtcccctcttctgggaggagggtagtgctcccaggcctcaggagtccagacagagacccccaaagcctgactgccaacagaaaccctctcctagtgaggggcaggtgggtgtgccccaggtccccacacccacagggaggcttcacacactgcccagtaccggggatgccaggaggcaggcccctctgtgctgctgctcttctgacccctgctgtgaggaatgggattcttggtcgaaaaaattggttttccttttttgtataaatgaaaagaatccaggagaagctgccaccctcccctcccagcgtgatgcgctaccttgcttcggcgtcttgtcgccctttccgcctttggtccagggacagcccagcagatcctcctggttctgacctggggggtgtttgcatcacccccttttacttgtattaaaaaaaaatgatgggttgaaaatgtactgaggattaaaaatgtacttttttataaataaagtgtttaaaacaaa

SEQ ID NO: 77318 - DNA, 1869 bp, Homo sapiens
gctccctggtgctgctattgaaccccctgccagctccatttctgccctggcaaccctgggcccagcaggtgggtcgtcgttgtctggccctcactgccctggccccagcccaggctgcccagtagccacgtagcagaagtctgaagccatgccagccctggtgcggctctcccctctacacatttggggtactggatagggtgaagttaggggagaaaattgtggagtctttccagccacagggcagagggaggtggaggagctgggctgcttttcccagcagtattagtgtcccccaggacaggggaccttttccacattacatcactgccccatcccaccttacaacactctggcccctctgcttggtccccttttcccccaggcaggaggcaatcccaggggcctgcctgatagaggcatttcctgtccctgtctcctcctgcatctcctttatcctgcactgccaccctctattccccattctgtgttggactttgaaggccccaagcccagccaaagcactgagttcccccttaagacacctccacaccctccccacaagcaaagcacaaattttggggtccatgtagcatgggccacgtaggaggctcctgacttgccaggggcccagcctcagcatacccaccgagcagctgccagcctgggctgagggtgggcatgaggcaggagtcagcacttggacctagggatgtgaggttttctgtgccccaagtttgtgggaaggtgggcactactgctgggcccacagacacagccagctggcaaaagggaggtctagcccagcagagagatgaggacattttgcttctccttcatgcccacagcatgagctgagcttctgctttgctggaaatgaaataaacttggtatgaattgtgccaaggcctccccagttgtcatcctgcctcttgttgccctccctgtccttgccccccaccccacacccatgcccctgtttccttacagattttgatattgttctaatgtgtaatagaaccagccgagtccccttttatcagaagggtctgaaaagcagcagcacagagtaggtgaacacaggcctgcaagtgcgaccacctcagacccagtacgtgtgcccacagtggacacactcacacctccaacacacccacgcgcaggcatgtgtacacgcatgtacacacgcatgcatgcacagccagatggccactcagcacagatgtggcagagggaatggtctgatcctgctgaaagccattaaggagaaacgaatttcccagtgcccgggctgcaagagagccttataggggccctgtttcctgggcatgcgcttcctctgccagccaacccccacttgcccaagtcactggtgcaataacttttctgccttcctcagagcagagaaattgggaattgtgttaggtgggtgtgggcagctctgctgagccaagcagacacggatgtcccctcttctgggaggagggtagtgctcccaggcctcaggagtccagacagagacccccaaagcctgactgccaacagaaaccctctcctagtgaggggcaggtgggtgtgccccaggtccccacacccacagggaggcttcacacactgcccagtaccggggatgccaggaggcaggcccctctctgccaccctcccctcccagcgtgatgcgctaccttgcttcggcgtcttgtcgccctttccgcctttggtccagggacagcccagcagatcctcctggttctgacctggggggtgtttgcatcacccccttttacttgtattaaaaaaaaatgatgggttgaaaatgtactgaggattaaaaatgtacttttttataaataaagtgtttaaaacaaa

SEQ ID NO: 77319 - DNA, 803 bp, Homo sapiens
  misc_feature (82)..(82): n is a, c, g, or t
  misc_feature (88)..(88): n is a, c, g, or t
  misc_feature (162)..(162): n is a, c, g, or t
gcagcaagcaccaagtggaacaggggctcctccctggcctcacaagctgggcaattgttggcaagcagtggcagcaagcagnggcgcnttcctccctggcatccccggtactgggcagtgtgtgaagcctccctgtggttttggggacctggggcacacccnacctgcccctcactaggagagggtttctgttggcagtgggtgtgggcagctctgctgagccaagcagacacggatgtcccctcttctgggaggagggtagtgctcccaggcctcaggagtccagacagagacccccaaagcctgactgccaacagaaaccctctcctagtgaggggcaggtgggtgtgccccaggtccccacacccacagggaggcttcacacactgcccagtaccggggatgccaggaggcaggcccctctgctgctgccactgctgccaacactgcccagcttgtgaggccaggaggagcccctgtcccactcggtgctgctgctcttctgacccctgctgtgaggaatgggattcttggtcgaaaaaattggttttccttttttgtataaatgaaaagaatccaggagaagctgccaccctcccctcccagcgtgatgcgctaccttgcttcggcgtcttgtcgccctttccgcctttggtccagggacagcccagcagatcctcctggttctgacctggggggtgtttgcatcacccccttttacttgtattaaaaaaaaatgatgggttgaaaatgtactgaggattaaaaatgtacttttttataaataaagtgtttaaaacaaa

SEQ ID NO: 77320 - DNA, 413 bp, Homo sapiens
  misc_feature (14)..(15): n is a, c, g, or t
  misc_feature (95)..(95): n is a, c, g, or t
  misc_feature (128)..(129): n is a, c, g, or t
cccccccccacccnnaaatctgatgtggatgtatttattctggtggaagtctcccaacctggggaggagtgtaaatagtttctgccccccttttngggacggccccccacctgcaaaatgtgtagtannttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtga

SEQ ID NO: 77321 - DNA, 585 bp, Homo sapiens
  misc_feature (565)..(566): n is a, c, g, or t
  misc_feature (581)..(581): n is a, c, g, or t
ttgtagcctagacagtgaaatgctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgaaaaaaaaaaannaaaaaaaaaattttngggg

SEQ ID NO: 77322 - DNA, 659 bp, Homo sapiens
ccgcccgcgatctagaactagtctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtga

SEQ ID NO: 77323 - DNA, 587 bp, Homo sapiens
cccacgcgtccggaaaaacatcatcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtga

SEQ ID NO: 77324 - DNA, 213 bp, Homo sapiens
atatcgtcgacccacgcgtccggtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtga

SEQ ID NO: 77325 - DNA, 253 bp, Homo sapiens
ccgatctagaggctcccccttctacgtctcatcacgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtga

SEQ ID NO: 77326 - DNA, 342 bp, Homo sapiens
ccatgttggcatcactccatgttggccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaaatgccccactggccgtgatgcccacctggcacgtgaagccccacactg

SEQ ID NO: 77327 - DNA, 706 bp, Homo sapiens
tgacctagaggatccccgaagcgcacgatgggcgtcccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcatcgtgcgcttcgaagcgcacgatggcgcgtccaattaggtgcatgagtaggtggcctgcagtaatgttagcggttaggcgtacggccagggctattggttgaatgagtcggctgatggtttcgataataactagtatggggataaggggtgtaggtgtcgcttgtggtaagaagtggctagggcatttttaatcttagagcgaagcctataatcatgcgccgtcataagggagcgcatg

SEQ ID NO: 77328 - DNA, 455 bp, Homo sapiens
tcctatagagctcgcttcagtggggagacagggctggagagagggtcagtgctatctatgtagggtgtaatctgtaagtcagcttttgaaatggggtgccctctactttgaatatctcgatactgtactaataaagtaacagaactctcctatgccagaaatatagaaatttttcatgctcttctaaaaatctagaagtggcaattttccatttaactaaagatttgatgtcttttaggacttggcagatgaacttgctcttgttgatgtcatcgaagacaaattgaagggagagatgatggatctccaacatggcagccttttccttagaacaccaaagattgtctctggcaaaggttgatttcaacaagtttatattataatccatgcttgacttaaattctttttccagatggtctccatttgttgcttagggtagagtgcagttgcacaat

SEQ ID NO: 77329 - DNA, 2062 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgagactactttggttaattcattatattaagatataaagtcataaagctgctagttattatattaatttggaaatattaggctattcttgggcaacctgcaacgattttttctaacagggatattattgactaatagcagaggatgtaatagtcaactgagttgtattggtaccacttccattgtaagtcccacgtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggc

SEQ ID NO: 77330 - DNA, 1726 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
  misc_feature (1706)..(1707): n is a, c, g, or t
  misc_feature (1722)..(1722): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgaaaaaaaaaaannaaaaaaaaaattttngggg

SEQ ID NO: 77331 - DNA, 1719 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgatgagacgtataagggtaccgagct

SEQ ID NO: 77332 - DNA, 1684 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
  misc_feature (1684)..(1684): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgaaatcacgtttgcgggggataatctagn

SEQ ID NO: 77333 - DNA, 2076 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccggtacggtagggccctgcgcgcacggcgccagagggatgggcgggtagagccaactgcctctggttctgctggcctccgctgctcgcgaagggattcctgctcccgggaggtgtaggagccgctttccagaagcacagcccagagacgtctgggcggcggcccacacaacgcatgtgttcggagctcgccgcgctctgcttttgctctaagcgggaaccatggcttctggccacgctggggaaccgaggaggagccggagtagctcagagtgatcttgtctgaggaaaggccagccccacttggggttaataaaccgcgatgggtgaaccctcaggaggctatacttacacccaaacgtcgatattccttttccacgctaagattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtga

SEQ ID NO: 77334 - DNA, 2284 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccggtacggtagggccctgcgcgcacggcgccagagggatgggcgggtagagccaactgcctctggttctgctggcctccgctgctcgcgaagggattcctgctcccgggaggtgtaggagccgctttccagaagcacagcccagagacgtctgggcggcggcccacacaacgcatgtgttcggagctcgccgcgctctgcttttgctctaagcgggaaccatggcttctggccacgctggggaaccgaggaggagccggagtagctcagagtgatcttgtctgaggaaaggccagccccacttggggttaataaaccgcgatgggtgaaccctcaggaggctatacttacacccaaacgtcgatattccttttccacgctaaggtatgggccttcactcttcacagaccctgtcattaggcctttcaactctcttttggcaaccattaggttttttcccctccctttttagtcatctctagtgatttatagtggcaaatacccccaaaggaagtaaaatagcttaaaaaaatctcttggttaataaacattaaagaagctgtagtgacactaaatgtttttcctcctatagattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtga

SEQ ID NO: 77335 - DNA, 1673 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctactggacttttatataccctacctacccagaggatcaaaattggccaag

SEQ ID NO: 77336 - DNA, 1571 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtga

SEQ ID NO: 77337 - DNA, 1610 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgttaggtgtcaagatatacttctaaatatttagctacagtgatgaacgtagaaaagggtccgc

SEQ ID NO: 77338 - DNA, 1521 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtga

SEQ ID NO: 77339 - DNA, 1499 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatagtaacgggggagtcctctaga

SEQ ID NO: 77340 - DNA, 1520 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacattatgccattcttgctggggatcctgtagaacgaccaacaagca

SEQ ID NO: 77341 - DNA, 1640 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggatgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtga

SEQ ID NO: 77342 - DNA, 1641 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaatggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtga

SEQ ID NO: 77343 - DNA, 1538 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttcgatcgatcagatagttgttacgcctatgacgcagcattcgcgatcgggaacgcaacgcattcgcccattgacaccggtggatgcattcgctgctcatgatggcacattcgattggcccctatcatggtaacacccgaagattctaccactatatcgccggagagtcacatccgtcgtttaacct

SEQ ID NO: 77344 - DNA, 1336 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaatccacaagggtttttcaaagcaagaacgtcaggttcgccagg

SEQ ID NO: 77345 - DNA, 1261 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
  misc_feature (1241)..(1242): n is a, c, g, or t
  misc_feature (1257)..(1257): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaaaaaaaaaannaaaaaaaaaattttngggg

SEQ ID NO: 77346 - DNA, 1561 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaattgatcccagctaccccactttctttcttttc

SEQ ID NO: 77347 - DNA, 1003 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
  misc_feature (981)..(981): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaaggtctttacggaataagnatgtgtgcgaggatgtagcgcg

SEQ ID NO: 77348 - DNA, 1173 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagaggtaataaatctttcaatttggcaacacagaatattaacatttactatttttatttaaaaggttaaaattgtaatagtatttgcatttgagaactttttgttagaaaacttgtgtggtttttttgttttgttttgtttgagacagaatcttgccctttcgcacaggctgcagtgcagtggcgcaatcttggctcactgcaacctctgcctcccgggttcaggcgattctcctgcctcagcctcctgggtacctgggactacaggcatatgccatgacgcccggctaattttttgtatttttagtagagatgggtttcaccatgttagccaaaaa

SEQ ID NO: 77349 - DNA, 611 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagcggatatcttgacctagctgccttcgcaggccgaatccgtctacccaatggcggcaacaggcg

SEQ ID NO: 77350 - DNA, 1428 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccggtacggtagggccctgcgcgcacggcgccagagggatgggcgggtagagccaactgcctctggttctgctggcctccgctgctcgcgaagggattcctgctcccgggaggtgtaggagccgctttccagaagcacagcccagagacgtctgggcggcggcccacacaacgcatgtgttcggagctcgccgcgctctgcttttgctctaagcgggaaccatggcttctggccacgctggggaaccgaggaggagccggagtagctcagagtgatcttgtctgaggaaaggccagccccacttggggttaataaaccgcgatgggtgaaccctcaggaggctatacttacacccaaacgtcgatattccttttccacgctaaggtatgggccttcactcttcacagaccctgtcattaggcctttcaactctcttttggcaaccattaggttttttcccctccctttttagtcatctctagtgatttatagtggcaaatacccccaaaggaagtaaaatagcttaaaaaaatctcttggttaataaacattaaagaagctgtagtgacactaaatgtttttcctcctatagattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtggatccgtgtgcctgttggagtggcattgatgtgctggtgccctcctgagactctcccccgatttggacggtaagataggaccggcgcggtcccaccgggttgactctttgcggccac

SEQ ID NO: 77351 - DNA, 659 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggtaagtgagagtctaccacactggaagcccataccttgaccccatcctctacccccactcctacccctagaactgtattattacatttcatgtaacagtatttagatttatgcactcattcggataactttctgtgaaacaaacttttgaaatatgataatacaccaaaagtgtatctgaaattaaaaagaatcaaaggttgtcaggctggagacccagttcctaaaattcattattctgtattaacatgcatggattgactaccaatgaaaaggaagggtccatgattttaaatgagccaaaattcttttaaagtgatttttgaattgaaaatgacaattcaaaaattgtcatttattggtaaaattatatgggaaatcataagttctcccactcaaatctc

SEQ ID NO: 77352 - DNA, 411 bp, Homo sapiens
cagtcctcccacctcagcctcccaaagtgttgggataacaggtgtgagttgtcatgcccagccaaaactactttttgaataattaatggacttgatatacatagtgtagaggcttaaaaatattaacaaaattattggttagccatgatcaatatcaagatcctgaaaagccatatatctggagtagcctattattatctaatgatcacctagtatctggttaagtgttttcttcatagtaggtatatcttttttgtgtgtagggagaggataatgggtgatttttattttctcctttttcatagtggatatcttgacctacgtggcttggaagataagtggttttcccaaaaaccgtgttattggaagtggttgcaatctggattcagcccgattccgttacctgatggg

SEQ ID NO: 77353 - DNA, 1695 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtga

SEQ ID NO: 77354 - DNA, 2303 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgaaaaaaaaaaaaaaaaaaaaaaaaaaaaaaaagaaaaaaaaaaaaaaaaaaaaaaaaaaaaaaaaaaaaaaaaaaaaaaaaaaaaaaaaaagggggggggggggggttaacattctcccccgaggagggggcgagcacactacgcaccgacgcccaccacccgtactttgctacagacagaagggggggcaccactatatcagcgaggggctgatttaatacaagacgcgcaggccgcgcgccgagccgtattacaacaccacacattcgtgcgcgggcggacacaactcgacggctacctcgaggatctcctcgcgcgcggcgaacgcaccccctctccctccggcggggggggggccacaacaacttagtggcgccagcacccccccccccccccaccagagccaccccagcgaccgcccacgtgcggcgcaatacacctcaccaccccacctcctgccgcgtgtacccgcgcgggggtagcaacaccaaccaccgcgacacaacgctgcggccggccggcgcgcacccactcactgctccgcgcccccgggcgcatccgctaccgcagccaacacactctccaccaacggcgagcactctacccac

SEQ ID NO: 77355 - DNA, 1734 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgagtcgacgcggccgcgaatttagtagtagtaggcggccgc

SEQ ID NO: 77356 - DNA, 1742 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgaaaatattatctactgtacctcttattacatcatggcccgcctttccg

SEQ ID NO: 77357 - DNA, 2251 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgaaaaaaaaaaaaaaaaaaaaaaaaaaaaaaaaaaaaaaagggggggggggggggttaacattctcccccgaggagggggcgagcacactacgcaccgacgcccaccacccgtactttgctacagacagaagggggggcaccactatatcagcgaggggctgatttaatacaagacgcgcaggccgcgcgccgagccgtattacaacaccacacattcgtgcgcgggcggacacaactcgacggctacctcgaggatctcctcgcgcgcggcgaacgcaccccctctccctccggcggggggggggccacaacaacttagtggcgccagcacccccccccccccccaccagagccaccccagcgaccgcccacgtgcggcgcaatacacctcaccaccccacctcctgccgcgtgtacccgcgcgggggtagcaacaccaaccaccgcgacacaacgctgcggccggccggcgcgcacccactcactgctccgcgcccccgggcgcatccgctaccgcagccaacacactctccaccaacggcgagcactctacccac

SEQ ID NO: 77358 - DNA, 1749 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgaaaaaacaaaaacaaaccacacacaaccaccacaaaacaaaaaaaaaaagagggg

SEQ ID NO: 77359 - DNA, 1719 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgatgacacgtgcagcgggtactctga

SEQ ID NO: 77360 - DNA, 1701 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaaatgccccactggccgtgatgcccacctggcacgtgaagccccacactg

SEQ ID NO: 77361 - DNA, 1892 bp, Homo sapiens
ctagtgggcctggatcaatcggccgagggacgaccgcccgacgtgcattcccggtacggtagggccctgcgcgcacggcgccagagggatgggcgggtagagccaactgcctctggttctgctggcctccgctgctcgcgaagggattcctgctcccgggaggtgtaggagccgctttccagaagcacagcccagagacgtctgggcggcggcccacacaacgcatgtgttcggagctcgccgcgctctgcttttgctctaagcgggaaccatggcttctggccacgctggggaaccgaggagattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtga

SEQ ID NO: 77362 - DNA, 1666 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctaccacacccactatcccaatgatgcccacatgggggatcctt

SEQ ID NO: 77363 - DNA, 1642 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccactgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtga

SEQ ID NO: 77364 - DNA, 1610 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgaattgccccgaccccattggcaacaacagccaccacagccagcaccaccaccaccactgtttccacgacagcagcaggtacaggtgaacaaaggcagagtaaactgtcaccccagatgcaggtacatcaaga

SEQ ID NO: 77365 - DNA, 1446 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcattgaagtccagatgccccgagtccagactagcggac

SEQ ID NO: 77366 - DNA, 1696 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaatggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtctcgcgctcctttttccaacgcattctattttgtgcccttttttactgaggaggcccttaccagttcccccctacagttctatttactatcttgttaccgatttttccaagtgttatactacctataaacctccatcaccctttaacttctcgccactctttcccttctcctatttattctttcttttattatttatatat

SEQ ID NO: 77367 - DNA, 1293 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagattgttggtgggggtaccgagc

SEQ ID NO: 77368 - DNA, 1166 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagcataattcttccaaaggatcttattttgtgaactatatcagtagtgtacattaccatataatgtaaaaagatctacatacaaacaatgcaaccaactatccaagtgttataccaactaaaacccccaataaaccttgaacagtga

SEQ ID NO: 77369 - DNA, 807 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
  misc_feature (729)..(729): n is a, c, g, or t
  misc_feature (731)..(731): n is a, c, g, or t
  misc_feature (743)..(745): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgnanggagtggatgannntgccggggctcccggagaaccggacccagaataggggctgatggacccgccacaggttccgc

SEQ ID NO: 77370 - DNA, 615 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
nnnttgaatccncnnctttgatggcctantgggtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggcagataagtggttttcccatgatgggggaaaggcttggagt

SEQ ID NO: 77371 - DNA, 1188 bp, Homo sapiens
  misc_feature (1)..(3): n is a, c, g, or t
  misc_feature (12)..(12): n is a, c, g, or t
  misc_feature (14)..(15): n is a, c, g, or t
  misc_feature (29)..(29): n is a, c, g, or t
  misc_feature (1110)..(1110): n is a, c, g, or t
  misc_feature (1112)..(1112): n is a, c, g, or t
  misc_feature (1124)..(1126): n is a, c, g, or t
nnnttgaatccncnnctttgatggcctantgggtgctgcagccgctgccgccgattccggatctcattgccacgcgcccccgacgaccgcccgacgtgcattcccggtacggtagggccctgcgcgcacggcgccagagggatgggcgggtagagccaactgcctctggttctgctggcctccgctgctcgcgaagggattcctgctcccgggaggtgtaggagccgctttccagaagcacagcccagagacgtctgggcggcggcccacacaacgcatgtgttcggagctcgccgcgctctgcttttgctctaagcgggaaccatggcttctggccacgctggggaaccgaggaggagccggagtagctcagagtgatcttgtctgaggaaaggccagccccacttggggttaataaaccgcgatgggtgaaccctcaggaggctatacttacacccaaacgtcgatattccttttccacgctaagattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgnanggagtggatgannntgccggggctcccggagaaccggacccagaataggggctgatggacccgccacaggttccgc

SEQ ID NO: 77372 - DNA, 482 bp, Homo sapiens
aaggccagctctgcgtctggcttgctgggtggccttccccaggcctcaggttcctcatctgccagctcaacctctcaactcccaatgagggcctaccatgtggtaggccctgcaccaggtgctggggaagtagtcaaggccaggcaaaattccctgccctcacagagctcgactcttagtggatgagctggatcataaacaaatgaataacggagatgttggccaaagcgtatagagtttcagctatggagaatgaacaagctctagagtaatgcacagcaaggagactgtagttcataagactgcactgtatacttgaaatttgctaagagagtagttctcaccatacacagaaaggtaactatgaaaagagacggatatgttcattagcttgactgtgataatcaggccattatctatgtgtgtatcaagacatcacactgtataccttaaacatagacattttccattaaaacatttaa

SEQ ID NO: 77373 - DNA, 519 bp, Homo sapiens
aagtcctattatctaaaaagaaatagcagtagtgttttagaccattttatgctgccataacagaataccacagattgggtagtttataattaacagatatttggctcacagttctggaggcagggaagtccaagagcatggtgctggcatctggcaaggacctttgtgctccatcatcccttggtggagggcaagacgggtgagagcaagaagggccaaaccgacttttataacaaacccactcttgtgataaccaaccaactactgagacaaatatgttaatccactcatgagggcagagccctcatgacctaatcacctcttagaggtcccactttttaacatggttgcatttgggattaaattttcaacacatgaagcttgttggatacattcaaaccatagcagatggtaactcgaattcacatgaatgaaaaacacctataaaggcaatatataggtaaatataagactacacatatattttttatcttgatttaaaatacaactgcaaggaac

SEQ ID NO: 77374 - DNA, 534 bp, Homo sapiens
aaagtgtgctccctcagtcattcattctgcccatgaccagtgacaccaccttggaaaatgcaggtcacaccagtcaccaccatcaaaaacgcatttcaggcttctgtacatttaattttcttcaacattaccttggaaaccacagtaaatcaataacagaatagttaaataccacaggttctttgtgttttgttttagaaaatattgctcaaggctaagagtgagttctattgatgatttttatttgctgctgggatgcaaaacaatcagaattttcgaagagtttgcttcctttttgtgcatttccttttttaaaaaaggaggggtctgtttcagatggaaaacattggtcgctaatagcagaaacttgagaataattggtaattttcaatcctatagaaaactagactaggtctgatgactttgacctttgttacgctcttcttccaaattttccccagccagctccctgcactcctgaccctcagcagcccattccactgagggtcgggtaactctggaacatcacagctg

SEQ ID NO: 77375 - DNA, 250 bp, Homo sapiens
ctgtgttcagtctcttgcctatagattaaatgtgtgaaatctctaaacagttcccctctttccatgcccaggagcaccacttcagttcagacctccatgacctgtcacattgactgttgcagagtctttcctgatcacttccacacagctgccactgtgatcgtgtttttatcttgttcgaaacccctgaatggctccccatcacatctgctgtccattgtttgcaggcagcatcagggccctgaagggt

SEQ ID NO: 77376 - DNA, 326 bp, Homo sapiens
tttatttttaaatttttctcttccatatctggaatcacagttttgtttttctctgctatttaatggatattttagaagctagtttttattttccaagtatttgtcttttctgtttacacttttgtaacagttattagttttcattcaagcaatacttttttaatcttgtgaaatttgttatcttcgtacaattatatttgatttcttctaagtgcattttgaatgtttaaaatggactgtaacctctattttaggagttactattttaatgaaatttcactaatgcaaactgtcaactaatttattcacttcatttaaatacatac

SEQ ID NO: 77377 - DNA, 409 bp, Homo sapiens
gagactctgtctcaaaaaagacaaaaaaaaaaaaaaagagccaattttggggtggggagaaggagttaaggacctttctcaccccttatgcaaataatcccgttgatgtggaaactacactgttacctgggaccctttagaatccatttccaacctctctcttcaggctcttgtcacccacccaacccctgtgcctgtccttctagccacagtaaacttctaagcccacagcagtcctattcctgtggcacgccaggactcaccaaatgcaggcctccatgacaactgtttcagcactgaccgagtgcttaagtttaatgttaaaagccagtggaccttatacaaaggctgggaatgtaacaaaagcccaccaagagttttgcctagggcttttctggggcctcaaagc

SEQ ID NO: 77378 - DNA, 542 bp, Homo sapiens
tcaaaggccagatgtccatttggctggttcaggggtgatgtgtgaagatgagacaaaacaaagagatgggtaaaggacgagggaaaaagaatgagggggatttaacccctgacctcaaagctaaacctctacaagagcagccactttcccatgctgtgagtggacgggcttcccttatccaaacatgcctgaaattcttctctttaggaacgtttatgtgggggtaagcattgtttgttctttgttcttctttcaagattttgtaaaaagcttcaggagagacagttcaaggggaaagagatggctgggagcgccaaagtgtacctcagtaaggaaggaaacagaaccccaagaggaccctctgggattagcaaagttgcagacaagggctgcacaagaaaggaacattagtcactggctgagtttacgcaggtcctacagaggtcttaatcacagagctctctttccagctggcatctcgttcccaagaggcgagttcagtactaagtccctcctagagcaacatgccgggggagggggtt

SEQ ID NO: 77379 - DNA, 326 bp, Homo sapiens
tagaggaggttggacccagtggggcacacctgagggtgaatgtatattcccggccgttgacctccatgctgtttggggacagaccattggtttctgcttctctctccaacaccccaagggctgccatgtgcctaacctgaccccagaccccactccttcaccctggctcacagcctgaaagctccctgccctccacctgctctccagggcctggccccctgaattgatcaaccccgcggagggtccacacccctcattctcttctccggtctgccccacggcccgggggcaggggattgattctgcgtgggcccctgtcaggcccc

SEQ ID NO: 77380 - DNA, 410 bp, Homo sapiens
gcttctaacattcctatccaagcgtctcagagtttaccacttatttttaacgtgggcttctgggttaaactgatgtttttaatgggctacaggccatgacatcttaaaactactggcttctcctcattagtagtagatgcaacttcagtggtcactttcatcattcagttaacattttaggtagttgatatgtgcattttaaaagtaatgcaaaccctgtcacaggcattgtgttctaagcacagagagcatccccagccattctgtgcctgggtgtgggttaggcttagaggagggctctgcaagcacacttctgtagtcagcaggcacctgggagatattcatctttcagaggcctgtatccagagcagattatagaaaacccatttcttcagatggtatcagttcca

SEQ ID NO: 77381 - DNA, 253 bp, Homo sapiens
ctccccaaagtctactatggtgctgtgcaacagaaatataatacaagccacaaatcgaattttcaatttcctagtagcttttttaaaaagtaaaaagaggggccaggcacagtggctcagcctgtaatcccagcactttgggaggctgaggtgggcaggatcacctgagctcgggaagttgaggctaatagtgggctgagattgtgccactgcactccagcctgggtgacagggaaggagaccctgtctcaaa

SEQ ID NO: 77382 - DNA, 264 bp, Homo sapiens
ggtggggttgctgtgtttgaggaagaaggaagtggccatctccacagcgccctccattgtttccttagtgacttcctgccacagccaccagctctgtcatttgaatgcctttgtcctcaaggggcagagagactcccttagagggcatgaggaaaggcaggcagaatccacccccacactggagagggtggggagccagtttcatttacatatttaaatatcttcctcacaagcaataaatctcaaatcattttaattgaacat

SEQ ID NO: 77383 - DNA, 427 bp, Homo sapiens
tcaggtgatccacccacctctgcctcccaaagtgctgggattacaggcatgagccaccgcacctggccagaagaaatctttatcttggtgtgcagtgtctggtgagggacaaatgtcatctctcttggatctgaatctggaaggatcaaggcactgaagggatttttttgtttcagacagtatccctctgtcgccaggctggagtgcagtggcgcaatctcagctcacggcaacctctgcctcccgggctcaagggatcctcctgcctcagcctctcgagtagctgggactacaggcacgcgtcaccaggcccagctaatttttgtatttttagtagagacagggttttaccacggtggccaggatggtctcaatctcttgacatcatgatccacctgccttggcctcccaaagggctgggattaca

SEQ ID NO: 77384 - DNA, 353 bp, Homo sapiens
acatacacagcaagattttcttagaactagcattttgctaaagaaattcagatatgtgtatggctgaaaaatgtgtaatttctgaacatgtatagaatttaccatattttcaaaagtacctctaagcaataagtggctatgatactttttagcacaaatctttgtgatagttttaaaaattctgagcattatttcatcagttcagttttttaagatagaagaaaaagggtttgtatattcatttattaaataaacatatattgagcacctactacattctgctatgcttggcactggaaatacagttaaagaacaaatcttagataataagtgcatttgtgattcttctactg

SEQ ID NO: 77385 - DNA, 819 bp, Homo sapiens
gtgtgggagacatgtgtgctcgtgccgcacatacacatcctggccgtgcacggctctctcatgaccagctctctgcctcccttccaggaggctccatcccacactgttcacccaggctgcggagactcaccttcccgagctaacttaactactgtacataataatatgtattaaactggtatcgtggtgatataatgtggtgcagttacttatatattaaatatctattgtatccatagaataggcagcattatttcaaacatattcaagttgggagtggagatcattgcctagaagtcaatattcaataaatcttgtacataactatttcgatggcaaatgttaagccttctaaaaggaaagtgtagattggaaaatgattttttttccaaatgatgtttttgccttctaatatactgtaaggtaatgagcttcagaacaggcaacctgaccctgcagaggtcgcgtgctgtgggatgacagcgggacgggagctcacaagtgctttcactgaagatttgttcatatactgtgtattgattgttgtgtaatatatcatcattgcttttgtaaatacgtaaaactgtaattttttaatggtgtgcttcccttatacttttttgatcagagaattttggaaagtaccaaagaagcaggggaatcattggccagtgttacgttttcacattgtctgtctcccaccctcactgatcacgcctgccccagagcagtgtgtggcggtgacaccgtcacccagcatgcgccacgccgtggctcccaccagcagtgccaccgccaccacaccccagatcccaccca

SEQ ID NO: 77386 - DNA, 479 bp, Homo sapiens
tcgagatattaaccttataccctttgccaaaattaactcaaatagattacagacataaaatgcaaaactataaacctcatagaagatagcacagcagaaaatatagatgaaatcttgggtttagtgctgacattttaaattaaaagggaaaattcattaaaaaaaggatggatacaatggacttcattaaaattaaaaacttcccctctgtaaaaaggactatcaaaatttcagcactttgggaagctgaggcaggagtattgcttgaggccaagagttgtagactagcctggacaaggtagtaaaacactgtttataaaaacaaaaatttaaaactgggcatggcggcacatgcctgtaatcccagctacttaggagactgaggcaagagctgagctcaggagactgacactgtagtaagcttatgctgcgtcactgcactcaggcctggtgacagagtgagactctgtctctcagag

SEQ ID NO: 77387 - DNA, 198 bp, Homo sapiens
ctgtgaaaattcttcaagctatacattcataatctatgtacctttgtccatgtaaattacatatcagtaaaaaaaaaaaaaaaaaaaaagtactttaaaaaactgaacaggttggttaaacagcagattagaccagccggttgtgaattctatgagagaacttgaaaacagtcataatgtagcacagacagagaaaat

SEQ ID NO: 77388 - DNA, 817 bp, Homo sapiens
agatacactaaggtcagctatgctggcagcagtgacaccatattgtcctatgttccaattcataatcctacttccaaagagacattcattctccctgctctctgcctgggcttggagcatgacccccattatagacttggaaatcagggggcagagaagtgaaatgccttccaaaacattcatagcaattaagtcataggatgatagaggaattgcaatgttccaggacttacaatgttgctgtgtggatgttactctttttttaaaaaacagcttttacgaattacatatgcacaatcaagtgcagaccatggctacctctggctagactgccactgctaggggaagaaaagacatccatacccattgcttatgattgctgctgctgctgttgtctccaaagaagaaaatggattctattttctacccttatctggttgaggatgcttaaaaaccaaaagatggagatattttaaagttgaagcagatcctttccttagtagcgttaaactggaatgcctaaaacataaactaacaccctgtttttttttctcctggatttcactggtgcctgagtaagcgaatatgctgtgctgttttcctggacactcagaatcaaacaggccttccaccccatcccatcatgttgaattacaaagtattttgagcatcgtttggtttgtttctttccacccatacctgtgtagggcagcggtagcagtcttcaacaatgcatcctcttggacaatgcattgtaatatctctctttcaaattctgtttcacatagtcatttctcatgttctgttggagaccccc

SEQ ID NO: 77389 - DNA, 417 bp, Homo sapiens
gtgaaatgtgagaagtctggtaacagagaatgtgcttgaggagcacagtagagtgaaggtctactttaaccaagaagttggcactacagtaggcaccgttggagctgggtcttgaagtatgagcaggaatttgtttactgtgctatcctagtttaaaatacatgcacgtggcttaaaaaataagggacaaaggaaattaccctaaatagttgctgtcccaccttactgccaactcctagtcccccttcctagaggaaccttttcaaattattttaaatttttctgcctattaaatgcttataaaatgctgttccttgatttttccacttcagaaatttgagagatgatcatttagtttatattcactatctcccatggtacctccccctgcctttgccattttttgatagttatatt

SEQ ID NO: 77390 - DNA, 220 bp, Homo sapiens
tgaactgcaggcatgtgttaccgattcaaaaataggaaaggcctaaaaaataaatgaaggtagaagttctgataggagagggtggtgcgggtctgcctggcagaatgtgcaggagagcacctgtggccttgcccgtgggaggagctcaggtccagggtgagcaccaccatgtggggtttgcagggcgtcccagacgcggggatggaatgctagcgtgcac

SEQ ID NO: 77391 - DNA, 2042 bp, Homo sapiens
  misc_feature (1212)..(1212): n is a, c, g, or t
  misc_feature (1231)..(1231): n is a, c, g, or t
  misc_feature (1831)..(1831): n is a, c, g, or t
agaatcgcttgaacccgggaggcggaggttgcagtgagctctcacctgcctgtgatgaccaacagcatttgggatacccagtgtggcactcattccagtgagttttagtgacacccccaccacacacagcttcccagtcacttccactaataactccagcctgggtgacagagcaagacaaaaaaaaaaaaaaaaagggaaaggaaaaaggaagaaagaaaattgcagaaggaggtttcgcagtgaatttcagtggcaccatacccacaggcagtttcctagggagttccaccagttccccagagcatggcttcccagcaaattctcttggcatcaccctccaggtagcttccagagagttccactagcacactagaggccatcttccttataacgcccagaaagtgttgcaggcacccacagggtaactgtctagtgatttccaccagcacccccagaaagcaggcccctgcttgccagccaccacatggacacccccacaggcttccccactatccagtgggccgtgaccaaatcctgtttaatgaggtctggatctcggccctggggagccaccccattcctggatttgctccctcctgggtcccctgccttagcccagcagtcacagatgctcttgcaatttgctgcttatgttctctttagagtcctcagtccctctagcagctaatcccatgttaccagttgacgactcttctaggaaacttcacctgttggtgtaaattagtacaagctctatggaaaacagtatggagatttctcaaagaactaaacataaacccccattcaatccagcaagcccactacttggcatctacccaaaggaaaataaatcattctatcaaaaagacacctgccttgaacgtttatcacagcactattcacaatagcaaagatgtgcaaatcaagctaagcatccatcaccagatgacgggacaaagaaaatgtggtacgtacactatgggatactattcagccataaaaaagaatgaaatggccgggcatggtagtgcatgcctataatccaagcactttgggaggccgaggcgatggatcacttgagatcagtagttctagaccagcctggccaacatggcgaaacctcgtctctactaaaattataaaagttagccgggggcggtggtgcatgcctgtaatcccagctactcaggtggctgaggcacaagaatngcttgaacccgggaggcanaggttgcagtgagccgagatcatgccattgcactccagcttaggcaacagagtaagactctctcaaaaaaaaaaaaaaaaaaaaaaaaaaaaaaagaatgaaatgatgtcttttgcagcaacatggatgggattgggggctattgtctttatcatttgacgtaaaaaggcaaatgcggcatgtcctaacttacaagaggggctaaataataggtacacatggacatagaatgtgaggctaggtgcagtggctcactcctataatcccagcactttggaaggccgaggtgggcagatcacttgaggccaggagttcgagaccagcctggccaacatggtgaaaccctgtctctactaaaaatacaaaaatgagcctggtgtagtggcgggtgcctgtaatcccagttactagggaggctgaggcacgaaaatctcctgaacccaggaggcagagattactgtgagctgagattgcaccactgcactccagcctaggcgacagagtgagactctgtctcaaaacaaacaaacaaaaacatggtcatagagtgtgaaataacagacactggagactcaggggtgggaggcaggaggtgggtangggatgataaattacttcatgggtacaatgtacattatttgggtgatgagtacactaaaaccccagacttcaccaacaacaccgtatatccatgcaagaaaactatacttggcggggtgtggtggctcacgcctgtaatcccagcactttgggaggccgaggcgggcggatcacgaggtcaggagatcgagaccattctggccatctctac

SEQ ID NO: 77392 - DNA, 525 bp, Homo sapiens
agaatcgcttgaacccgggaggcggaggttgcagtgagctctcacctgcctgtgatgaccaacagcatttgggatacccagtgtggcactcattccagtgagttttagtgacacccccaccacacacagcttcccagtcacttccactaatactccagctggcttcccagcaagtcttatcgaagtcccagaaaattccagaaggggccaggtgcagtggctcacatatgtaatcccagcactttgggaggctgaggtgggaggatcgctggagcccaggcgtttgagacctgcctgggcaacatggcaagaccctgtctctacaaaatgcatatatatatacatttttacattggccttttttcttttttattattattttaaaaatatatatatcagctgggtgtggtggctcacacctgtaattccagcactctggtaggctgaggctggcggatcacctgaggccaggagtttgaaaccagcctggccaacatggtgaaaccccatctgtactaaaaatac

SEQ ID NO: 77393 - DNA, 1582 bp, Homo sapiens
agaatcgcttgaacccgggaggcggaggttgcagtgagctctcacctgcctgtgatgaccaacagcatttgggatacccagtgtggcactcattccagtgagttttagtgacacccccaccacacacagcttcccagtcacttccactaataactccagcctgggtgacagagcaagacaaaaaaaaaaaaaaaaagggaaaggaaaaaggaagaaagaaaattgcagaaggaggtttcgcagtgaatttcagtggcaccatacccacaggcagtttcctagggagttccaccagttccccagagcatggcttcccagcaaattctcttggcatcaccctccaggtagcttccagagagttccactagcacactagaggccatcttccttataacgcccagaaagtgttgcaggcacccacagggtaactgtctagtgatttccaccagcacccccagaaagcaggcccctgcttgccagccaccacatggacacccccacaggcttccccactatccagtgggccgtgaccaaatcctgtttaatgaggtctggatctcggccctggggagccaccccattcctggatttgctccctcctgggtcccctgccttagcccagcagtcacagatgctcttgcaatttgctgcttatgttctctttagagtcctcagtccctctagcagctaatcccatgttaccagttgacgactcttctaggaaacttcacctgttggtgtaaattagtacaagctctatggaaaacagtatggagatttctcaaagaactaaacataaacccccattcaatccagcaagcccactacttggcatctacccaaaggaaaataaatcattctatcaaaaagacacctgccttgaacgtttatcacagcactattcacaatagcaaagatgtgcaaatcaagctaagcatccatcaccagttcttaattaccagattaagtgttcttatagaagatgatgtggatcttggatcttctgctctgtggaaacttctgtattgatcactctttcttccttgatcccattttagagagccctgcatcaaggccagtgtattgctaaagacagtcaatgttggctcagtcacctccctcacccctcagttgtcactccacctacccatgtctttccataggcatgaagatgggaattaaaaaaaaaatacgctgggcatggtggcttgagcctgtaatcccagctacttgggaggctaaggtgggaggatcatttgagcccaggagtttgagaccagactgagcaacatagtaagaccctgtctctacaaaataaaataaaaataattttcaaaaatcctttgcagtgttttaaaaagctagataacaggctgggcacggtgactcacaccagctacttgggaggctgaggtgggtggatcacctgagatcaagagttcgagaccagcctggccaacatagtgaaactccgtctctactaaaactacaaaaattagtcgggcatggtggcaggcggctgtaatgccagctactcaggaggcagaggcaggagaattgcttgaacccaggaggcagaggt

SEQ ID NO: 77394 - DNA, 283 bp, Homo sapiens
ttcgtatactttaaaatagcctttgtaataaactgtaataaagagggggtcttgggaaatccatctaaaagctattcagtcagatgttttaggggccttggacttgcgactggtgggaaagagagggctgttttgtaaaactgaaccctcaacctgcggtttctgaggttatctctaggtagatggcatcagaattgaattgaattggaggcctcccagctggtgtctgctgcagaattgatgtgcttcctccagtgtgggaagagccccccgcccctcccca

SEQ ID NO: 77395 - DNA, 735 bp, Homo sapiens
gccactgtgcccgcagcctgatagcaacttttaacatcaccctttgtggatttcacgttttccccttaacctgattataatttggcttctaaatccttcagtaaatctccttacaagaagaaaataaaaatgcaatggctaagctgaaacatcgatctcatctgtgttatattttgcctctaaaaagataaacgggcatcctgatttgtttttatgtcttatgacattgtttatgaatttgtttaaactaagtccattccagagaaaataattccacatacaagaaacttttaaaaagtaaacaaacaaacaaaaaaactagcaggctttgattcttccaccaaagagcgtattggaatctatgggtatgtgtagttcaaaaagtgtaacagatgattccgataatgcagccagtctactaatgttctgaaatatcacaacacatgccaatatgaggccttgggaaccgaaaatgaaatgttgctgtaacaacatagctgttaatagctatgacactgatagcagagtctggaaagatgaagagtgtcatgttatgaaatgacagaaatgaaaaggaaccaaatccagaaacttgagaagctggagtaaatgaaacctacttaatactttttctaaacccattcaggtagactagattattatctccatcattcacaatctctcacctaagagaatatgtttttctggcccactgacatcagatttgatttgtga

SEQ ID NO: 77396 - DNA, 541 bp, Homo sapiens
gaaagataatgatatgatgttgtaatggattgaatattaatgtactccaaaactcctgttaaaatcctcgccctgaggtgatggtactaggaggtgggcctgatggtactaggaggtggttctttgtaggtgattagctcatgaatgagatccttgtacaagaggcctcagacagctgccttgccccttccaccaagtgaggacacagagaaaaggcagctgtgcaagaaccagagagcagccctcaccacacactgaatccgccggcacctggatcttggactccccaccctccagaacttgtaagaaattgattcctgtttacaagccacccagtctttcgcattttgttatagcagcccaaactgaccaagacagttagaaagatgggactggtggtaaggccctgaaacagggtagacgctgggactgagatgaagagacacatttactgaattttttttttttttttttttgagatggagtctcgctctgtcacccaggctggagtgcagtggcgcgatctcggctcactgcaacc

SEQ ID NO: 77397 - DNA, 790 bp, Homo sapiens
tgaagagcgatttttgaagctagtggtcttctagtatacagtaaggtcaacttattttgaaacacaaaagcacaatagagaattagcttccatcaatatacgtactatactgaatacagctggcttgaggaaacttctttttaagaacattctatgagtgactgctaaatcctatttctgatctttctacatgttggcccaaaagttttcctttgtcatattctcctatagctataatttaaccatcactgattggagcagttctattgttccaagctgaaattcattgcctcagatggaggtaggtcttactgagacactatttcatacaaatttagaagacagttatgtactgatgatcaattaataaatctcatgtgctgttactgcttgaggcagccaaattggaatgctgtaaaaaaatacccatattttttaaaacactgaaacatgggcttagagacaattatctttttattcttcactaaattttcagcaacgttagttttaacaaggacttggtttgtgggaagaaagaggaaaaaagagaaaaatgtaaatggagggttaggatttgcttcagagaaaatttaggcttggctttgctacaaataatgtatcatttttccataaacgaattaaataactttaaatttatttaattggtccagatcacattaatcttgatttcctgggaaaaatacatacatattaatgctgaaatatagtataaaagtcttcttgaactgtcaaaattcagtgtctgatattaaggatataaattactcag

SEQ ID NO: 77398 - DNA, 399 bp, Homo sapiens
  misc_feature (337)..(337): n is a, c, g, or t
  misc_feature (362)..(362): n is a, c, g, or t
aaaattcaagtaataatgatctaatattcaataatacattatcgacataattagtcatttaaaaatgtaaataaaaagtacaatgaaatactacttcactctcatgaagatggctataatttcaaagacaaaccataacaaatgatggccaagatgtgaagagtaccctatgacttaggtgctatgatttcctccgttttccaaatgatgaaattgaggcatggagaatttaagtaactttacccaggccacatgatgagtaaggagaagagttagcattcaaatccatgtctctctgaccacaaagccacaccttttaatcatttccttatacggncagcttcaggggtgtcatttgaggnggccatcctattctattgaggcaagcaggtaacaagg

SEQ ID NO: 77399 - DNA, 961 bp, Homo sapiens
tttccattttgcattactgaaatttcaataaatagtgctttagttagatgtaaatctctgtcatttgtggcagaggaacttaaatgtcggcctgcattttagggcacctttttgtatagagcagagagaagggaagtgctgtcccccagtggcctgattcttggtgagcttgaaggttcagacctgaaagtcatttaagaaatgagcatccattttgatggctgctaatagcgacagttaaccatttccgttttacacacaaactgtgggagcttttccatcagaggcattgtttttctcggaaggggtgaaacggtaaggctgcacacagcctaatgcagtggtgttcaacttgagcatatgtgggagttacctggaggctttgctgaaacatggatctctggcctgtgttaaccccgcagtttccgatgctgtagctttggggcgcggcccaggctgtgcatttctagtgagtctccgcataatgccgatgctgctggccgggggaccaccctgtgaggaccctgccccaggtgagactcacctggggaggattgaaaaattacctgttgggcctcaccccagacccgttgaagtgaaacatgagatggctaggaggcagggacggacatttttcagagttgtccaggtgatttgaatgtgcagccaggatttacaatcagtgctttggagaaaacaagggaaagacaaaaaacacaggtcttctcaagaacaattggataggagggtgcctggtattgttcttcccgttctgatcaaatatccatgaggagagagagctgatgcagaatgcagctggtggtgcattctggctgtctaaactttgaatggtgtttggggtcggggagatgagagggaaaggtgaatgctcaattcgggagactttatttaattttgtagctgttttctttgtagggttcctagcaggatagaggctttg

SEQ ID NO: 77400 - DNA, 619 bp, Homo sapiens
catgaaagaactcacactagagagaaaccctatgaatgtaaggaatgtggaaaagcctttatttaccttgcaagctttcaaagacacatgataatgcacagtggagatggaccttataaatgcgaggagtgtggaaaagcattcagttgtcctagttcatttcaagtacctgaacgaattcacactagagaaaaaccatatgaatgtaaacaatgtggtaaagccttcagttggcttggttcctttcgagtacatgaaagaactcacactggagagaaaccctgtgaatgtaacgaatgtgggaaagccttcatttatcgaactacgttaaaaggacacatgaatattcacactggagagaaaccttataaatgtgaacaatgtgagaaagccttcctttctcttgcaagctttcaaatgcacatgataatgcatactggagatgcaccttataaatgtaacgaatgtgggaaagcattcaattgtcttaattcatttcaaatccatgaaaggactcacactggagagaaaccgtatgaatgtaaacaatgtggtaaagccttcagttgttccagttcctttagaatacatgaaagaagtcatagtggagagaaacccc

SEQ ID NO: 77401 - DNA, 260 bp, Homo sapiens
tgtatttttagtagagatggggtttcactgtgttagccaggatggtctcaatctcctgacctcatgatctgcccgcttcggcctcccaaaatgctgggcttccaggcatgagccaccgtgcccggtctcagggtttaaaaaaaaaaattggtgaaatacacacaatataaaatttatcattttgcttttttttttttttaatgaggacagggttttgccctgtttctcaggctggcctcgaactcctgagctgaagtgat

SEQ ID NO: 77402 - DNA, 186 bp, Homo sapiens
caaaaaaaaaaaaaaaaaaaaaagtccaggaccagaagaattcacagctgaactctaccagacattcaaagaagaattggtaccaatctcaatgaaacaattccaaaagacagagaaagaggaaatcctccctagatcattctgtgaagccagtatcaccctaataccaaaacaaggaaaacacat

SEQ ID NO: 77403 - DNA, 333 bp, Homo sapiens
cccagcccggagtgaagtggtgtgatctcagctcactgcaacctccacccaccatattcaagtgattctcctgcctcagcctcctgagtagctagtattatgcaaccatcaccattttccagaattgtttccttatcctaaacagaagacctgtacccattaaacaatgtgctttttttcttaattttaatgttttcttttatcttcttttttttttttttttctgagacagagtctccatctgttgcccaggctggagtgcaatggcacagtcttggctcactgaaacctctacctcctgggtacaaatgattcttgcgcctcagcctccaa

SEQ ID NO: 77404 - DNA, 821 bp, Homo sapiens
agttacactaagttttattttaaactaaaattcaataaacagtgcagccagggaagatctgctaaaccatgccgttatttggaaaatcattgcaatatattaacaactgcttccttctatgatgtttactagatggagaaaaatactccatacctatattgcaattttatttttatctagaaaaagaaaatattaggcttcagacccaactgtgcaaatttcatttgctttccatctcttactactacctctgtgtcataatttaacacgtaacatacaactcctgtctcttaaggcagctaccatatggtgtttatgtcagactggatatatttatctaattttgtgaaattattttttagttcccaacacaattcttgaaagtaataccactgttgttactctttctccttacaatttttatgttgttgagatgtatcagttatgtattataatcatgaaattgtattggcctcaaacccaaattttctttgtagtctaggatagatttttcatgaaagctatatagttataactgtgattgtacagattgtttatttgttttacagctaacattaagcatgattccaggtttttaattatgttccagcaacactagtgtttctttataacttaaaatcataaccactttgataatttacctttggatctgaccagtgattcatttttttcttgaatatactttgtgtttgctttctcatccccgttaagtctgaaacattattgacaccccacatcacttactctgtttaaagactttacgagtagtgagtcacatgtttaggatgatcactttggga

SEQ ID NO: 77405 - DNA, 227 bp, Homo sapiens
cagaaatatctgaaaaggatgaccaaagtcagcacaactccgatgaagagccagagtcaaacgtctctgtggatcaagagattgacgcagaggaggttaatagtgtccaaaccgccgtgaaaaatctggccacagccttcatgataattcatcatccagagtcaaccccgcaccagtccaaagaaacccaacccgaaataggcagttctcaggagagtgctgacgcc

SEQ ID NO: 77406 - DNA, 440 bp, Homo sapiens
gagactgcaggtgaggcctcagggctctgcattcccatccccaaaagtcaccagcgtgtggccttgtgggtgtcactcccctctgtggagtcaactttgtgcagtgacatgcagaggctggactgctgccacctcatgcccctcctggcatgatggtcgcatgaggctgagtgatttgcaggtctatggggaaacccgcctcagagatgtggaggagaagccaggcagagcgctgttcattccatttctttctttttttaatctaaaggagggaaagagctttattaactcaaacaaagggatgccatacaacttcccaacgatactgtgcagtgatggtattagcttccacctgttcttccattctgggggcagggtgtgaggactggctgctctgggagacgctctgagctgagagagaagaaatagctatgctaata

SEQ ID NO: 77407 - DNA, 1853 bp, Homo sapiens
  misc_feature (596)..(596): n is a, c, g, or t
agcactttcaggctcacagtttctcatcttttcaacagtcagggaaaagaaacctatggaatagttcgcatttcacagaggaagaaactgagggccagagctaggggtctctgacacagccatgggatcctgcaccccacactggctctatgtgactctgtagtagtggctaatgtccatcagtcgccccctgctcccctgcctggccatttgcccccaaatagggcagtggtgggagtatatcctggaggagggggaagtgggatataggtagtacttggctgacttcacaattttgctacacccagtctggacctcctgacagtggagtgggatccctgtggcttcctttttcttgtttttgttttgttttgttttttttagatggagtctccctctatcatccaggctggagtgcaatggtgcgatttcagctcactgcaacttccacctcccaggttcaaacaattctcctgtctcagccacctgagtagcttggactacaggcacccgccaccaccccagctactaagttttgtatttttagtagagatggggtttcaccacatggccaggatggtcttgatctcttgacnttgtgatctgcccaccttggcctcgcaaagcactgggattacaggcgtgggccactacgcctggccaatttttttttgttttgtttttttgagatggagtcttgctccatctcccaggctggagagcaatggcgtgatctcagctcactgcaacctctgcctcctgggttcaagcgattctcctgcctcagcctcccaagtagctgggattacaggcacccaccatcatgcccgggttaatttttgtattttcttagagatggagtttcactatgttggccagcctcatctttgaactcctgacctccgatgatccacctgccttggcctcccaaagtgatgggattacaggcgtgagccaccgcacctggccccagtggcttcttcagacttgaaacacaaaatgtggccagctagggatagagagaattctgactttcaacactgctgagccatggcatgggctgcttctgggtagtgagctccctgtccttggggtagacacagccatcccttgggtccttcctccagaccttccaggtacagccctttgctgctcttccctgcctccaaacctttgccagtttttgagtttctttacccaggatgttccatcagatctctctgcttccgggaagtcctattccactgaccacctactgtgtgcacaggcttgtgctgagtggtgctgtggaggggcagaagggagctggaacctggtgatggagagaagtcatagcatgatgaataactcatgtccactgggcacgtgctaggcactgggcattgttctaagtgtatgtcttatctcatttactcctcacagcacgtatgagataagcaatcttacttatgtctaagtagcttccagatgaggaaactgaggctctgggaagtgaagtaacttgcctaaggaaacacaggatgggctatggaaccaggattcaaccacaaacacagtgacttagcatcatctactgcaaacatccactgcagttaaaatgcctggagtgggtggcctggtcactggaggtgagggtcggggctgggtcgtctgagagccaggcgggtcttcggggtgaggggagtgttggggtgaggaaacatgtgaacatgcctcagtctttggagaacttagttactgttaacctgaatgtcaccacccctgactcggagactggcaccaaatggattatgggttcaataaatgtttgttgaatgaataaacgagccccatttgcagaagggtatccacta

SEQ ID NO: 77408 - DNA, 433 bp, Homo sapiens
atctttaagaacttcaaatcagtaaattcaaatggccacaaataatctaccactttaaggtactatataaacttttttcctcttgcctttccttcttttcattgatggtgggttatttctctaaggtacaccaaaagataagcacgtattgagatataaaggggatatgaatacacagtattagtcacttatattcaaaatgaaaaataatgtttctcacaaaatacttatttgttcagaattcagtcagctcttcttattctaaatcaaaagaccactattcatcatgggtagatgtgaagcatggcccactttgatttcaggtatggaaaactgcaggactggctaaatccagcacatggttccctctctaggaagtggtatacagagagtaagaacacagatgtaaatgcattcataatgctcagatatc

SEQ ID NO: 77409 - DNA, 1187 bp, Homo sapiens
caagtctcccacgacgttcccacccactcctgagagcagagctggccgcagccatgaccccgcagcttctcctggcccttgtcctctgggccagctgcccgccctgcagtggaaggaaagggcccccagcagctctgacactgccccgggtgcaatgccgagcctctcggtacccgatcgccgtggattgctcctggaccctgccgcctgctccaaactccaccagccccgtgtccttcattgccacgtacaggctcggcatggctgcccggggccacagctggccctgcctgcagcagacgccaacgtccaccagctgcaccatcacggatgtccagctgttctccatggctccctacgtgctcaatgtcaccgccgtccacccctggggctccagcagcagcttcgtgcctttcataacagagcacatcatcaagcccgaccctccagaaggcgtgcgcctaagccccctcgctgagcgccagctacaggtgcagtgggagcctcccgggtcctggcccttcccagagatcttctcactgaagtactggatccgttacaagcgtcagggagctgcgcgcttccaccgggtggggcccattgaagccacgtccttcatcctcagggctgtgcggccccgagccaggtactacgtccaagtggcggctcaggacctcacagactacggggaactgagtgactggagtctccccgccactgccacaatgagcctgggcaagtagcaagggcttcccgctgcctccagacagcacctgggtcctcgccaccctaagccccgggacacctgttggagggcggatggggatctgccctagccctgggctggagtccttgctttgctgctgctgagctgccgggcaacctcagatgaccgacttttcccctttgagcctcagtttctctagctgagaaatggagatgtactactctctcctttacctttacctttaccacagtgcagggctgactgaactgtcactgtgagatattttttattgtttaattagaaaagaattgttgttgggctgggcgcagtggatcgcacctgtaatcccagtcactgggaagccgacgtgggagggtagcttgaggccaggagctcgaaaccagtccgggccacacagcaagaccccatctctaaaaaattaatataaatataaaataaa

SEQ ID NO: 77410 - DNA, 1524 bp, Homo sapiens
caagtctcccacgacgttcccacccactcctgagagcagagctggccgcagccatgaccccgcagcttctcctggcccttgtcctctgggccagctgcccgccctgcagtggaaggaaagggcccccagcagctctgacactgccccgggtgcaatgccgagcctctcggtacccgatcgccgtggattgctcctggaccctgccgcctgctccaaactccaccagccccgtgtccttcattgccacgtacaggctcggcatggctgcccggggccacagctggccctgcctgcagcagacgccaacgtccaccagctgcaccatcacggatgtccagctgttctccatggctccctacgtgctcaatgtcaccgccgtccacccctggggctccagcagcagcttcgtgcctttcataacagagcacatcatcaagcccgaccctccagaaggcgtgcgcctaagccccctcgctgagcgccagctacaggtgcagtgggagcctcccgggtcctggcccttcccagagatcttctcactgaagtactggatccgttacaagcgtcagggagctgcgcgcttccaccgggtggggcccattgaagccacgtccttcatcctcagggctgtgcggccccgagccaggtactacgtccaagtggcggctcaggacctcacagactacggggaactgagtgactggagtctccccgccactgccacaatgagcctgggcaagtagcaagggcttcccgctgcctccagacagcacctgggtcctcgccaccctaagccccgggacacctgttggagggcggatggggatctgccctagccctgggctggagtccttgctttgctgctgctgagctgccgggcaacctcagatgaccgacttttcccctttgagcctcagtttctctagctgagaaatggagatgtactactctctcctttacctttacctttaccacagtgcagggctgactgaactgtcactgtgagatattttttattgtttaattagaaaagaattgttgttgggctgggcgcagtggatcgcacctgtaatcccagtcactgggaagccgacgtgggagggtagcttgaggccaggagctcgaaaccagtccgggccacacagcaagaccccatctctaaaaaattaatataaatataaaataaaaaaaaaaaaaaaaaaaaaaaaaaaatcttttgtggggcacggcctcgaggaccctggagagaaaagttctcttgaagaccccctgccgttggtggcggagccgggggcccccagagatgggggcttaaggtgtgacaccaggggggccctataagcgtggggtcccccagaggagagcaaccggggggacgagcgaccacaggtgggccgggggaattctctccaacccgagattgtaaaaacaggcccgcggagaggaacaaccgagaggcgggtctttggaaacaaaaccaccgagacgtggagttcgcagggggacaaacaggggggctcatcg

SEQ ID NO: 77411 - DNA, 1574 bp, Homo sapiens
caagtctcccacgacgttcccacccactcctgagagcagagctggccgcagccatgaccccgcagcttctcctggcccttgtcctctgggccagctgcccgccctgcagtggaaggaaagggcccccagcagctctgacactgccccgggtgcaatgccgagcctctcggtacccgatcgccgtggattgctcctggaccctgccgcctgctccaaactccaccagccccgtgtccttcattgccacgtacaggctcggcatggctgcccggggccacagctggccctgcctgcagcagacgccaacgtccaccagctgcaccatcacggatgtccagctgttctccatggctccctacgtgctcaatgtcaccgccgtccacccctggggctccagcagcagcttcgtgcctttcataacagagcacatcatcaagcccgaccctccagaaggcgtgcgcctaagccccctcgctgagcgccagctacaggtgcagtgggagcctcccgggtcctggcccttcccagagatcttctcactgaagtactggatccgttacaagcgtcagggagctgcgcgcttccaccgggtggggcccattgaagccacgtccttcatcctcagggctgtgcggccccgagccaggtactacgtccaagtggcggctcaggacctcacagactacggggaactgagtgactggagtctccccgccactgccacaatgagcctgggcaagtagcaagggcttcccgctgcctccagacagcacctgggtcctcgccaccctaagccccgggacacctgttggagggcggatggggatctgccctagccctgggctggagtccttgctttgctgctgctgagctgccgggcaacctcagatgaccgacttttcccctttgagcctcagtttctctagctgagaaatggagatgtactactctctcctttacctttacctttaccacagtgcagggctgactgaactgtcactgtgagatattttttattgtttaattagaaaagaattgttgttgggctgggcgcagtggatcgcacctgtaatcccagtcactgggaagccgacgtgggagggtagcttgaggccaggagctcgaaaccagtccgggccacacagcaagaccccatctctaaaaaattaatataaatataaaataaattagccaggtgtgatgttgcgcgcccacagtcccaactacttgggaggctgaggtgggaggatcacttgagtccaggaggttaaggctgcagtgagctgtcgtcacaccactgccttcatgcctgggcaacagagcaagaccctggtttttttgtttgtttgtttgtttgttttaatcatagttgaggccgggtgcggtggctcgcgcctgtaatcccgacgccgaggcgggcagatcacgaggtcaggagttcgagaccagcctgaccaacatggtgaaacccggtctctactaaaaatacagaaattagctgggcatggtggcctgagcccgtaaccccagctactcaggaggctaaggcaggagaatcgcttgaacctgggagg

SEQ ID NO: 77412 - DNA, 1341 bp, Homo sapiens
caagtctcccacgacgttcccacccactcctgagagcagagctggccgcagccatgaccccgcagcttctcctggcccttgtcctctgggccagctgcccgccctgcagtggaaggaaagggcccccagcagctctgacactgccccgggtgcaatgccgagcctctcggtacccgatcgccgtggattgctcctggaccctgccgcctgctccaaactccaccagccccgtgtccttcattgccacgtacaggctcggcatggctgcccggggccacagctggccctgcctgcagcagacgccaacgtccaccagctgcaccatcacggatgtccagctgttctccatggctccctacgtgctcaatgtcaccgccgtccacccctggggctccagcagcagcttcgtgcctttcataacagagcacatcatcaagcccgaccctccagaaggcgtgcgcctaagccccctcgctgagcgccagctacaggtgcagtgggagcctcccgggtcctggcccttcccagagatcttctcactgaagtactggatccgttacaagcgtcagggagctgcgcgcttccaccgggtggggcccattgaagccacgtccttcatcctcagggctgtgcggccccgagccaggtactacgtccaagtggcggctcaggacctcacagactacggggaactgagtgactggagtctccccgccactgccacaatgagcctgggcaagtagcaagggcttcccgctgcctccagacagcacctgggtcctcgccaccctaagccccgggacacctgttggagggcggatggggatctgccctagccctgggctggagtccttgctttgctgctgctgagctgccgggcaacctcagatgaccgacttttcccctttgagcctcagtttctctagctgagaaatggagatgtactactctctcctttacctttacctttaccacagtgcagggctgactgaactgtcactgtgagatattttttattgtttaattagaaaagaattgttgttgggctgggcgcagtggatcgcacctgtaatcccagtcactggtagccgcgtagtcacgatctgactacgcggctggactggagaggatacactgtgtattcttggctttgagttccttgactgctttctgctgcgtgggagttttccaggcatgtttggagagcggacagggttcagccagctagacctacctggctgctctggagaaatttggttcacttgatccaagttcagatgcacaatttatggtgtccaacttgtccacacactcaggagctcctctaagctcaaagggtgg

SEQ ID NO: 77413 - DNA, 931 bp, Homo sapiens
ggcggtgcagcttgcatgctgtggtcgttctagaggttcccctcacgccctgtccaccagctgcaccatcacggatgtccagctgttctccatggctccctacgtgctcaatgtcaccgccgtccacccctggggctccagcagcagcttcgtgcctttcataacagagcacatcatcaagcccgaccctccagaaggcgtgcgcctaagccccctcgctgagcgccagctacaggtgcagtgggagcctcccgggtcctggcccttcccagagatcttctcactgaagtactggatccgttacaagcgtcagggagctgcgcgcttccaccgggtggggcccattgaagccacgtccttcatcctcagggctgtgcggccccgagccaggtactacgtccaagtggcggctcaggacctcacagactacggggaactgagtgactggagtctccccgccactgccacaatgagcctgggcaagtagcaagggcttcccgctgcctccagacagcacctgggtcctcgccaccctaagccccgggacacctgttggagggcggatggggatctgccctagccctgggctggagtccttgctttgctgctgctgagctgccgggcaacctcagatgaccgacttttcccctttgagcctcagtttctctagctgagaaatggagatgtactactctctcctttacctttacctttaccacagtgcagggctgactgaactgtcactgtgagatattttttattgtttaattagaaaagaattgttgttgggctgggcgcagtggatcgcacctgtaatcccagtcactgggaagccgacgtgggagggtagcttgaggccaggagctcgaaaccagtccgggccacacagcaagaccccatctctaaaaaattaatataaatataaaataaa

SEQ ID NO: 77414 - DNA, 1028 bp, Homo sapiens
  misc_feature (584)..(584): n is a, c, g, or t
ggaagatgtgatttcatggggaacctgggagaccatcagaccctgtctcctccctgctgtgtgactgtggggaggttccttcacctctctgggcgtgcttcctcttgtgcagctggatagagctcatgaaggcagagccctacacagtgcctctggcacacagcaagcagtgcataaatgcatacttgttagccctggaaaaaaaaaaaaaaaaaaaaaaaaaaaaaaaaaaaaaaaaaaaaagggggggcgcacggcaaaaaagatacccccggaggggcccaacatgaaccgcctgaccccgttctttggtgcaaaagggcggcccccaataaggaggggccgtataatataaagcaacaaaggagcacgggggaccgagcgttaaaacacacgggtgcgggctggggaaacacgcggcaagggggagacactttcgtggagaggaaaccccacatcctctggtgcggcggggacacaatttcggggacgcacacactcactcaacagaggagatattattaagcgggcgccaggcgaggaataattataacctgaagggggggctacgtgggtggcgtganacccccaagcggggcgaggaaaatattgcgtgctggcgcgcgggcagtgcgacaagataatatttagggcgcacacacgagcggaggagatggtagatgtttcttggtgggcgaacactatcttctttttcccggccgggcgtgccgttcccttggtcttctacataacatacaccaggggtactgtagatagatcgagcgaacaaacggacgaggacacgaaacgatgcagatagaaagtcgactcataacgagaaggcaaaggaaagcaacagaatggcagagtggataaaagacagcaggaacagataggactacatcagcagtagaggaggtaaaggagacgacatgccagtacagcaagagagtagggtacgacgaatacaaaacacaagagtagcgactacaggtaggactaacgtacgtgagaccagcaggaactat

SEQ ID NO: 77415 - DNA, 2037 bp, Homo sapiens
  misc_feature (9)..(9): n is a, c, g, or t
aagcgggcngggcgaaggcggagcgctaacgtctaacgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgaggccaaccaatcaatggctcagacagataagccaacatgcatcccgccggagctgccgaagatgctgaaggagtttgccaaagccgccattagggtgcagccgcaggacctcatccagtgggcagccgagtacgtgctcctttctcgccttcaccccttggaggacggccggagacagagggtcctgtaaaaccgcggaggttgtcatggctgcagctaggaagtccggactaactggcatcgtctttgttttagctcttgcattgctttgatgctttaaaatccacacataaatgctacatctagctgggcaaggatgggatgcctcccctaagggagccagattgagcagtaggacgccaggtcaataggccgtgtcctggggcaagcagcaagttagatgaccgcgtcacaccagcgtatgcacacccacctcctccctgcacgccttttcccactcccggtggaaagaagggctgggaatctccgaagcttaatctgcctttcttcgttctcctgtctcaccactagatggcagcagtgcagccgggggagggaagcgacagccctgggtggatggggtgggaccagtcctgctagttcactcctttaaggagacacttcctcccctgctgttaaaactcatacttggacccaaccaaagaccctttatatcttgtcttggaggaaattattgttattttctttagtgtttctctgaactgattttgttctgccaacataaagatgtccgcacagtacacactgcattctggggaaaggccaagcagagtgatggggtcctcaggcatggctgaaaacagtgtgcctcaaacacgggtgccttctttcaggagagacctccagaggctgctcagtagatggagcttacacaacaatcgctgcgggcctggattgaagtagctttgcacagaaagcctctcagctatgaaattgctccttggacaaacttgcctgcttgaaactggggaaccaggacttgagacaggagttggaagataactagacctcacggaccattttcaggctatttttactgtttgatgattccctgcttaggagggtttcagtgggaaagtgagagtgagagaggccgttgagagaaagccagtgagttggggaagggaagatgtcctcaggctgaggttgtgagtgggtgtcctgggcagatggtggggagagtgtggacacctttgagaagacacaaaatggcatctaagaggggcctttcggagtctctgggccagtgctgtgctcctggactggattaggatgtagcttttacaattggaaggaaaataagccagtggtgctcataaaaagaaacataaatgggggttgctttgcctagtaatgagccctgtttagttctccattttaaattttatatattgcctctaagattgaactttagcttcagaagactaatttattttggcatagtcagatagacagactttatcttatacgttagtttcaaacccatttgattgttcttgtgctgccgttttatagtaagcaaactgacattgcttagtattgtccctgacatttatggaagaggcattccactattgtagactgcttgctctcgtattgtatcacgtgctataatttttttagacatccatgaaaacttagtttgtagtttaaccacaatgaaaaaggagggcatgacctaagagccccctccattctatccagacatgaaaagcactgctcagatggttgtatgtgacttacttaaaacctgtagcattttagagaataaaactctgcaaagtgtttccaagac

SEQ ID NO: 77416 - DNA, 2082 bp, Homo sapiens
  misc_feature (9)..(9): n is a, c, g, or t
aagcgggcngggcgaaggcggagcgctaacgtctaacgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgagcaaattatctcaaaagctgcaagttcctgcatctacatgtgcccagccaaccaatcaatggctcagacagataagccaacatgcatcccgccggagctgccgaagatgctgaaggagtttgccaaagccgccattagggtgcagccgcaggacctcatccagtgggcagccgagtacgtgctcctttctcgccttcaccccttggaggacggccggagacagagggtcctgtaaaaccgcggaggttgtcatggctgcagctaggaagtccggactaactggcatcgtctttgttttagctcttgcattgctttgatgctttaaaatccacacataaatgctacatctagctgggcaaggatgggatgcctcccctaagggagccagattgagcagtaggacgccaggtcaataggccgtgtcctggggcaagcagcaagttagatgaccgcgtcacaccagcgtatgcacacccacctcctccctgcacgccttttcccactcccggtggaaagaagggctgggaatctccgaagcttaatctgcctttcttcgttctcctgtctcaccactagatggcagcagtgcagccgggggagggaagcgacagccctgggtggatggggtgggaccagtcctgctagttcactcctttaaggagacacttcctcccctgctgttaaaactcatacttggacccaaccaaagaccctttatatcttgtcttggaggaaattattgttattttctttagtgtttctctgaactgattttgttctgccaacataaagatgtccgcacagtacacactgcattctggggaaaggccaagcagagtgatggggtcctcaggcatggctgaaaacagtgtgcctcaaacacgggtgccttctttcaggagagacctccagaggctgctcagtagatggagcttacacaacaatcgctgcgggcctggattgaagtagctttgcacagaaagcctctcagctatgaaattgctccttggacaaacttgcctgcttgaaactggggaaccaggacttgagacaggagttggaagataactagacctcacggaccattttcaggctatttttactgtttgatgattccctgcttaggagggtttcagtgggaaagtgagagtgagagaggccgttgagagaaagccagtgagttggggaagggaagatgtcctcaggctgaggttgtgagtgggtgtcctgggcagatggtggggagagtgtggacacctttgagaagacacaaaatggcatctaagaggggcctttcggagtctctgggccagtgctgtgctcctggactggattaggatgtagcttttacaattggaaggaaaataagccagtggtgctcataaaaagaaacataaatgggggttgctttgcctagtaatgagccctgtttagttctccattttaaattttatatattgcctctaagattgaactttagcttcagaagactaatttattttggcatagtcagatagacagactttatcttatacgttagtttcaaacccatttgattgttcttgtgctgccgttttatagtaagcaaactgacattgcttagtattgtccctgacatttatggaagaggcattccactattgtagactgcttgctctcgtattgtatcacgtgctataatttttttagacatccatgaaaacttagtttgtagtttaaccacaatgaaaaaggagggcatgacctaagagccccctccattctatccagacatgaaaagcactgctcagatggttgtatgtgacttacttaaaacctgtagcattttagagaataaaactctgcaaagtgtttccaagac

SEQ ID NO: 77417 - DNA, 466 bp, Homo sapiens
cattgcaaaattcattgcagaagaattcatcacctaggcacatagtcatcagattatctgaagtcaagatgaaggaaaaatcttaagagctatgaggcaaaaatatcaggtaacctataaaggaaaacctatcagattaacagaagatttctcaacagaaaccctacaagccagaagagattgattagggtcctatctttagtctccttaaacaaaacaattatcagccaagaattttgtgtccagtgaaactaagcctcataaatgaaggaatgatacagtcttttacaggcaaacaaatgctgagagaattcgccactaccaagccagcactataagaactgctaaaaggagctctaagtcttgaaaaaaatcttcgaaatacaccaaaatagaacctccttaagacacaaatccaacagaacctctataacaataacaatgaaaaaaacagcatggtattcag

SEQ ID NO: 77418 - DNA, 549 bp, Homo sapiens
tgaccggcgccggagttttgagtccacagataaaatgtgtctcctttgtctctaccagaaaatgaaaggaattgaaattaagggagagattgaagtgtttcatgcgcgtccgtgtgaagagaccaccaaacaggctttgtgtgagcaacatggctgtttatttcacctgggtgcaggcgggctgagtccgaaaagagagtcagcaaagggtgtgggttatcattagttcttatgggtttgggatagccggtaaatataagagcaatgttttttggcaagaagtggatctcacaaagtacattctcaagagtggggagaattacaaagaaccttcttaagggtgggggagattacaaagtacattgatcagttcgggtggggcagaaacaaatcacaatggtggaatgtcatcagctaaggctatttttacttcttttgtggatcttcatttacttcaggccatctggatgtatacgtgcaagtcataggggatgcgatggcttggcttgggctcagaggcctgacattcctgccttcttatgttaataa

SEQ ID NO: 77419 - DNA, 600 bp, Homo sapiens
caaaaaaccccgcacagtaagtggaataacaaatacaacagcagcaaaacaatagagtgaaattttgctggataccccacccctgagcctgaggtgtgctctcttgtgaaagagctgttcgggctggacgtggtgattcttgcctgtaatcccagcacttagggaggctgaggcaggattgctttagcccagttgttcaagcccatttgggcaacacaatgaaaccccgtctgtacaaaaaattaaaaaaaatacaaagaattaactggatgtggtggcgggcacctgtagtcccagctactcgggaggctgagccaggagtatggcgtgaacccgggaggcagagcttgcagtgagccaagattgcaccactgcactccagcctgggcgacagagcaagactccatctcaaaagaaaaagaaaaagaaatacagaaggggaattgcagcggagttgtgttctgaccacgtgattcacgtgccttatgcttgtgttagctgccacgctgtgggaaatgcctcacggaaggcacgttgccttttcccttggggcccaccgccatgccctctgcagtctcgcctcttaggatcgggggatcc

SEQ ID NO: 77420 - DNA, 948 bp, Homo sapiens
caaaaaaccccgcacagtaagtggaataacaaatacaacagcagcaaaacaatagagtgaaattttgctggataccccacccctgagcctgaggtgtgctctcttgtgaaagagctgttcgggctggacgtggtgattcttgcctgtaatcccagcacttagggaggctgaggcaggattgctttagcccagttgttcaagcccatttgggcaacacaatgaaaccccgtctgtacaaaaaattaaattagccagtcatagcggtgcacacctgtagcccagctacttggtaggctgaggtgggaggatcacttaagtccaggagtttgaggctgcggtgagctatcatcagtgccgctgccctccagcctgggcaacagagcaagaccctgcctaaaaaaaacaaaaacaaagcctgtactatagtagtgcccacctggaagttccttcttgccagaataagaaatacagaagaggggccaggcgcggtggctcatgcctgtaatcccagcactttgggagggcgaggcgggcagatcacgaggtcaggagatcgagaccatcctggctaacacggtgaaaccgtgtctctgctaaaaatacaaagaattaactggatgtggtggcgggcacctgtagtcccagctactcgggaggctgagccaggagtatggcgtgaacccgggaggcagagcttgcagtgagccaagattgcaccactgcactccagcctgggcgacagagcaagactccatctcaaaagaaaaagaaaaagaaatacagaaggggaattgcagcggagttgtgttctgaccacgtgattcacgtgccttatgcttgtgttagctgccacgctgtgggaaatgcctcacggaaggcacgttgccttttcccttggggcccaccgccatgccctctgcagtctcgcctcttaggatcgggggatcc

SEQ ID NO: 77421 - DNA, 1521 bp, Homo sapiens
accgaccggagcgccgatcagagcacctgcccgggccacacatttcctcctggagcacagcaagtgccgcctaaattacccgagtgagcatctcttcccggcacgagaggcagggaggccaaagggccgccaagctggcctgggagaggcgtagggcggagcgagagtggagtgacattcccgagggcggagccccagggcctccgagacccgtagactcccgcctcccgcctcctctaggccgccggccgcgaagcgctgagtcacggtgaggcgactggacccacactctcttaacctgccctccctgcactcgctcccggcggctcttcgcgtcacccccgccgctaaggctccaggtgccgctaccgcagcgtgagtacctggggctcctgcaggggtccactagccctccatcctctacagctcagcatcagaacactctctttttagactccgatatggggtcctccaagaaagttactctctcagtgctcagccgggagcagtcggaaggggttggagcgagggtccggagaagcattggcagacccgagttaaaaaatctggatccgtttttactgtttgatgaatttaaaggaggtagaccaggaggatttcctgatcatccacatcgaggttttgaaacagtatcctacctcctggaagggggcagcatggcccatgaagacttctgtggacacactggtaaaatgaacccaggagatttgcagtggatgactgcgggccggggcattctgcacgctgagatgccttgctcagaggagccagcccatggcctacaactgtgggttaatttgaggagctcagagaagatggtggagcctcagtaccaggaactgaaaagtgaagaaatccctaaacccagtaaggatggtgtgacagttgctgtcatttctggagaagccctgggaataaagtccaaggtttacactcgcacaccaaccttatatttggacttcaaattggacccaggagccaaacattcccaacctatccctaaagggtggacaagcttcatttacacgatatctggagatgtgtatattgggcccgatgatgcacaacaaaaaatagaacctcatcacacagcagtgcttggagaaggtgacagtgtccaggtggagaacaaggatcccaagagaagccactttgtcttaattgctggggagccattaagagaaccagttatccaacatggtccatttgtgatgaacaccaatgaagagatttctcaagctattcttgatttcagaaacgcaaaaaatgggtttgaaagggccaaaacctggaaatcaaagattgggaactagtggaaagcggaagagcaggtcttgatgtgtcctagaattttgccatttctgagattgagccattgaaggcattccatttctaaagcttatttagccggtgcttctaaagaattccacactaacgtgataacatggtttttgtaacaataaatgtaggatatttcctggcacatgcaaataaacctaa

SEQ ID NO: 77422 - DNA, 405 bp, Homo sapiens
  misc_feature (28)..(28): n is a, c, g, or t
  misc_feature (31)..(31): n is a, c, g, or t
  misc_feature (37)..(38): n is a, c, g, or t
tctttcctccctgccgcctcccccgcgnccncccttnngatcccaagagaagccactttgtcttaattgctggggagccattaagagaaccagttatccaacatggtccatttgtgatgaacaccaatgaagagatttctcaagctattcttgatttcagaaacgcaaaaaatgggtttgaaagggccaaaacctggaaatcaaagattgggaactagtggaaagcggaagagcaggtcttgatgtgtcctagaattttgccatttctgagattgagccattgaaggcattccatttctaaagcttatttagccggtgcttctaaagaattccacactaacgtgataacatggtttttgtaacaataaatgtaggatatttcctggcacatgcaaataaacctaa

SEQ ID NO: 77423 - DNA, 415 bp, Homo sapiens
  misc_feature (20)..(20): n is a, c, g, or t
gtacatatgaatgtaatggntacatcgttccaaaatataaaaagtctagatcccaagagaagccactttgtcttaattgctggggagccattaagagaaccagttatccaacatggtccatttgtgatgaacaccaatgaagagatttctcaagctattcttgatttcagaaacgcaaaaaatgggtttgaaagggccaaaacctggaaatcaaagattgggaactagtggaaagcggaagagcaggtcttgatgtgtcctagaattttgccatttctgagattgagccattgaaggcattccatttctaaagcttatttagccggtgcttctaaagaattccacactaacgtgataacatggtttttgtaacaataaatgtaggatatttcctggcacatgcaaataaacctaa

SEQ ID NO: 77424 - DNA, 410 bp, Homo sapiens
  misc_feature (32)..(33): n is a, c, g, or t
  misc_feature (39)..(39): n is a, c, g, or t
ttactgactccacctctcatggaataaaaggnnggaggncctggatcccaagagaagccactttgtcttaattgctggggagccattaagagaaccagttatccaacatggtccatttgtgatgaacaccaatgaagagatttctcaagctattcttgatttcagaaacgcaaaaaatgggtttgaaagggccaaaacctggaaatcaaagattgggaactagtggaaagcggaagagcaggtcttgatgtgtcctagaattttgccatttctgagattgagccattgaaggcattccatttctaaagcttatttagccggtgcttctaaagaattccacactaacgtgataacatggtttttgtaacaataaatgtaggatatttcctggcacatgcaaataaacctaa

SEQ ID NO: 77425 - DNA, 430 bp, Homo sapiens
aataaacttttactcttcggatgtgcttggattttgttttaaattaagaactacagaaatatatatcatttctagtggtagaggaaaatattgccacccagaactttctgaatgtctctttctgccctaggtccatttgtgatgaacaccaatgaagagatttctcaagctattcttgatttcagaaacgcaaaaaatgggtttgaaagggccaaaacctggaaatcaaagattgggaactagtggaaagcggaagagcaggtcttgatgtgtcctagaattttgccatttctgagattgagccattgaaggcattccatttctaaagcttatttagccggtgcttctaaagaattccacactaacgtgataacatggtttttgtaacaataaatgtaggatatttcctggcacatgcaaataaacctaa

SEQ ID NO: 77426 - DNA, 790 bp, Homo sapiens
accgaccggagcgccgatcagagcacctgcccgggccacacatttcctcctggagcacagcaagtgccgcctaaattacccgagtgagcatctcttcccggcacgagaggcagggaggccaaagggccgccaagctggcctgggagaggcgtagggcggagcgagagtggagtgacattcccgagggcggagccccagggcctccgagacccgtagactcccgcctcccgcctcctctaggccgccggccgcgaagcgctgagtcacggtgaggcgactggacccacactctcttaacctgccctccctgcactcgctcccggcggctcttcgcgtcacccccgccgctaaggctccaggtgccgctaccgcagcccctccatcctctacagctcagcatcagaacactctctttttagactccgatatggggtcctccaagaaagttactctctcagtgctcagccgggagcagtcggaaggggttggagcgagggtccggagaagcattggcagacccgagttaaaaaatctggatccgtttttactgtttgatgaatttaaaggaggtagaccaggaggatttcctgatcatccacatcgaggttttgaaacattcccttctctgctaacacgttgaaggcgctgtggcttgctttgcagcaataatggaagccattcctttcacctaccctacactcatactggattctgaccctgttcctggaagatgtctccactctgtgctcctgctcgagctacttcttgtgtgctccatcccatagctcca

SEQ ID NO: 77427 - DNA, 2021 bp, Homo sapiens
  misc_feature (1547)..(1547): n is a, c, g, or t
  misc_feature (1553)..(1553): n is a, c, g, or t
accgaccggagcgccgatcagagcacctgcccgggccacacatttcctcctggagcacagcaagtgccgcctaaattacccgagtgagcatctcttcccggcacgagaggcagggaggccaaagggccgccaagctggcctgggagaggcgtagggcggagcgagagtggagtgacattcccgagggcggagccccagggcctccgagacccgtagactcccgcctcccgcctcctctaggccgccggccgcgaagcgctgagtcacggtgaggcgactggacccacactctcttaacctgccctccctgcactcgctcccggcggctcttcgcgtcacccccgccgctaaggctccaggtgccgctaccgcagcgtgagtacctggggctcctgcaggggtccactagccctccatcctctacagctcagcatcagaacactctctttttagactccgatatggggtcctccaagaaagttactctctcagtgctcagccgggagcagtcggaaggggttggagcgagggtccggagaagcattggcagacccgagttaaaaaatctggatccgtttttactgtttgatgaatttaaaggaggtagaccaggaggatttcctgatcatccacatcgaggttttgaaacagtatcctacctcctggaagggggcagcatggcccatgaagacttctgtggacacactggtaaaatgaacccaggagatttgcagtggatgactgcgggccggggcattctgcacgctgagatgccttgctcagaggagccagcccatggcctacaactgtgggttaatttgaggagctcagagaagatggtggagcctcagtaccaggaactgaaaagtgaagaaatccctaaacccagtaaggatggtgtgacagttgctgtcatttctggagaagccctgggaataaagtccaaggtttacactcgcacaccaaccttatatttggacttcaaattggacccaggagccaaacattcccaacctatccctaaagggtggacaagcttcatttacacgatatctggagatgtgtatattgggcccgatgatgcacaacaaaaaatagaacctcatcacacagcagtgcttggagaaggtgacagtgtccaggtggagaacaaggatcccaagagaagccactttgtcttaattgctggggagccattaagagaaccagttatccaacatggtccatttgtgatgaacaccaatgaagagatttctcaagctattcttgatttcagaaacgcaaaaaatgggtttgaaagggccaaaacctggaaatcaaagattgggaactagtggaaagcggaagagcaggtcttgatgtgtcctagaattttgccatttctgagattgagccattgaaggcattccatttctaaagcttatttagccggtgcttctaaagaattccacactaacgtgataacatggtttttgtaacaataaatgtaggatatttcctggcacatgcaaataaacctaatcattgtttctttaaaaaaaaaaaancacatnaacacaaacattaccctccacaatcccatattacaaaaccaccccgccattcttcttattcactatcatctataaaatccatttctttattcccaccatccacactactgtcctcttttctccccacacgggggacttctcgggctttttctacttggggggggtattatactccccccccacatcctcctttgacttttgtgggaggggggcagagcagactcctctctgcagggggagtttctttctccccgttagggagggctccgataaatacgtttcctcgtgctttgtgggtgccgcctcgaaggcgggcgggcgtatttttctttggtctccagccctgaatacaacacaagaagtgccgccgtgaagggcggcccgcgctaggaccaatgccccgctcgctcccgttagacccgcgtctgttcttcgagctccctgatgagactgatccgccgtattttg

SEQ ID NO: 77428 - DNA, 1487 bp, Homo sapiens
accgaccggagcgccgatcagagcacctgcccgggccacacatttcctcctggagcacagcaagtgccgcctaaattacccgagtgagcatctcttcccggcacgagaggcagggaggccaaagggccgccaagctggcctgggagaggcgtagggcggagcgagagtggagtgacattcccgagggcggagccccagggcctccgagacccgtagactcccgcctcccgcctcctctaggccgccggccgcgaagcgctgagtcacggtgaggcgactggacccacactctcttaacctgccctccctgcactcgctcccggcggctcttcgcgtcacccccgccgctaaggctccaggtgccgctaccgcagcccctccatcctctacagctcagcatcagaacactctctttttagactccgatatggggtcctccaagaaagttactctctcagtgctcagccgggagcagtcggaaggggttggagcgagggtccggagaagcattggcagacccgagttaaaaaatctggatccgtttttactgtttgatgaatttaaaggaggtagaccaggaggatttcctgatcatccacatcgaggttttgaaacagtatcctacctcctggaagggggcagcatggcccatgaagacttctgtggacacactggtaaaatgaacccaggagatttgcagtggatgactgcgggccggggcattctgcacgctgagatgccttgctcagaggagccagcccatggcctacaactgtgggttaatttgaggagctcagagaagatggtggagcctcagtaccaggaactgaaaagtgaagaaatccctaaacccagtaaggatggtgtgacagttgctgtcatttctggagaagccctgggaataaagtccaaggtttacactcgcacaccaaccttatatttggacttcaaattggacccaggagccaaacattcccaacctatccctaaagggtggacaagcttcatttacacgatatctggagatgtgtatattgggcccgatgatgcacaacaaaaaatagaacctcatcacacagcagtgcttggagaaggtgacagtgtccaggtggagaacaaggatcccaagagaagccactttgtcttaattgctggggagccattaagagaaccagttatccaacatggtccatttgtgatgaacaccaatgaagagatttctcaagctattcttgatttcagaaacgcaaaaaatgggtttgaaagggccaaaacctggaaatcaaagattgggaactagtggaaagcggaagagcaggtcttgatgtgtcctagaattttgccatttctgagattgagccattgaaggcattccatttctaaagcttatttagccggtgcttctaaagaattccacactaacgtgataacatggtttttgtaacaataaatgtaggatatttcctggcacatgcaaataaacctaa

SEQ ID NO: 77429 - DNA, 1287 bp, Homo sapiens
  misc_feature (813)..(813): n is a, c, g, or t
  misc_feature (819)..(819): n is a, c, g, or t
gcccatggcctacaactgtgggttggctcctctgagcaaggcatctcagaggagccagcccatggcctacaactgtgggttaatttgaggagctcagagaagatggtggagcctcagtaccaggaactgaaaagtgaagaaatccctaaacccagtaaggatggtgtgacagttgctgtcatttctggagaagccctgggaataaagtccaaggtttacactcgcacaccaaccttatatttggacttcaaattggacccaggagccaaacattcccaacctatccctaaagggtggacaagcttcatttacacgatatctggagatgtgtatattgggcccgatgatgcacaacaaaaaatagaacctcatcacacagcagtgcttggagaaggtgacagtgtccaggtggagaacaaggatcccaagagaagccactttgtcttaattgctggggagccattaagagaaccagttatccaacatggtccatttgtgatgaacaccaatgaagagatttctcaagctattcttgatttcagaaacgcaaaaaatgggtttgaaagggccaaaacctggaaatcaaagattgggaactagtggaaagcggaagagcaggtcttgatgtgtcctagaattttgccatttctgagattgagccattgaaggcattccatttctaaagcttatttagccggtgcttctaaagaattccacactaacgtgataacatggtttttgtaacaataaatgtaggatatttcctggcacatgcaaataaacctaatcattgtttctttaaaaaaaaaaaancacatnaacacaaacattaccctccacaatcccatattacaaaaccaccccgccattcttcttattcactatcatctataaaatccatttctttattcccaccatccacactactgtcctcttttctccccacacgggggacttctcgggctttttctacttggggggggtattatactccccccccacatcctcctttgacttttgtgggaggggggcagagcagactcctctctgcagggggagtttctttctccccgttagggagggctccgataaatacgtttcctcgtgctttgtgggtgccgcctcgaaggcgggcgggcgtatttttctttggtctccagccctgaatacaacacaagaagtgccgccgtgaagggcggcccgcgctaggaccaatgccccgctcgctcccgttagacccgcgtctgttcttcgagctccctgatgagactgatccgccgtattttg

SEQ ID NO: 77430 - DNA, 1579 bp, Homo sapiens
  misc_feature (1521)..(1521): n is a, c, g, or t
accgaccggagcgccgatcagagcacctgcccgggccacacatttcctcctggagcacagcaagtgccgcctaaattacccgagtgagcatctcttcccggcacgagaggcagggaggccaaagggccgccaagctggcctgggagaggcgtagggcggagcgagagtggagtgacattcccgagggcggagccccagggcctccgagacccgtagactcccgcctcccgcctcctctaggccgccggccgcgaagcgctgagtcacggtgaggcgactggacccacactctcttaacctgccctccctgcactcgctcccggcggctcttcgcgtcacccccgccgctaaggctccaggtgccgctaccgcagcccctccatcctctacagctcagcatcagaacactctctttttagactccgatatggggtcctccaagaaagttactctctcagtgctcagccgggagcagtcggaaggggttggagcgagggtccggagaagcattggcagacccgagttaaaaaatctggatccgtttttactgtttgatgaatttaaaggaggtagaccaggaggatttcctgatcatccacatcgaggttttgaaacagtatcctacctcctggaagggggcagcatggcccatgaagacttctgtggacacactggtaaaatgaacccaggagatttgcagtggatgactgcgggccggggcattctgcacgctgagatgccttgctcagaggagccagcccatggcctacaactgtgggttaatttgaggagctcagagaagatggtggagcctcagtaccaggaactgaaaagtgaagaaatccctaaacccagtaaggatggtgtgacagttgctgtcatttctggagaagccctgggaataaagtccaaggtttacactcgcacaccaaccttatatttggacttcaaattggacccaggagccaaacattcccaacctatccctaaagggtggacaagcttcatttacacgatatctggagatgtgtatattgggcccgatgatgcacaacaaaaaatagaacctcatcacacagcagtgcttggagaaggtgacagtgtccaggtggagaacaaggatcccaagagaagccactttgtcttaattgctggggagccattaagagaaccagttatccaacatgcgatcatctcagtccacattggaacgatctgaacagcagatcagggctgcttctagtttggaggaactacttcgaattactcactctgaggactggaagctgtggagatgcaggctgaggctcaaaagttttaccagtatggactctcgctcagcatcccatcggtccactaggtttgcggcaactttctatgacattgaaacactgttatagatgaagaatggcaaagaactcagtgcagccctagagaaacgtgcgtggaggtggccagtgagctggggaagagtccaacacattcttcaagcccccttgtgtgaacgtgttccgatgtggnggctgttgcaatgaagagagccttatctgtatgcaccagcacctcgtcatttcccgct

SEQ ID NO: 77431 - DNA, 1443 bp, Homo sapiens
accgaccggagcgccgatcagagcacctgcccgggccacacatttcctcctggagcacagcaagtgccgcctaaattacccgagtgagcatctcttcccggcacgagaggcagggaggccaaagggccgccaagctggcctgggagaggcgtagggcggagcgagagtggagtgacattcccgagggcggagccccagggcctccgagacccgtagactcccgcctcccgcctcctctaggccgccggccgcgaagcgctgagtcacggtgaggcgactggacccacactctcttaacctgccctccctgcactcgctcccggcggctcttcgcgtcacccccgccgctaaggctccaggtgccgctaccgcagcccctccatcctctacagctcagcatcagaacactctctttttagactccgatatggggtcctccaagaaagttactctctcagtgctcagccgggagcagtcggaaggggttggagcgagggtccggagaagcattggcagacccgagttaaaaaatctggatccgtttttactgtttgatgaatttaaaggaggtagaccaggaggatttcctgatcatccacatcgaggttttgaaacagtatcctacctcctggaagggggcagcatggcccatgaagacttctgtggacacactggtaaaatgaacccaggagatttgcagtggatgactgcgggccggggcattctgcacgctgagatgccttgctcagaggagccagcccatggcctacaactgtgggttaatttgaggagctcagagaagatggtggagcctcagtaccaggaactgaaaagtgaagaaatccctaaacccagtaaggatggtgtgacagttgctgtcatttctggagaagccctgggaataaagtccaaggtttacactcgcacaccaaccttatatttggacttcaaattggacccaggagccaaacattcccaacctatccctaaaggggcccgatgatgcacaacaaaaaatagaacctcatcacacagcagtgcttggagaaggtgacagtgtccaggtggagaacaaggatcccaagagaagccactttgtcttaattgctggggagccattaagagaaccagttatccaacatggtccatttgtgatgaacaccaatgaagagatttctcaagctattcttgatttcagaaacgcaaaaaatgggtttgaaagggccaaaacctggaaatcaaagattgggaactagtggaaagcggaagagcaggtcttgatgtgtcctagaattttgccatttctgagattgagccattgaaggcattccatttctaaagcttatttagccggtgcttctaaagaattccacactaacgtgataacatggtttttgtaacaataaatgtaggatatttcctggcacatgcaaataaacctaa

SEQ ID NO: 77432 - DNA, 913 bp, Homo sapiens
  misc_feature (31)..(34): n is a, c, g, or t
  misc_feature (38)..(38): n is a, c, g, or t
  misc_feature (439)..(439): n is a, c, g, or t
  misc_feature (445)..(445): n is a, c, g, or t
aaatgggttaaagcgctcggaaaaaaacaannnnaccntttgtgtggatcccaagagaagccactttgtcttaattgctggggagccattaagagaaccagttatccaacatggtccatttgtgatgaacaccaatgaagagatttctcaagctattcttgatttcagaaacgcaaaaaatgggtttgaaagggccaaaacctggaaatcaaagattgggaactagtggaaagcggaagagcaggtcttgatgtgtcctagaattttgccatttctgagattgagccattgaaggcattccatttctaaagcttatttagccggtgcttctaaagaattccacactaacgtgataacatggtttttgtaacaataaatgtaggatatttcctggcacatgcaaataaacctaatcattgtttctttaaaaaaaaaaaancacatnaacacaaacattaccctccacaatcccatattacaaaaccaccccgccattcttcttattcactatcatctataaaatccatttctttattcccaccatccacactactgtcctcttttctccccacacgggggacttctcgggctttttctacttggggggggtattatactccccccccacatcctcctttgacttttgtgggaggggggcagagcagactcctctctgcagggggagtttctttctccccgttagggagggctccgataaatacgtttcctcgtgctttgtgggtgccgcctcgaaggcgggcgggcgtatttttctttggtctccagccctgaatacaacacaagaagtgccgccgtgaagggcggcccgcgctaggaccaatgccccgctcgctcccgttagacccgcgtctgttcttcgagctccctgatgagactgatccgccgtattttg

SEQ ID NO: 77433 - DNA, 905 bp, Homo sapiens
  misc_feature (28)..(28): n is a, c, g, or t
  misc_feature (31)..(31): n is a, c, g, or t
  misc_feature (37)..(38): n is a, c, g, or t
  misc_feature (431)..(431): n is a, c, g, or t
  misc_feature (437)..(437): n is a, c, g, or t
tctttcctccctgccgcctcccccgcgnccncccttnngatcccaagagaagccactttgtcttaattgctggggagccattaagagaaccagttatccaacatggtccatttgtgatgaacaccaatgaagagatttctcaagctattcttgatttcagaaacgcaaaaaatgggtttgaaagggccaaaacctggaaatcaaagattgggaactagtggaaagcggaagagcaggtcttgatgtgtcctagaattttgccatttctgagattgagccattgaaggcattccatttctaaagcttatttagccggtgcttctaaagaattccacactaacgtgataacatggtttttgtaacaataaatgtaggatatttcctggcacatgcaaataaacctaatcattgtttctttaaaaaaaaaaaancacatnaacacaaacattaccctccacaatcccatattacaaaaccaccccgccattcttcttattcactatcatctataaaatccatttctttattcccaccatccacactactgtcctcttttctccccacacgggggacttctcgggctttttctacttggggggggtattatactccccccccacatcctcctttgacttttgtgggaggggggcagagcagactcctctctgcagggggagtttctttctccccgttagggagggctccgataaatacgtttcctcgtgctttgtgggtgccgcctcgaaggcgggcgggcgtatttttctttggtctccagccctgaatacaacacaagaagtgccgccgtgaagggcggcccgcgctaggaccaatgccccgctcgctcccgttagacccgcgtctgttcttcgagctccctgatgagactgatccgccgtattttg

SEQ ID NO: 77434 - DNA, 1987 bp, Homo sapiens
  misc_feature (1513)..(1513): n is a, c, g, or t
  misc_feature (1519)..(1519): n is a, c, g, or t
accgaccggagcgccgatcagagcacctgcccgggccacacatttcctcctggagcacagcaagtgccgcctaaattacccgagtgagcatctcttcccggcacgagaggcagggaggccaaagggccgccaagctggcctgggagaggcgtagggcggagcgagagtggagtgacattcccgagggcggagccccagggcctccgagacccgtagactcccgcctcccgcctcctctaggccgccggccgcgaagcgctgagtcacggtgaggcgactggacccacactctcttaacctgccctccctgcactcgctcccggcggctcttcgcgtcacccccgccgctaaggctccaggtgccgctaccgcagcccctccatcctctacagctcagcatcagaacactctctttttagactccgatatggggtcctccaagaaagttactctctcagtgctcagccgggagcagtcggaaggggttggagcgagggtccggagaagcattggcagacccgagttaaaaaatctggatccgtttttactgtttgatgaatttaaaggaggtagaccaggaggatttcctgatcatccacatcgaggttttgaaacagtatcctacctcctggaagggggcagcatggcccatgaagacttctgtggacacactggtaaaatgaacccaggagatttgcagtggatgactgcgggccggggcattctgcacgctgagatgccttgctcagaggagccagcccatggcctacaactgtgggttaatttgaggagctcagagaagatggtggagcctcagtaccaggaactgaaaagtgaagaaatccctaaacccagtaaggatggtgtgacagttgctgtcatttctggagaagccctgggaataaagtccaaggtttacactcgcacaccaaccttatatttggacttcaaattggacccaggagccaaacattcccaacctatccctaaagggtggacaagcttcatttacacgatatctggagatgtgtatattgggcccgatgatgcacaacaaaaaatagaacctcatcacacagcagtgcttggagaaggtgacagtgtccaggtggagaacaaggatcccaagagaagccactttgtcttaattgctggggagccattaagagaaccagttatccaacatggtccatttgtgatgaacaccaatgaagagatttctcaagctattcttgatttcagaaacgcaaaaaatgggtttgaaagggccaaaacctggaaatcaaagattgggaactagtggaaagcggaagagcaggtcttgatgtgtcctagaattttgccatttctgagattgagccattgaaggcattccatttctaaagcttatttagccggtgcttctaaagaattccacactaacgtgataacatggtttttgtaacaataaatgtaggatatttcctggcacatgcaaataaacctaatcattgtttctttaaaaaaaaaaaancacatnaacacaaacattaccctccacaatcccatattacaaaaccaccccgccattcttcttattcactatcatctataaaatccatttctttattcccaccatccacactactgtcctcttttctccccacacgggggacttctcgggctttttctacttggggggggtattatactccccccccacatcctcctttgacttttgtgggaggggggcagagcagactcctctctgcagggggagtttctttctccccgttagggagggctccgataaatacgtttcctcgtgctttgtgggtgccgcctcgaaggcgggcgggcgtatttttctttggtctccagccctgaatacaacacaagaagtgccgccgtgaagggcggcccgcgctaggaccaatgccccgctcgctcccgttagacccgcgtctgttcttcgagctccctgatgagactgatccgccgtattttg

SEQ ID NO: 77435 - DNA, 1518 bp, Homo sapiens
accgaccggagcgccgatcagagcacctgcccgggccacacatttcctcctggagcacagcaagtgccgcctaaattacccgagtgagcatctcttcccggcacgagaggcagggaggccaaagggccgccaagctggcctgggagaggcgtagggcggagcgagagtggagtgacattcccgagggcggagccccagggcctccgagacccgtagactcccgcctcccgcctcctctaggccgccggccgcgaagcgctgagtcacggtgaggcgactggacccacactctcttaacctgccctccctgcactcgctcccggcggctcttcgcgtcacccccgccgctaaggctccaggtgccgctaccgcagcccctccatcctctacagctcagcatcagaacactctctttttagactccgatatggggtcctccaagaaagttactctctcagtgctcagccgggagcagtcggaaggggttggagcgagggtccggagaagcattggcagacccgagttaaaaaatctggatccgtttttactgtttgatgaatttaaaggaggtagaccaggaggatttcctgatcatccacatcgaggttttgaaacagtatcctacctcctggaagggggcagcatggcccatgaagacttctgtggacacactggtaaaatgaacccaggagatttgcagtggatgactgcgggccggggcattctgcacgctgagatgccttgctcagaggagccagcccatggcctacaactgtgggttaatttgaggagctcagagaagatggtggagcctcagtaccaggaactgaaaagtgaagaaatccctaaacccagtaaggatggtgtgacagttgctgtcatttctggagaagccctgggaataaagtccaaggtttacactcgcacaccaaccttatatttggacttcaaattggacccaggagccaaacattcccaacctatccctaaagggtggacaagcttcatttacacgatatctggagatgtgtatattgggcccgatgatgcacaacaaaaaatagaacctcatcacacagcagtgcttggagaaggtgacagtgtccaggtggagaacaaggatcccaagagaagccactttgtcttaattgctggggagccattaagagaaccagttatccaacatggtccatttgtgatgaacaccaatgaagagatttctcaagctattcttgatttcagaaacgcaaaaaatgggtttgaaagggccaaaacctggaaatcaaagattgggaactagtggaaagcggaagagcaggtcttgatgtgtcctagaattttgccatttctgagattgagccattgaaggcattccatttctaaagcttatttagccggtgcttctaaagaattccacactaacgtgataacatggtttttgtaacaataaatgtaggatatttcctggcacatgcaaataaacctaaggaaaaaaaattggtctgtttgggtcttatg

SEQ ID NO: 77436 - DNA, 1015 bp, Homo sapiens
  misc_feature (541)..(541): n is a, c, g, or t
  misc_feature (547)..(547): n is a, c, g, or t
ggccggtaccatctctccacagtggacaagcttcatttacacgatatctggagatgtgtatattgggcccgatgatgcacaacaaaaaatagaacctcatcacacagcagtgcttggagaaggtgacagtgtccaggtggagaacaaggatcccaagagaagccactttgtcttaattgctggggagccattaagagaaccagttatccaacatggtccatttgtgatgaacaccaatgaagagatttctcaagctattcttgatttcagaaacgcaaaaaatgggtttgaaagggccaaaacctggaaatcaaagattgggaactagtggaaagcggaagagcaggtcttgatgtgtcctagaattttgccatttctgagattgagccattgaaggcattccatttctaaagcttatttagccggtgcttctaaagaattccacactaacgtgataacatggtttttgtaacaataaatgtaggatatttcctggcacatgcaaataaacctaatcattgtttctttaaaaaaaaaaaancacatnaacacaaacattaccctccacaatcccatattacaaaaccaccccgccattcttcttattcactatcatctataaaatccatttctttattcccaccatccacactactgtcctcttttctccccacacgggggacttctcgggctttttctacttggggggggtattatactccccccccacatcctcctttgacttttgtgggaggggggcagagcagactcctctctgcagggggagtttctttctccccgttagggagggctccgataaatacgtttcctcgtgctttgtgggtgccgcctcgaaggcgggcgggcgtatttttctttggtctccagccctgaatacaacacaagaagtgccgccgtgaagggcggcccgcgctaggaccaatgccccgctcgctcccgttagacccgcgtctgttcttcgagctccctgatgagactgatccgccgtattttg

SEQ ID NO: 77437 - DNA, 1408 bp, Homo sapiens
accgaccggagcgccgatcagagcacctgcccgggccacacatttcctcctggagcacagcaagtgccgcctaaattacccgagtgagcatctcttcccggcacgagaggcagggaggccaaagggccgccaagctggcctgggagaggcgtagggcggagcgagagtggagtgacattcccgagggcggagccccagggcctccgagacccgtagactcccgcctcccgcctcctctaggccgccggccgcgaagcgctgagtcacggtgaggcgactggacccacactctcttaacctgccctccctgcactcgctcccggcggctcttcgcgtcacccccgccgctaaggctccaggtgccgctaccgcagcccctccatcctctacagctcagcatcagaacactctctttttagactccgatatggggtcctccaagaaagttactctctcagtgctcagccgggagcagtcggaaggggttggagcgagggtccggagaagcattggcagacccgagttaaaaaatctggatccgtttttactgtttgatgaatttaaaggaggtagaccaggaggatttcctgatcatccacatcgaggttttgaaacagtatcctacctcctggaagggggcagcatggcccatgaagacttctgtggacacactggtaaaatgaacccaggagatttgcagtggatgactgcgggccggggcattctgcacgctgagatgccttgctcagaggagccagcccatggcctacaactgtgggttaatttgaggagctcagagaagatggtggagcctcagtaccaggaactgaaaagtgaagaaatccctaaacccagtaaggatggtgtgacagttgctgtcatttctggagaagccctgggaataaagtccaaggtttacactcgcacaccaaccttatatttggacttcaaattggacccaggagccaaacattcccaacctatccctaaagggtggacaagcttcatttacacgatatctggagatgtgtatattgggcccgatgatgcacaacaaaaaatagaacctcatcacacagcagtgcttggagaaggtgacagtgtccaggtggagaacaaggatcccaagagaagccactttgtcttaattgctggggagccattaagagaaccagttatccaacatgtaagaccaaaatgacaatgattttcttggttgattttccttttctttgaaaacagtatacatgtatactattgttgggaagaatagctggttttttttgtcctgtctctccatctataaatctgaggattgtttaatttttctgtcatcagagggaaatatatatgtgatgtttattcatctctttttttttaaagaaacatttcttagatacctattatg

SEQ ID NO: 77438 - DNA, 1232 bp, Homo sapiens
  misc_feature (1203)..(1203): n is a, c, g, or t
  misc_feature (1215)..(1215): n is a, c, g, or t
accgaccggagcgccgatcagagcacctgcccgggccacacatttcctcctggagcacagcaagtgccgcctaaattacccgagtgagcatctcttcccggcacgagaggcagggaggccaaagggccgccaagctggcctgggagaggcgtagggcggagcgagagtggagtgacattcccgagggcggagccccagggcctccgagacccgtagactcccgcctcccgcctcctctaggccgccggccgcgaagcgctgagtcacggtgaggcgactggacccacactctcttaacctgccctccctgcactcgctcccggcggctcttcgcgtcacccccgccgctaaggctccaggtgccgctaccgcagcccctccatcctctacagctcagcatcagaacactctctttttagactccgatatggggtcctccaagaaagttactctctcagtgctcagccgggagcagtcggaaggggttggagcgagggtccggagaagcattggcagacccgagttaaaaaatctggatccgtttttactgtttgatgaatttaaaggaggtagaccaggaggatttcctgatcatccacatcgaggttttgaaacagtatcctacctcctggaagggggcagcatggcccatgaagacttctgtggacacactggtaaaatgaacccaggagatttgcagtggatgactgcgggccggggcattctgcacgctgagatgccttgctcagaggagccagcccatggcctacaactgtgggttaatttgaggagctcagagaagatggtggagcctcagtaccaggaactgaaaagtgaagaaatccctaaacccagtaaggatggtgtgacagttgctgtcatttctggagaagccctgggaataaagtccaaggtttacactcgcacaccaaccttatatttggacttcaaattggacccaggagccaaacattcccaacctatccctaaagggtggacaagcttcatttacacgatatctggagatgtgtatattgggcccgatgatgcacaacaaaaaatagaacctcatcacacagcagtgcttggagaaggtgacagtgtccaggtggagaacaaggatcccaagagaagccactttgtcttaattgctggggagccattaagagaaccagttatccaacatgcattatggatcttggntaacctcaaaanagcaaggagaaagaagc

SEQ ID NO: 77439 - DNA, 309 bp, Homo sapiens
aagctaggagggctaacttccagaccaagacctttaagaggggctgttttagcagcccacctcggctttaacacttccctaggaggaactatatatataatggatccaggtccaggcctattacagaagggccagctgaaggaaagaagaaccttattcttagaaaaaaacactgatggtttccttttccttttcagtccaaggtttacactcgcacaccaaccttatatttggacttcaaattggacccaggagccaaacattcccaacctatccctaaagggtatgatgggttctggggtttagtag

SEQ ID NO: 77440 - DNA, 2660 bp, Homo sapiens
aagcccggcctggcggcggcggtggcggtagctgccgtggcggcctctgcgcatgctccgtcgcctgcccgccctggccgctcgccgcccgcccgcccgacggagacgcagtcccagctatctgacttcatgtgaaagatggctaatgcagaagtgagtgtcccagtgggggatgtggttgtggtacctactgaaggaaatgaaggggagaatcctgaagacactaaaacccaagtgattttgcagttacagcctgtgcaacaagggatttatgaagctgggtcggagaacaacacggcagttgtagcagtagaaactcacacgatacacaaaattgaagaagggattgatacaggcactatagaagcaaatgaggatatggaaattgcttaccccataacttgtggggagagcaaagccatcctcctctggaagaagtttgtatgtccaggaataaacgtgaagtgtgtcaagttcaatgatcagttgatcagccccaagcactttgttcatctggctggcaagtccactctgaaggactggaagagagctattcgtctgggtgggatcatgctcaggaaaatgatggactccggacagattgatttttaccaacatgacaaagtttgctccaatacctgcagaagcaccaaatttgatcttctgatcagcagtgcaagagctccagtgccaggacagcagacaagtgtggtgcagacacccacttcggctgatggtagcatcacgcagattgccatctcagaagagagcatggaagaggcagggctggaatggaactcagctctcaccgctgctgtcaccatggccacggaggagggtgtaaagaaagactcagaggaaatttcagaggacactttgatgttctggaaaggaatagctgatgtagggctgatggaagaggttgtctgcaatatacagaaggaaatagaggagctactcaggggagttcagcagcggctcatccaggctcccttccaagtcacagatgctgctgttctcaacaatgtagcacacacatttggcctaatggacacagtcaagaaggttttagacaacagaaggaaccaagtagagcagggagaagaacagtttctctatactctgacagacttggaacgccagttggaggagcagaagaagcaaggccaggatcacaggctgaaatctcagacagttcaaaatgtggtactgatgcctgtgagcactcctaagcctccaaaaaggccccggctccagcggccagcctccaccactgtcttgagcccttctcctcctgtccagcagcctcagttcacagtcatctcacccatcaccatcaccccagtgggtcagtcattttccatgggcaatattccagtggccaccctcagccagggctccagtcctgtgactgtccacacactgccttctggccctcagctcttccgctatgccacagtggtctcctctgccaagagcagctcaccagacacagtgaccatccacccttcatctagcttggcgctgctgagctctactgccatgcaggatgggagtacactgggcaacatgaccaccatggttagccctgtggaattggtggccatggagtccggcctaacctcggcaattcaggctgttgaaagcacctcagaggatgggcagaccatcattgagattgatccagccccggacccagaagctgaagatactgagggcaaagcagtcatcttggagacagagctgaggactgaggagaaagttgtggctgagatggaagaacaccagcatcaagttcacaatgtggagattgtggtcttagaggattaactggggatctcagggccaggagttatgttttgatttggaattttaattatttgtttatttttatcattgtcccactcatttccacataggacccttttttaaaaaaaaaaaaacaaaatcttattgttgtaactgaaaatgttgggttcttcccactccctcattgaaaaatggacaaaacaagctgcccttccagaagttgagagtaggtcattcaatgtcctaatcatcttacaccaagaaagtaatttcttttaggggaagtgtcaagataacaagtaaccctgtccagaaagccatttccaggctcgtctgtgtgtgtaggcatgtggttttattcttgtaaagatgcattgaccaaactctggaacacagatctgacactggaaggcaacccactcgcatgtggatgctgaagggcactttattttgtatcctgaaaagggcctacagaggccagtacaaaactctcaaacaaaaggaagttgactctgctttgaggggaaggtggcatgccagcactagcttaaaaagggaagtgctagccgggcgtggtggctcacgcctgcaatcccagcactttgggaggccgaggcgggtggatcacgaggtcaggagtttgagaccagcctggccaacatggtgaaaccccgtatctactaaaaatacgaaaaaaaaattagccgggtgtggtggcgggagcctgtaatcccagctattcaggaggccaaggcaggagaatcgcttgaacctgggaaggcagaggttgcagtgagccaagatcgcaccactgcactccagcctgggcaacaagagcgagactccatctc

SEQ ID NO: 77441 - DNA, 212 bp, Homo sapiens
  misc_feature (179)..(179): n is a, c, g, or t
tgtccatcccccttcgtggccatggtagcatcacgcagattgccatctcagaagagagcatggaagaggcagggctggaatggaactcagctctcaccgctgctgtcaccatggccacggaggagggtgtaaagaaagactcagaggaaatttcagagacactttatgttctggaaagnatagctgacgaaggggtatgacactaacctctg

SEQ ID NO: 77442 - DNA, 209 bp, Homo sapiens
aggctcagcagtgttgtccctatttttccctgaggcctagttcccactagatgaagtataggctgaactggtacttcttgtctccctttgcacaggaaaatgatggactccggacagattgatttttaccaacatgacaaagtttgttgcagtgagccgagatcgcgccactgcactccagcctgggcgactaagcaagactccatctc

SEQ ID NO: 77443 - DNA, 2690 bp, Homo sapiens
aagcccggcctggcggcggcggtggcggtagctgccgtggcggcctctgcgcatgctccgtcgcctgcccgccctggccgctcgccgcccgcccgcccgacggagacgcagtcccagctatctgacttcatgtgaaagatggctaatgcagaagtgagtgtcccagtgggggatgtggttgtggtacctactgaaggaaatgaaggggagaatcctgaagacactaaaacccaagtgattttgcagttacagcctgtgcaacaaggtttgtttatcgatggacacttttacaacaggatttatgaagctgggtcggagaacaacacggcagttgtagcagtagaaactcacacgatacacaaaattgaagaagggattgatacaggcactatagaagcaaatgaggatatggaaattgcttaccccataacttgtggggagagcaaagccatcctcctctggaagaagtttgtatgtccaggaataaacgtgaagtgtgtcaagttcaatgatcagttgatcagccccaagcactttgttcatctggctggcaagtccactctgaaggactggaagagagctattcgtctgggtgggatcatgctcaggaaaatgatggactccggacagattgatttttaccaacatgacaaagtttgctccaatacctgcagaagcaccaaatttgatcttctgatcagcagtgcaagagctccagtgccaggacagcagacaagtgtggtgcagacacccacttcggctgatggtagcatcacgcagattgccatctcagaagagagcatggaagaggcagggctggaatggaactcagctctcaccgctgctgtcaccatggccacggaggagggtgtaaagaaagactcagaggaaatttcagaggacactttgatgttctggaaaggaatagctgatgtagggctgatggaagaggttgtctgcaatatacagaaggaaatagaggagctactcaggggagttcagcagcggctcatccaggctcccttccaagtcacagatgctgctgttctcaacaatgtagcacacacatttggcctaatggacacagtcaagaaggttttagacaacagaaggaaccaagtagagcagggagaagaacagtttctctatactctgacagacttggaacgccagttggaggagcagaagaagcaaggccaggatcacaggctgaaatctcagacagttcaaaatgtggtactgatgcctgtgagcactcctaagcctccaaaaaggccccggctccagcggccagcctccaccactgtcttgagcccttctcctcctgtccagcagcctcagttcacagtcatctcacccatcaccatcaccccagtgggtcagtcattttccatgggcaatattccagtggccaccctcagccagggctccagtcctgtgactgtccacacactgccttctggccctcagctcttccgctatgccacagtggtctcctctgccaagagcagctcaccagacacagtgaccatccacccttcatctagcttggcgctgctgagctctactgccatgcaggatgggagtacactgggcaacatgaccaccatggttagccctgtggaattggtggccatggagtccggcctaacctcggcaattcaggctgttgaaagcacctcagaggatgggcagaccatcattgagattgatccagccccggacccagaagctgaagatactgagggcaaagcagtcatcttggagacagagctgaggactgaggagaaagttgtggctgagatggaagaacaccagcatcaagttcacaatgtggagattgtggtcttagaggattaactggggatctcagggccaggagttatgttttgatttggaattttaattatttgtttatttttatcattgtcccactcatttccacataggacccttttttaaaaaaaaaaaaacaaaatcttattgttgtaactgaaaatgttgggttcttcccactccctcattgaaaaatggacaaaacaagctgcccttccagaagttgagagtaggtcattcaatgtcctaatcatcttacaccaagaaagtaatttcttttaggggaagtgtcaagataacaagtaaccctgtccagaaagccatttccaggctcgtctgtgtgtgtaggcatgtggttttattcttgtaaagatgcattgaccaaactctggaacacagatctgacactggaaggcaacccactcgcatgtggatgctgaagggcactttattttgtatcctgaaaagggcctacagaggccagtacaaaactctcaaacaaaaggaagttgactctgctttgaggggaaggtggcatgccagcactagcttaaaaagggaagtgctagccgggcgtggtggctcacgcctgcaatcccagcactttgggaggccgaggcgggtggatcacgaggtcaggagtttgagaccagcctggccaacatggtgaaaccccgtatctactaaaaatacgaaaaaaaaattagccgggtgtggtggcgggagcctgtaatcccagctattcaggaggccaaggcaggagaatcgcttgaacctgggaaggcagaggttgcagtgagccaagatcgcaccactgcactccagcctgggcaacaagagcgagactccatctc

SEQ ID NO: 77444 - DNA, 751 bp, Homo sapiens
tgaggatgggttcccatggcatataacttacaaataattcaaaaggagaatgttatgaggttgcctccattgctacgtgactctgggagatatatatgtatatatatatatgtatgtatgttggtatacatgttggtatttatttaaaaaatttctttagttgaaatttcgagcatttgacctaagtggctgataatatctcataaaagctgacatttgttagtggattataatatgtcaggctcagtgctacctgctttctgtggattatctcagaatcctcgcactgatctgtatttttcattttatagagggatctatgtggaggtgctgagttgtcaaaggacactggcagagcttgattgcattcagggctgaattactttgctaaagtggcggggtctatttctctaccccttgaatctgagcagggctcgtgccttgctttggccactagaattcagggggatggcccgtgcaccagccctgtgcccagctctgaagaccctctgtgtttcctctttgcctcatgctgtctgcagccatgaggagaacacacccaagctaccggaggatggaaggcaagtggagaagatccgagtcgtgccaccaaggccagtctagatgagccaagagctagtagagccccggatatttaagtgagtctggctgggcgcggtggctcatgcctgtaattccagcactttgggaggctgaggcaggtggatcacgaggtcaggagatcgagacc

SEQ ID NO: 77445 - DNA, 1193 bp, Homo sapiens
gcagtgaagtcatggtctaaggccagggcggaggtggaagagctaccggtgtcatagccacatttacctggtttctgcagctgtgggagtgaactgtggatgttgtcactcacctggtggggggtgggggggggtcttcctaaaaaagcaggtgaaggacagaatagcgccagtgtggagagagccgaggaagaggaaactgcctgggtgaccaagaatacgtcgtgacagaggaggacaatacgcgatcacagacaccaggaaagaaaaaggtggctttctggagatagcgccccttccttcatcataacccattcattcagaccctgtctgtgagtatttcagggcaggaggaatggatggcagtcttcgtcaataccccttaaaatttctgaacataggggccattgaagtgcctgtgtgccattgcctgcttattaaaatgaattatgaacaaatatatttcttttaattcttatgcagttctctgagatatgtattccagtttacaaacagaagctggacctcggagaggggaaacgattctcccaaaattgtgtagccaagtggaagaaacattggaatctaggtgtgattccagactcttccactgtcccatattagtttcacaccagataattttctctgatcagacgttaggaagatgttgaaaacacctaaggaatggggcaggggtgatgaacagatatacctgaagcaggagggaagggaaggtttttatatgatgatgttcactggagcatcattgacatcatagacaaagcagtctaacaacagaggaaaggtatttcaaggccgtgaaccttcaaatctgtgtttgtaaaggctatatatggtcttttccagtggttctcaaacttcagcatgagttgcaagcgccgtcagagcttgccaagacacaattgttgggccttacctggagcttctgattcagcaggactgcggtcccaaaataggcatgtctaacaagctcccaggtgatgctgctgatcccaggatcacactttgaaaaccactggtctaatttagcctgcacaggtgatgggttctacttctaaaaatgagggatgaatgcatttggctttagattgctgaactagggattcctcctccgggaaaaatgggattcgaaccctttgaggagactcttcttcagagtggattatttaaaa

SEQ ID NO: 77446 - DNA, 2880 bp, Homo sapiens
ccctataggcagtctttagctctcatggattgggagctgggaaaggaatgagaagacagaagtcagagacaagaagaggctaacatgactgataccactataatttagtggatcagtgtctttcaatgatgtgactgtggacttcactcaggaggagtggcagcacctggatcatgctcagaagactctatatatggatgtgatgttggaaaactattgccacctcatctctgtggggtgtcacatgaccaaacctgatgtgatcctcaagttggaacgaggagaagagccatggacatcatttgcaggtcatacctgcttggaagaaaactggaaagctgaagactttttagtgaaattcaaggaacaccaagagaagtattctagatcagttgtaagcatcaaccacaaaaaactggtgaaggagaagagtaaaatatatgaaaagacatttactctaggcaaaaaccctgtgaattcaaaaaatctacctcctgaatatgatactcatggaaggattttgaaaaatgtttcagaattaatcatcagtaatctaaatcctgcaagaaagagacttagtgagtataatggatatgggaaatcactcctgagtactaaacaagagactactcatcctgaagtcaaatcccataatcaaagtgccagagctttcagtcataatgaagttcttatgcagtatcagaaaacggaaactccagcacagtcatttggatataatgactgtgagaaatcattccttcaaaggggaggcctgattacacatagtagaccttacaaaggagaaaacccatctgtatataataaaaaaagaagagcaaccaatattgaaaaaaaacatacatgcaatgaatgtgggaaatctttctgcaggaaatcagtattgattctgcatcagggaattcactcagaagaaaaaccctatcaatgtcatcaatgtggaaatgcatttagaaggaaatcatatctcattgatcatcagaggactcacacaggagagaaaccctttgtttgcaatgaatgtggtaagtccttccgcctcaagacagccctcactgatcatcagagaacacacacaggggagaaatcgtatgaatgtctgcaatgtaggaatgccttcagattgaagtcacacctcattcgtcatcagagaactcacacgggagagaaaccatatgagtgtaatgactgtgggaagtccttccgccagaagacaacactctctctacatcagagaatccatacaggtgagaaaccctatatttgtaaagaatgtgggaagtcctttcaccagaaggcaaatcttactgtacatcagagaactcatacaggggaaaagccctatatttgtaatgaatgtgggaaatccttctcccagaagacaacccttgctcttcatgagaaaactcataatgaggagaaaccctatatttgtagtgaatgtggaaagtccttccgccagaagacaacccttgtagcacatcagagaacacatacaggggagaaatcttatgaatgtcctcactgtgggaaggcctttagaatgaagtcatacctcattgatcatcaccgaactcacacaggagagaaaccatatgaatgtaatgaatgtggtaaatcattcagtcaaaagacaaatctcaatctacatcagagaattcatacaggggagaaaccctatgtttgtaatgaatgtgggaagtcctttcgccagaaagcaaccctcactgtacatcagaaaatacataccggccagaaatcctatgaatgtcctcagtgtgggaaagcctttagcaggaagtcatatctcattcatcatcaaagaactcatacgggagagaaaccatataaatgtagtgaatgtggaaagtgcttccgccagaagacaaatcttattgtacatcagagaactcacacaggctggagtacaatggtgcgatctcggctgactgcaacctctgcctcccgggttcaagcaattctcctgcctcagcctcccaagtagctgggattacaggtacgtgccaccacacccggctaattttgtatttttagtagagaaggggtttcctatgttggccaggctggtctcacaaactcctgatctcaagtgattggcctgcctcagcctcccaaagtgctgggattacaggcatgagccactgcggttggccaagtagagcaatttttttttttttttgagacggagtctcggtctatcacccaggctggaatgcagtggcgtgatctcaactcactgcaagctccacctcctgggttcatgccattctcctgcctcagctcccagctacttggaggctgaggcaggagaatggcgtgaatcgggaggcggagcttgcagtgagccgagatcgcgccactgctctccagcgtgggtgacagagcgagactccgtatcaaaaaaaaaaaaaaaattgtaacaagccagtcagagaacattggaataaataaataatacttcaatgcaaagacatcaatatacatccataagcaacatgcctaaagagggaaccgtgatctcaccaaatgaacaaagcaagaaaccagtaactcatcctaacaagatggcaatatgtgagctgtctgataaaaattgaaaatagcagttctaaagaaacttagtgatttccgagataagactgaaaagcaattcagaaatgtatcaaagaaatttaacaaagaaattgaaaaaaataaaaaaacggaaatcaaatcttgcaactaaaaaatgaaatttctaaacagaattcattataggctctcaatggcagaatgggtccaatagaagaaagaatccatgagctccaaaataagttatttgaaaacacaaagtcagagggg

SEQ ID NO: 77447 - DNA, 490 bp, Homo sapiens
ccctataggcagtctttagctctcatggattgggagctgggaaaggaatgagaagacagaagtcagagacaagaagaggctaacatgactgataccactataatttagtggatcagtgtctttcaatgatgtgactgtggacttcactcaggaggagtggcagcacctggatcatgctcagaagactctatatatggatgtgatgttggaaaactattgccacctcatctctgtggggtgtcacatgaccaaacctgatgtgatcctcaagttggaacgaggagaagagccatggacatcatttgcaggtcatacctgcttgggtggagaggatggcctaactggatgtttatcctagcgtcaacccaccaaagatttggggaacatgtgagtcacattctctgggacattctactcccctttgattttgcatttccagacatttcagtggctaccacaaaaaataaaaagtatctgtggcaaaaaaaaa

SEQ ID NO: 77448 - DNA, 2962 bp, Homo sapiens
gattacagttccatccattctagggatcagtgtctttcaatgatgtgactgtggacttcactcaggaggagtggcagcacctggatcatgctcagaagactctatatatggatgtgatgttggaaaactattgccacctcatctctgtggggtgtcacatgaccaaacctgatgtgatcctcaagttggaacgaggagaagagccatggacatcatttgcaggtcatacctgcttggaagaaaactggaaagctgaagactttttagtgaaattcaaggaacaccaagagaagtattctagatcagttgtaagcatcaaccacaaaaaactggtgaaggagaagagtaaaatatatgaaaagacatttactctaggcaaaaaccctgtgaattcaaaaaatctacctcctgaatatgatactcatggaaggattttgaaaaatgtttcagaattaatcatcagtaatctaaatcctgcaagaaagagacttagtgagtataatggatatgggaaatcactcctgagtactaaacaagagactactcatcctgaagtcaaatcccataatcaaagtgccagagctttcagtcataatgaagttcttatgcagtatcagaaaacggaaactccagcacagtcatttggatataatgactgtgagaaatcattccttcaaaggggaggcctgattacacatagtagaccttacaaaggagaaaacccatctgtatataataaaagtgccagagctttcagtcataatgaagtttttatgcagtatcagaaaacggaaactccagcacagtcatttggatataatgactgtgagaaatcattccttcaaaggggaggcctgattacacatagtagaccttacaaaggagaaaacccatctgtatataataaaaaaagaagagcaaccaatattgaaaaaaaacatacatgcaatgaatgtgggaaatctttctgcaggaaatcagtattgattctgcatcagggaattcactcagaagaaaaaccctatcaatgtcatcaatgtggaaatgcatttagaaggaaatcatatctcattgatcatcagaggactcacacaggagagaaaccctttgtttgcaatgaatgtggtaagtccttccgcctcaagacagccctcactgatcatcagagaacacacacaggggagaaatcgtatgaatgtctgcaatgtaggaatgccttcagattgaagtcacacctcattcgtcatcagagaactcacacgggagagaaaccatatgagtgtaatgactgtgggaagtccttccgccagaagacaacactctctctacatcagagaatccatacaggtgagaaaccctatatttgtaaagaatgtgggaagtcctttcaccagaaggcaaatcttactgtacatcagagaactcatacaggggaaaagccctatatttgtaatgaatgtgggaaatccttctcccagaagacaacccttgctcttcatgagaaaactcataatgaggagaaaccctatatttgtagtgaatgtggaaagtccttccgccagaagacaacccttgtagcacatcagagaacacatacaggggagaaatcttatgaatgtcctcactgtgggaaggcctttagaatgaagtcatacctcattgatcatcaccgaactcacacaggagagaaaccatatgaatgtaatgaatgtggtaaatcattcagtcaaaagacaaatctcaatctacatcagagaattcatacaggggagaaaccctatgtttgtaatgaatgtgggaagtcctttcgccagaaagcaaccctcactgtacatcagaaaatacataccggccagaaatcctatgaatgtcctcagtgtgggaaagcctttagcaggaagtcatatctcattcatcatcaaagaactcatacgggagagaaaccatataaatgtagtgaatgtggaaagtgcttccgccagaagacaaatcttattgtacatcagagaactcacacaggctggagtacaatggtgcgatctcggctgactgcaacctctgcctcccgggttcaagcaattctcctgcctcagcctcccaagtagctgggattacaggtacgtgccaccacacccggctaattttgtatttttagtagagaaggggtttcctatgttggccaggctggtctcacaaactcctgatctcaagtgattggcctgcctcagcctcccaaagtgctgggattacaggcatgagccactgcggttggccaagtagagcaatttttttttttttttgagacggagtctcggtctatcacccaggctggaatgcagtggcgtgatctcaactcactgcaagctccacctcctgggttcatgccattctcctgcctcagctcccagctacttggaggctgaggcaggagaatggcgtgaatcgggaggcggagcttgcagtgagccgagatcgcgccactgctctccagcgtgggtgacagagcgagactccgtatcaaaaaaaaaaaaaaaattgtaacaagccagtcagagaacattggaataaataaataatacttcaatgcaaagacatcaatatacatccataagcaacatgcctaaagagggaaccgtgatctcaccaaatgaacaaagcaagaaaccagtaactcatcctaacaagatggcaatatgtgagctgtctgataaaaattgaaaatagcagttctaaagaaacttagtgatttccgagataagactgaaaagcaattcagaaatgtatcaaagaaatttaacaaagaaattgaaaaaaataaaaaaacggaaatcaaatcttgcaactaaaaaatgaaatttctaaacagaattcattataggctctcaatggcagaatgggtccaatagaagaaagaatccatgagctccaaaataagttatttgaaaacacaaagtcagagggg

SEQ ID NO: 77449 - DNA, 586 bp, Homo sapiens
aaatgactaaatatttttatgtttctgtcagtatatggaatttttcttaaaggcggtcaataaataaaattctgtttatttaaaagaaaaaaagaaacagatccagacctatttagaattaaacggccatgatatctgcagtttattatctgtggttcagcaatataataatatcagtagccacagtgaccacaactatatatatatatatatagttcatgaatctggcatgttttctataagtctgaaagaatttcaaaaaaaaaatgttgaggcagagcagctacctgaggtagccaccaaacctacgtgcagagatcagaagaacacaaatacagtaaacgtgctgagggccaggggcagctgttcagagttgctgttctctgctgtctgctttggtgttccagaagggtgtggccccagtattagcttggcatggtggcgtacacctgtagtcccagctgctccaagaggctgaggcaggaagatagtttgagcccatgagttcaaggctgtagtgaagtatgatcctgcactccactccagcctgggcaacatagtgagaccctgtctcttaaaaaaaaaa

SEQ ID NO: 77450 - DNA, 289 bp, Homo sapiens
ggcaggatcagatgatacaccgggatgtgttttcagtgtgatggaaagattgtttccagtgatcttagtgatggtaaagatagaggagaagacacctaagaaatgtgtttttctggagttatattagtatttttgttgccagtatctaatagtgtttccagaactattctggaagcaagccagatctcgtaaacaataattaacagagctttttacctagctttattcattagagtaactaacaggagtttctatataaacaactccaaaaccctagtggcttattaaa

SEQ ID NO: 77451 - DNA, 818 bp, Homo sapiens
  misc_feature (699)..(699): n is a, c, g, or t
gcgccgtgcgggatgctgaccgtacccaggcgggagccgccgcgccgccgcctggcgctgcacctgggcccggcccggccgccaattggacggctcggggcgaccccgctgtatcgcgagacgagattggcagcggcggggcctcaagtgcccccgcgctggctttgtatgcggagccgcctgccggtcctttaacaatgggcggcgcgagcgtccaggcgctgggctctagctgaggccggcgcttagcggcccactgtccgcagcatgagcggggccggcgtccgccgcacgacggcggggctggggctgtgagggccgcggttccggactcgagttgccgcgtcgggctgggcgcgccgccgggtcccatggagctggaggggcagtggtggcgaggacagctggccgccgatattcaccaagcgcttcgctacaaggagctgaagttgccctcctataaaggccagtcccctcagttaagtctcagacggtattttgctgacttgattgccattgtgagcaatcgcttcacactctgcccttctgcccgccatcttgctgtctatttactggacctgtttatggaccgctatgacatctctatccagcagctgcatttagttgcgctttcctgcctgcttctagcaagtaagtatgaacgaaacacgaagacagctgtgcctaagtctggagcangtcaacagcctgggtttgttgactaactattgaatctagtttttaccaaacacaaattgtgcctacatattggacactcattatctcagaaacctttcaaggggaacctctggcttcca

SEQ ID NO: 77452 - DNA, 2139 bp, Homo sapiens
agcggggctggccgctccagcctcccggcccgcttgctggctgcccagctgctaggacagtttgcagagcagtggcgtgcggagcggcggcggaccacctccaggggctaagtgatggatcttgtactccgtgttgcagattactatttttttacaccatacgtgtatccagccacatggccagaagatgacatcttccgacaagctattagtcttctgattgtaacaaatgttggtgcttacatcctttatttcttctgtgcaacactgagctattattttgtcttcgatcatgcattaatgaaacatccacaatttttaaagaatcaagtccgtcgagagattaagtttactgtccaggcattgccatggataagtattcttactgttgcactgttcttgctggagataagaggttacagcaaattacatgatgacctaggagagtttccatatggattgtttgaacttgtcgttagtataatatctttcctctttttcactgacatgttcatctactggattcacagaggccttcatcatagactggtatataagcgcctacataaacctcaccatatttggaagattcctactccatttgcaagtcatgcttttcaccctattgatggctttcttcagagtctaccttaccatatatacccttttatctttccattacacaaggtggtttatttaagtctgtacatcttggttaatatctggacaatttccattcatgacggtgattttcgtgtcccccaaatcttacagccatttattaatggctcagctcatcatacagaccaccatatgttctttgactataattatggacaatatttcactttgtgggataggattggcggctcattcaaaaatccttcatcctttgaggggaagggaccgctcagttatgtgaaggagatgacagagggaaagcgcagcagccattcaggaaatggctgtaagaatgaaaaattattcaatggagagtttacaaagactgaatagattattgcccagttattcttaagtaaggacaaagaaggaaatatcatcgtatttcttttttttaataaggaaaaaataatctccatacagtcaagatacatagtaaatggtatcatttggaaatcagcatcgtgggcactgctgaggaatgatcctagtggtaggtcagaagaagatgctgtgaacaccaggactttaatcttatgcttaaaatgccagatgttgttcgggggacaacttgtatctttctagcagcagatctgtagtttgtatagcctcaacaacaattttaaataagatggagaataaattattgaggggactaggctatatgcatttgccttcatccacccatgtttattaagaatcattgtgcttaataataccaagactaagcaccataaccaagaaatactaatgtaaagattgtttcttgtttcaggaatggttaattcttcaacgttggtatgataatgataacttgttttgacttgaataaagtactacatcagtgtggaaaaaaattctgatacattagcagctatgtaaatgacctaattgatagcaggtgtaataagactatcgtcttcctacacataggaggctcattctctggacacactatcacctattacattttactgattaacaaataaattggaatttaaaaatatcgatatcaccatgatttaatccagatctgggattatgtagctaaacattgtgatgattattatttaaaaccattatttaataagagtaaaaatatgtgaatctggatatatttaaaaaaagaaatttgatgcccagataatatattaggcactactgattttttagttaaattgatgcactacacttttgatgtttgaagttacaaacctgtaatttttttgtaaaggaaataattgccaaatacctaggcccattgctgacgattagttctaaaatcttattcctcctcttctcccctcacttttccctacttcctctgcaaaaagatttaacaaatacattcataaggaaatgtgtgttgtaacaaatatattgcaaaaacatagtttgtaaaggcattctataagctatttatgtaaaatcaataaaagttgatcataattaaactgt

SEQ ID NO: 77453 - DNA, 2246 bp, Homo sapiens
gggccggggggcgatggaataaaagaagatggagagacttcagcgcctgggactcgggtgggcgaggcggaaggtgtcctcgcagcacggcttttctccgcgccgcggttggttagcgagtgccctctgggtgctaggcgttgggcggatggtaggatcgcggtagcatacggatccgagtcctgcgccgagtgagaggagaggctggcaggggctaagtgatggatcttgtactccgtgttgcagattactatttttttacaccatacgtgtatccagccacatggccagaagatgacatcttccgacaagctattagtcttctgattgtaacaaatgttggtgcttacatcctttatttcttctgtgcaacactgagctattattttgtcttcgatcatgcattaatgaaacatccacaatttttaaagaatcaagtccgtcgagagattaagtttactgtccaggcattgccatggataagtattcttactgttgcactgttcttgctggagataagaggttacagcaaattacatgatgacctaggagagtttccatatggattgtttgaacttgtcgttagtataatatctttcctctttttcactgacatgttcatctactggattcacagaggccttcatcatagactggtatataagcgcctacataaacctcaccatatttggaagattcctactccatttgcaagtcatgcttttcaccctattgatggctttcttcagagtctaccttaccatatatacccttttatctttccattacacaaggtggtttatttaagtctgtacatcttggttaatatctggacaatttccattcatgacggtgattttcgtgtcccccaaatcttacagccatttattaatggctcagctcatcatacagaccaccatatgttctttgactataattatggacaatatttcactttgtgggataggattggcggctcattcaaaaatccttcatcctttgaggggaagggaccgctcagttatgtgaaggagatgacagagggaaagcgcagcagccattcaggaaatggctgtaagaatgaaaaattattcaatggagagtttacaaagactgaatagattattgcccagttattcttaagtaaggacaaagaaggaaatatcatcgtatttcttttttttaataaggaaaaaataatctccatacagtcaagatacatagtaaatggtatcatttggaaatcagcatcgtgggcactgctgaggaatgatcctagtggtaggtcagaagaagatgctgtgaacaccaggactttaatcttatgcttaaaatgccagatgttgttcgggggacaacttgtatctttctagcagcagatctgtagtttgtatagcctcaacaacaattttaaataagatggagaataaattattgaggggactaggctatatgcatttgccttcatccacccatgtttattaagaatcattgtgcttaataataccaagactaagcaccataaccaagaaatactaatgtaaagattgtttcttgtttcaggaatggttaattcttcaacgttggtatgataatgataacttgttttgacttgaataaagtactacatcagtgtggaaaaaaattctgatacattagcagctatgtaaatgacctaattgatagcaggtgtaataagactatcgtcttcctacacataggaggctcattctctggacacactatcacctattacattttactgattaacaaataaattggaatttaaaaatatcgatatcaccatgatttaatccagatctgggattatgtagctaaacattgtgatgattattatttaaaaccattatttaataagagtaaaaatatgtgaatctggatatatttaaaaaaagaaatttgatgcccagataatatattaggcactactgattttttagttaaattgatgcactacacttttgatgtttgaagttacaaacctgtaatttttttgtaaaggaaataattgccaaatacctaggcccattgctgacgattagttctaaaatcttattcctcctcttctcccctcacttttccctacttcctctgcaaaaagatttaacaaatacattcataaggaaatgtgtgttgtaacaaatatattgcaaaaacatagtttgtaaaggcattctataagctatttatgtaaaatcaataaaagttgatcataattaaactgt

SEQ ID NO: 77454 - DNA, 2663 bp, Homo sapiens
tttggcctggaggcaatcggcacgaggggcgtgcggagcggcggcggaccacctccaggggctaagtgatggatcttgtactccgtgttgcagattactatttttttacaccatacgtgtatccagccacatggccagaagatgacatcttccgacaagctattagtcttctgattgtaacaaatgttggtgcttacatcctttatttcttctgtgcaacactgagctattattttgtcttcgatcatgcattaatgaaacatccacaatttttaaagaatcaagtccgtcgagagattaagtttactgtccaggcattgccatggataagtattcttactgttgcactgttcttgctggagataagaggttacagcaaattacatgatgacctaggagagtttccatatggattgtttgaacttgtcgttagtataatatctttcctctttttcactgacatgttcatctactggattcacagaggccttcatcatagactggtatataaggtaaagtcatttgtggtgaaaagagaaaaaaggttacacatttcagcaatgtatgattataaattctgttctctatttccaagaatttcctctacccatattaaatgtctaagtagccataatcataacaggtacagggtgcattttgttcatattcttctttatgggtctaaggggctgtcttaaaattcgtctgttccggtaacaggtacacatggacttacagagggaacaatagacattagagactccagaaggtgggaggatgggagaggagtgagggatgagacgctccctattgggtacaatgtgcactcttcaggtgctaggtacactaaaagccagacttcaccactgtgcagtatatccatggaacaccactgcacttgtactcataaatccatataaaattatactgttttagggcgaagaaggacattttgtagaataaataattttgctgatctctacaggatttgttaggttgtttccaacatgagtgtgagaagctaagttgaatgttgcacggggtaaagtttgcagtgctaattgtgtccttttctcctgcagcgcctacataaacctcaccatatttggaagattcctactccatttgcaagtcatgcttttcaccctattgatggctttcttcagagtctaccttaccatatatacccttttatctttccattacacaaggtggtttatttaagtctgtacatcttggttaatatctggacaatttccattcatgacggtgattttcgtgtcccccaaatcttacagccatttattaatggctcagctcatcatacagaccaccatatgttctttgactataattatggacaatatttcactttgtgggataggattggcggctcattcaaaaatccttcatcctttgaggggaagggaccgctcagttatgtgaaggagatgacagagggaaagcgcagcagccattcaggaaatggctgtaagaatgaaaaattattcaatggagagtttacaaagactgaatagattattgcccagttattcttaagtaaggacaaagaaggaaatatcatcgtatttcttttttttaataaggaaaaaataatctccatacagtcaagatacatagtaaatggtatcatttggaaatcagcatcgtgggcactgctgaggaatgatcctagtggtaggtcagaagaagatgctgtgaacaccaggactttaatcttatgcttaaaatgccagatgttgttcgggggacaacttgtatctttctagcagcagatctgtagtttgtatagcctcaacaacaattttaaataagatggagaataaattattgaggggactaggctatatgcatttgccttcatccacccatgtttattaagaatcattgtgcttaataataccaagactaagcaccataaccaagaaatactaatgtaaagattgtttcttgtttcaggaatggttaattcttcaacgttggtatgataatgataacttgttttgacttgaataaagtactacatcagtgtggaaaaaaattctgatacattagcagctatgtaaatgacctaattgatagcaggtgtaataagactatcgtcttcctacacataggaggctcattctctggacacactatcacctattacattttactgattaacaaataaattggaatttaaaaatatcgatatcaccatgatttaatccagatctgggattatgtagctaaacattgtgatgattattatttaaaaccattatttaataagagtaaaaatatgtgaatctggatatatttaaaaaaagaaatttgatgcccagataatatattaggcactactgattttttagttaaattgatgcactacacttttgatgtttgaagttacaaacctgtaatttttttgtaaaggaaataattgccaaatacctaggcccattgctgacgattagttctaaaatcttattcctcctcttctcccctcacttttccctacttcctctgcaaaaagatttaacaaatacattcataaggaaatgtgtgttgtaacaaatatattgcaaaaacatagtttgtaaaggcattctataagctatttatgtaaaatcaataaaagttgatcataattaaactgt

SEQ ID NO: 77455 - DNA, 889 bp, Homo sapiens
agcggggctggccgctccagcctcccggcccgcttgctggctgcccagctgctaggacagtttgcagagcagtggcgtgcggagcggcggcggaccacctccaggggctaagtgatggatcttgtactccgtgttgcagattactatttttttacaccatacgtgtatccagccacatggccagaagatgacatcttccgacaagctattagtcttctgattgtaacaaatgttggtgcttacatcctttatttcttctgtgcaacactgagctattattttgtcttcgatcatgcattaatgaaacatccacaatttttaaagaatcaagtccgtcgagagattaagtttactgtccaggcattgccatggataagtattcttactgttgcactgttcttgctggagataagaggttacagcaaattacatgatgacctaggagagtttccatatggtaagtaaataacacgagtgtcaggaagagagtagtctaagcacaggttagtttccttaaaaaaacaagtctgcccttttttttttcatcttttaaaataattacaaattattcagttgttttttaatgttctattttcatgtgttcatgtcttgccacatgtgcatttctttagtttttctatcaatctgaaagtctgctgtagatgagattgtgtctggcggaagattggagtgatcagagatgggtccttgcatttgttttctattaattattgaattcaaccttctaaaaaaaacttgagtagcttatgtcattgctgaaagttaaaaacagatttttaaaatgcattattctgcttcttagaaactgtaactcttctggcatacaaccacccacttttctgtgcctgtatacttcattgtttacatt

SEQ ID NO: 77456 - DNA, 2709 bp, Homo sapiens
agcggggctggccgctccagcctcccggcccgcttgctggctgcccagctgctaggacagtttgcagagcagtggcgtgcggagcggcggcggaccacctccaggggctaagtgatggatcttgtactccgtgttgcagattactatttttttacaccatacgtgtatccagccacatggccagaagatgacatcttccgacaagctattagtcttctgattgtaacaaatgttggtgcttacatcctttatttcttctgtgcaacactgagctattattttgtcttcgatcatgcattaatgaaacatccacaatttttaaagaatcaagtccgtcgagagattaagtttactgtccaggcattgccatggataagtattcttactgttgcactgttcttgctggagataagaggttacagcaaattacatgatgacctaggagagtttccatatggattgtttgaacttgtcgttagtataatatctttcctctttttcactgacatgttcatctactggattcacagaggccttcatcatagactggtatataaggtaaagtcatttgtggtgaaaagagaaaaaaggttacacatttcagcaatgtatgattataaattctgttctctatttccaagaatttcctctacccatattaaatgtctaagtagccataatcataacaggtacagggtgcattttgttcatattcttctttatgggtctaaggggctgtcttaaaattcgtctgttccggtaacaggtacacatggacttacagagggaacaatagacattagagactccagaaggtgggaggatgggagaggagtgagggatgagacgctccctattgggtacaatgtgcactcttcaggtgctaggtacactaaaagccagacttcaccactgtgcagtatatccatggaacaccactgcacttgtactcataaatccatataaaattatactgttttagggcgaagaaggacattttgtagaataaataattttgctgatctctacaggatttgttaggttgtttccaacatgagtgtgagaagctaagttgaatgttgcacggggtaaagtttgcagtgctaattgtgtccttttctcctgcagcgcctacataaacctcaccatatttggaagattcctactccatttgcaagtcatgcttttcaccctattgatggctttcttcagagtctaccttaccatatatacccttttatctttccattacacaaggtggtttatttaagtctgtacatcttggttaatatctggacaatttccattcatgacggtgattttcgtgtcccccaaatcttacagccatttattaatggctcagctcatcatacagaccaccatatgttctttgactataattatggacaatatttcactttgtgggataggattggcggctcattcaaaaatccttcatcctttgaggggaagggaccgctcagttatgtgaaggagatgacagagggaaagcgcagcagccattcaggaaatggctgtaagaatgaaaaattattcaatggagagtttacaaagactgaatagattattgcccagttattcttaagtaaggacaaagaaggaaatatcatcgtatttcttttttttaataaggaaaaaataatctccatacagtcaagatacatagtaaatggtatcatttggaaatcagcatcgtgggcactgctgaggaatgatcctagtggtaggtcagaagaagatgctgtgaacaccaggactttaatcttatgcttaaaatgccagatgttgttcgggggacaacttgtatctttctagcagcagatctgtagtttgtatagcctcaacaacaattttaaataagatggagaataaattattgaggggactaggctatatgcatttgccttcatccacccatgtttattaagaatcattgtgcttaataataccaagactaagcaccataaccaagaaatactaatgtaaagattgtttcttgtttcaggaatggttaattcttcaacgttggtatgataatgataacttgttttgacttgaataaagtactacatcagtgtggaaaaaaattctgatacattagcagctatgtaaatgacctaattgatagcaggtgtaataagactatcgtcttcctacacataggaggctcattctctggacacactatcacctattacattttactgattaacaaataaattggaatttaaaaatatcgatatcaccatgatttaatccagatctgggattatgtagctaaacattgtgatgattattatttaaaaccattatttaataagagtaaaaatatgtgaatctggatatatttaaaaaaagaaatttgatgcccagataatatattaggcactactgattttttagttaaattgatgcactacacttttgatgtttgaagttacaaacctgtaatttttttgtaaaggaaataattgccaaatacctaggcccattgctgacgattagttctaaaatcttattcctcctcttctcccctcacttttccctacttcctctgcaaaaagatttaacaaatacattcataaggaaatgtgtgttgtaacaaatatattgcaaaaacatagtttgtaaaggcattctataagctatttatgtaaaatcaataaaagttgatcataattaaactgt

SEQ ID NO: 77457 - DNA, 2084 bp, Homo sapiens
agcggggctggccgctccagcctcccggcccgcttgctggctgcccagctgctaggacagtttgcagagcagtggcgtgcggagcggcggcggaccacctccaggggctaagtgatggatcttgtactccgtgttgcagattactatttttttacaccatacgtgtatccagccacatggccagaagatgacatcttccgacaagctattagtcttctgattgtaacaaatgttggtgcttacatcctttatttcttctgtgcaacactgagctattattttgtcttcgatcatgcattaatgaaacatccacaatttttaaagaatcaagtccgtcgagagattaagtttactgtccaggcattgccatggataagtattcttactgttgcactgttcttgctggagataagaggttacagcaaattacatgatgacctaggagagtttccatatggattgtttgaacttgtcgttagtataatatctttcctctttttcactgacatgttcatctactggattcacagaggccttcatcatagactggtatataagcgcctacataaacctcaccatatttggaagattcctactccatttgcaagtcatgcttttcaccctattgatggctttcttcagagtctaccttaccatatatacccttttatctttccattacacaaggtggtttatttaagtctgtacatcttggttaatatctggacaatttccattcatgacggtgattttcgtgtcccccaaatcttacagccatttattaatggctcagctcatcatacagaccaccatatgttctttgactataattatggacaatatttcactttgtgggataggattggcggctcattcaaaaatccttcatcctttgaggggaagggaccgctcagttatgtgaaggagatgacagagggaaagcgcagcagccattcaggaaatggctgtaagaatgaaaaattattcaatggagagtttacaaagactgaatagattattgcccagttattcttaagtaaggacaaagaaggaaatatcatcgtatttcttttttttaataaggaacatcgtgggcactgctgaggaatgatcctagtggtaggtcagaagaagatgctgtgaacaccaggactttaatcttatgcttaaaatgccagatgttgttcgggggacaacttgtatctttctagcagcagatctgtagtttgtatagcctcaacaacaattttaaataagatggagaataaattattgaggggactaggctatatgcatttgccttcatccacccatgtttattaagaatcattgtgcttaataataccaagactaagcaccataaccaagaaatactaatgtaaagattgtttcttgtttcaggaatggttaattcttcaacgttggtatgataatgataacttgttttgacttgaataaagtactacatcagtgtggaaaaaaattctgatacattagcagctatgtaaatgacctaattgatagcaggtgtaataagactatcgtcttcctacacataggaggctcattctctggacacactatcacctattacattttactgattaacaaataaattggaatttaaaaatatcgatatcaccatgatttaatccagatctgggattatgtagctaaacattgtgatgattattatttaaaaccattatttaataagagtaaaaatatgtgaatctggatatatttaaaaaaagaaatttgatgcccagataatatattaggcactactgattttttagttaaattgatgcactacacttttgatgtttgaagttacaaacctgtaatttttttgtaaaggaaataattgccaaatacctaggcccattgctgacgattagttctaaaatcttattcctcctcttctcccctcacttttccctacttcctctgcaaaaagatttaacaaatacattcataaggaaatgtgtgttgtaacaaatatattgcaaaaacatagtttgtaaaggcattctataagctatttatgtaaaatcaataaaagttgatcataattaaactgt

SEQ ID NO: 77458 - DNA, 2020 bp, Homo sapiens
tttggcctggaggcaatcggcacgaggggcgtgcggagcggcggcggaccacctccaggggctaagtgatggatcttgtactccgtgttgcagattactatttttttacaccatacgtgtatccagccacatggccagaagatgacatcttccgacaagctattagtcttctgattgtaacaaatgttggtgcttacatcctttatttcttctgtgcaacactgagctattattttgtcttcgatcatgcattaatgaaacatccacaatttttaaagaatcaagtccgtcgagagattaagtttactgtccaggcattgccatggataagtattcttactgttgcactgttcttgctggagataagaggttacagcaaattacatgatgacctaggagagtttccatatgaggccttcatcatagactggtatataagcgcctacataaacctcaccatatttggaagattcctactccatttgcaagtcatgcttttcaccctattgatggctttcttcagagtctaccttaccatatatacccttttatctttccattacacaaggtggtttatttaagtctgtacatcttggttaatatctggacaatttccattcatgacggtgattttcgtgtcccccaaatcttacagccatttattaatggctcagctcatcatacagaccaccatatgttctttgactataattatggacaatatttcactttgtgggataggattggcggctcattcaaaaatccttcatcctttgaggggaagggaccgctcagttatgtgaaggagatgacagagggaaagcgcagcagccattcaggaaatggctgtaagaatgaaaaattattcaatggagagtttacaaagactgaatagattattgcccagttattcttaagtaaggacaaagaaggaaatatcatcgtatttcttttttttaataaggaaaaaataatctccatacagtcaagatacatagtaaatggtatcatttggaaatcagcatcgtgggcactgctgaggaatgatcctagtggtaggtcagaagaagatgctgtgaacaccaggactttaatcttatgcttaaaatgccagatgttgttcgggggacaacttgtatctttctagcagcagatctgtagtttgtatagcctcaacaacaattttaaataagatggagaataaattattgaggggactaggctatatgcatttgccttcatccacccatgtttattaagaatcattgtgcttaataataccaagactaagcaccataaccaagaaatactaatgtaaagattgtttcttgtttcaggaatggttaattcttcaacgttggtatgataatgataacttgttttgacttgaataaagtactacatcagtgtggaaaaaaattctgatacattagcagctatgtaaatgacctaattgatagcaggtgtaataagactatcgtcttcctacacataggaggctcattctctggacacactatcacctattacattttactgattaacaaataaattggaatttaaaaatatcgatatcaccatgatttaatccagatctgggattatgtagctaaacattgtgatgattattatttaaaaccattatttaataagagtaaaaatatgtgaatctggatatatttaaaaaaagaaatttgatgcccagataatatattaggcactactgattttttagttaaattgatgcactacacttttgatgtttgaagttacaaacctgtaatttttttgtaaaggaaataattgccaaatacctaggcccattgctgacgattagttctaaaatcttattcctcctcttctcccctcacttttccctacttcctctgcaaaaagatttaacaaatacattcataaggaaatgtgtgttgtaacaaatatattgcaaaaacatagtttgtaaaggcattctataagctatttatgtaaaatcaataaaagttgatcataattaaactgt

SEQ ID NO: 77459 - DNA, 2086 bp, Homo sapiens
agcggggctggccgctccagcctcccggcccgcttgctggctgcccagctgctaggacagtttgcagagcagtggcgtgcggagcggcggcggaccacctccaggggctaagtgatggatcttgtactccgtgttgcagattactatttttttacaccatacgtgtatccagccacatggccagaagatgacatcttccgacaagctattagtcttctgattgtaacaaatgttggtgcttacatcctttatttcttctgtgcaacactgagctattattttgtcttcgatcatgcattaatgaaacatccacaatttttaaagaatcaagtccgtcgagagattaagtttactgtccaggcattgccatggataagtattcttactgttgcactgttcttgctggagataagaggttacagcaaattacatgatgacctaggagagtttccatatggattgtttgaacttgtcgttagtataatatctttcctctttttcactgacatgttcatctactggattcacagaggccttcatcatagactggtatataagcgcctacataaacctcaccatatttggaagattcctactccatttgcaagtcatgcttttcaccctattgatggctttcttcagagtctaccttaccatatatacccttttatctttccattacacaaggtggtttatttaagtctgtacatcttggttaatatctggacaatttccattcatgacggtgattttcgtgtcccccaaatcttacagccatttattaatggctcagctcatcatacagaccaccatatgttctttgactataattatggacaatatttcactttgtgggataggattggcggctcattcaaaaatccttcatcctttgaggggaagggaccgctcagttatgtgaaggagatgacagagggaaagcgcagcagccattcaggaaatggctgtaagaatgaaaaattattcaatggagagtttacaaagactgaatagattattgcccagttattcttaagtaaggacaaagaaggaaatatcatcgtatttcttttttttaataaggaaaaaataatctccatacagtcaagatacatagtaaatggtatcatttggaaatcagcatcgtgggcactgctgaggaatgatcctagtggtaggtcagaagaagatgctgtgaacaccaggactttaatcttatgcttgtagtttgtatagcctcaacaacaattttaaataagatggagaataaattattgaggggactaggctatatgcatttgccttcatccacccatgtttattaagaatcattgtgcttaataataccaagactaagcaccataaccaagaaatactaatgtaaagattgtttcttgtttcaggaatggttaattcttcaacgttggtatgataatgataacttgttttgacttgaataaagtactacatcagtgtggaaaaaaattctgatacattagcagctatgtaaatgacctaattgatagcaggtgtaataagactatcgtcttcctacacataggaggctcattctctggacacactatcacctattacattttactgattaacaaataaattggaatttaaaaatatcgatatcaccatgatttaatccagatctgggattatgtagctaaacattgtgatgattattatttaaaaccattatttaataagagtaaaaatatgtgaatctggatatatttaaaaaaagaaatttgatgcccagataatatattaggcactactgattttttagttaaattgatgcactacacttttgatgtttgaagttacaaacctgtaatttttttgtaaaggaaataattgccaaatacctaggcccattgctgacgattagttctaaaatcttattcctcctcttctcccctcacttttccctacttcctctgcaaaaagatttaacaaatacattcataaggaaatgtgtgttgtaacaaatatattgcaaaaacatagtttgtaaaggcattctataagctatttatgtaaaatcaataaaagttgatcataattaaactgt

SEQ ID NO: 77460 - DNA, 2170 bp, Homo sapiens
agcggggctggccgctccagcctcccggcccgcttgctggctgcccagctgctaggacagtttgcagagcagtggcgtgcggagcggcggcggaccacctccaggggctaagtgatggatcttgtactccgtgttgcagattactatttttttacaccatacgtgtatccagccacatggccagaagatgacatcttccgacaagctattagtcttctgattgtaacaaatgttggtgcttacatcctttatttcttctgtgcaacactgagctattattttgtcttcgatcatgcattaatgaaacatccacaatttttaaagaatcaagtccgtcgagagattaagtttactgtccaggcattgccatggataagtattcttactgttgcactgttcttgctggagataagaggttacagcaaattacatgatgacctaggagagtttccatatggattgtttgaacttgtcgttagtataatatctttcctctttttcactgacatgttcatctactggattcacagaggccttcatcatagactggtatataagcgcctacataaacctcaccatatttggaagattcctactccatttgcaagtcatgcttttcaccctattgatggctttcttcagagtctaccttaccatatatacccttttatctttccattacacaaggtggtttatttaagtctgtacatcttggttaatatctggacaatttccattcatgacggtgattttcgtgtcccccaaatcttacagccatttattaatggctcagctcatcatacagaccaccatatgttctttgactataattatggacaatatttcactttgtgggataggattggcggctcattcaaaaatccttcatcctttgaggggaagggaccgctcagttatgtgaaggagatgacagagggaaagcgcagcagccattcaggaaatggctgtaagaatgaaaaattattcaatggagagtttacaaagactgaatagattattgcccagttattcttaagtaaggacaaagaaggaaatatcatcgtatttcttttttttaataaggaaaaaataatctccatacagtcaagatacatagtaaatggtatcatttggaaatcagcatcgtgggcactgctgaggaatgatcctagtggtaggtcagaagaagatgctgtgaacaccaggactttaatcttatgcttaaaatgccagatgttgttcgggggacaacttgtatctttctagcagcagatctgtagtttgtatagcctcaacaacaattttaaataagatggagaataaattattgaggggactaggctatatgcatttgccttcatccacccatgtttattaagaatcattgtgcttaataataccaagactaagcaccataaccaagaaatactaatgtaaagattgtttcttgtttcaggaatggttaattcttcaacgttggtatgataatgataacttgttttgacttgaataaagtactacatcagtgtggaaaaaaattctgatacattagcagctatgtaaatgacctaattgatagcaggtgtaataagactatcgtcttcctacacataggaggctcattctctggacacactatcacctattacattttactgattaacaaataaattggaatttaaaaatatcgatatcaccatgatttaatccagatctgggattatgtagctaaacattgtgatgattattatttaaaaccattatttaataagagtaaaaatatgtgaatctggatatatttaaaaaaagaaatttgatgcccagataatatattaggcactactgattttttagttaaattgatgcactacacttttgatgtttgaagttacaaacctgtaatttttttgtaaaggaaataattgccaaatacctaggcccattgctgacgattagttctaaaatcttattcctcctcttctcccctcacttttccctacttcctctgcaaaaagatttaacaaatacattcataaggaaatgtgtgttgtaacaaatatattgcaaaaacatagtttgtaaaggcattctataagctatttatgtaaaatcaataaaagttgatcataattaaactgtatcagttgagtattatagcagcaaaaaaaat

SEQ ID NO: 77461 - DNA, 2085 bp, Homo sapiens
agcggggctggccgctccagcctcccggcccgcttgctggctgcccagctgctaggacagtttgcagagcagtggcgtgcggagcggcggcggaccacctccaggggctaagtgatggatcttgtactccgtgttgcagattactatttttttacaccatacgtgtatccagccacatggccagaagatgacatcttccgacaagctattagtcttctgattgtaacaaatgttggtgcttacatcctttatttcttctgtgcaacactgagctattattttgtcttcgatcatgcattaatgaaacatccacaatttttaaagaatcaagtccgtcgagagattaagtttactgtccaggcattgccatggataagtattcttactgttgcactgttcttgctggagataagaggttacagcaaattacatgatgacctaggagagtttccatatggattgtttgaacttgtcgttagtataatatctttcctctttttcactgacatgttcatctactggattcacagaggccttcatcatagactggtatataagcgcctacataaacctcaccatatttggaagattcctactccatttgcaagtcatgcttttcaccctattgatggctttcttcagagtctaccttaccatatatacccttttatctttccattacacaaggtggtttatttaagtctgtacatcttggttaatatctggacaatttccattcatgacggtgattttcgtgtcccccaaatcttacagccatttattaatggctcagctcatcatacagaccaccatatgttctttgactataattatggacaatatttcactttgtgggataggattggcggctcattcaaaaatccttcatcctttgaggggaagggaccgctcagttatgtgaaggagatgacagagggaaagcgcagcagccattcaggaaatggctgtaagaatgaaaaattattcaatggagagtttacaaagactgaatagattattgcccagttattcttaagtaaggacaaagaaggaaatatcatcgtatttcttttttttaataaggaaaaaataatctccatacagtcaagatacatagtaaatggtatcatttggaaatcagcatcgtgggcactgctgaggaatgatcctagtggtaggtcagaagaagatgctgtgaacaccaggactttaatcttatgcttaaaatgccagatgttgttcgggggacaacttgtatctttctagcagcagatctgtagtttgtatagcctcaacaacaattttaaataagatggagaataaattattgaggggactaggctatatgcatttgccttcatccacccatgtttattaagaatcattgtgcttaataataccaagactaagcaccataaccaagaaatactaatgtaaagattgtttcttgtttcaggaatggttaattcttcaacgttggtatgataatgataacttgttttgacttgaataaagtactacatcagtgtggaaaaaaattctgatacattagcagctatgtaaatgacctaattgatagcaggtgtaataagactatcgtcttcctacacataggaggctcattctctggacacactatcacctattacattttactgattaacaaataaattggaatttaaaaatatcgatatcaccatgatttaatccagatctgggattatgtagctaaacattgtgatgattattatttaaaaccattatttaataagagtaaaaatatgtgaatctggatatatttaaaattgatgcactacacttttgatgtttgaagttacaaacctgtaatttttttgtaaaggaaataattgccaaatacctaggcccattgctgacgattagttctaaaatcttattcctcctcttctcccctcacttttccctacttcctctgcaaaaagatttaacaaatacattcataaggaaatgtgtgttgtaacaaatatattgcaaaaacatagtttgtaaaggcattctataagctatttatgtaaaatcaataaaagttgatcataattaaactgt

SEQ ID NO: 77462 - DNA, 1261 bp, Homo sapiens
cggacgcgtgggtcgcccacgcgtcggaccgctcagttatgtgaaggagatgacagagggaaagcgcagcagccattcaggaaatggctgtaagaatgaaaaattattcaatggagagtttacaaagactgaatagattattgcccagttattcttaagtaaggacaaagaaggaaatatcatcgtatttcttttttttaataaggaaaaaataatctccatacagtcaagatacatagtaaatggtatcatttggaaatcagcatcgtgggcactgctgaggaatgatcctagtggtaggtcagaagaagatgctgtgaacaccaggactttaatcttatgcttaaaatgccagatgttgttcgggggacaacttgtatctttctagcagcagatctgtagtttgtatagcctcaacaacaattttaaataagatggagaataaattattgaggggactaggctatatgcatttgccttcatccacccatgtttattaagaatcattgtgcttaataataccaagactaagcaccataaccaagaaatactaatgtaaagattgtttcttgtttcaggaatggttaattcttcaacgttggtatgataatgataacttgttttgacttgaataaagtactacatcagtgtggaaaaaaattctgatacattagcagctatgtaaatgacctaattgatagcaggtgtaataagactatcgtcttcctacacataggaggctcattctctggacacactatcacctattacattttactgattaacaaataaattggaatttaaaaatatcgatatcaccatgatttaatccagatctgggattatgtagctaaacattgtgatgattattatttaaaaccattatttaataagagtaaaaatatgtgaatctggatatatttaaaaaaagaaatttgatgcccagataatatattaggcactactgattttttagttaaattgatgcactacacttttgatgtttgaagttacaaacctgtaatttttttgtaaaggaaataattgccaaatacctaggcccattgctgacgattagttctaaaatcttattcctcctcttctcccctcacttttccctacttcctctgcaaaaagatttaacaaatacattcataaggaaatgtgtgttgtaacaaatatattgcaaaaacatagtttgtaaaggcattctataagctatttatgtaaaatcaataaaagttgatcataattaaactgt

SEQ ID NO: 77463 - DNA, 782 bp, Homo sapiens
gctgtaggaattcggctctaggaatcattgtgcttaataataccaagactaagcaccataaccaagaaatactaatgtaaagattgtttcttgtttcaggaatggttaattcttcaacgttggtatgataatgataacttgttttgacttgaataaagtactacatcagtgtggaaaaaaattctgatacattagcagctatgtaaatgacctaattgatagcaggtgtaataagactatcgtcttcctacacataggaggctcattctctggacacactatcacctattacattttactgattaacaaataaattggaatttaaaaatatcgatatcaccatgatttaatccagatctgggattatgtagctaaacattgtgatgattattatttaaaaccattatttaataagagtaaaaatatgtgaatctggatatatttaaaaaaagaaatttgatgcccagataatatattaggcactactgattttttagttaaattgatgcactacacttttgatgtttgaagttacaaacctgtaatttttttgtaaaggaaataattgccaaatacctaggcccattgctgacgattagttctaaaatcttattcctcctcttctcccctcacttttccctacttcctctgcaaaaagatttaacaaatacattcataaggaaatgtgtgttgtaacaaatatattgcaaaaacatagtttgtaaaggcattctataagctatttatgtaaaatcaataaaagttgatcataattaaactgt

SEQ ID NO: 77464 - DNA, 728 bp, Homo sapiens
acggatccgagtcctgcgccgagtgagaggagaggctggcaggtagcctggcatcccgaagactggcggcgagggctgggccgggggacctcggggcctggagggctgcgccacctgggagtccgggcggaggggccttccgctcgcgctgggagggatcgcggggccgatagggaggcctggacttgaaggagccgaccgtggacgggcttaaagaaaatgcagtgtttgatgttgggtgttgcagatctcttactcaagggaattctggtctggctgctgaacacgaatgctttacttttcccttcgttctgggagggtttttttcttttaaaggccagaagaatcaggctgaagaactggtcggtatcagaactcctgaccattgcaagcctctgttgctgcggcgtaattagaatgaagggacagcaatctggggctgaggagactgaaaggaaaagggaaataatctgttccttttgcatcataaaaggaaaaataatgtatactgacatccctgtgttacagcagagtagatttggaggtggtgtaagtgaagaaaacaagacctcagtacatagagtttccaaactggaaagtttgtggcagctcggtacttttagaggaaaccctctggaagttatttgtctttatatcactatcattttttaaagtttctaatgattgatacctagtaaataataactgatccttgatcatttacagag

SEQ ID NO: 77465 - DNA, 491 bp, Homo sapiens
gccccctcccctgtaggccccaccctgaatgtgacccgctgcaggtacagcccagactcaagtatgttgcattggtgctgcaatcagtctctaagaaaatgaatgaaaagagcaagaagtcggatcaaaaatacaagccaataacgactttacaagataaaacaagtaattttcaaaattgttggactgaaatgataataatatatacataaacaactctagatatggtctctcttccttttgtccctaaatgctacttttaaattttcttttctgagacccaacctgggcaagacagcaagactccatctctacaaaatgtaaaaatattagctgggcgcagtggcacatacacctgtagtcccagctactagggaggacgaggcgtaaggataccttgacaccaaaagttggaggccaccatgagctatgactgtgccactgcactccagcctagatgacaaaacaagaccttatctctccaaaaaaaa

SEQ ID NO: 77466 - DNA, 381 bp, Homo sapiens
gatgggaaatgtaactcctagctagccaggcacagcccaatcccagctgcatattatgtgtggaattaagtatgaatatttggtggacaactatttatgtctgccactacacttagataaggctccagtaagctgattgtgaggatttgaaaaactacgatgcatagtatcaacaaaattggcagcagtatgaacaattcaggcatgcaactactttttatgcagtaaagacaaaacaaaacatcaaaaatcaaagaaaccaaaacgtgttgagctatttcccattttatggtttagtttccgttttctgtttcttgctgcttgtgttttctttttgttttaagaaacattggaaatacaacctcaggctggcatattatg

SEQ ID NO: 77467 - DNA, 444 bp, Homo sapiens
ctagaagattggaactaagagactataaaatagaggcccccagcacaatgaaatcagtctgctataaaaggcgacacatgccagtttttcctccccaatggcagatgccacaccctaaagcagacagaaggcactgcagcctgtaggagaagcacaacacaaagccggcaggacttggttttgtcttttaaaccacggagaatgctaaaatacctttctaaagcatctttgctgaagataagaagtgcactcgaatttgctcaacttttcatacacacctcaggaaaacaaaataaaagcctgtttagtttcatttaaacatccagggcttaacaaacaaaacaccaattgtcaggggtctgttacaaagtgatgaaataggttcccattacacaaaagcacaatttcaaccacaggttcaaatttccattgtgttccttgcct

SEQ ID NO: 77468 - DNA, 510 bp, Homo sapiens
tattacatatgttttaatggacttttaaaacatgagaatgagaaaggagagaaatgtaaagcagatgagtctgtctaggtcaggatctggttaattctccctgtacctacacaaaagcaccaacccaaacagaaacaataaccaaactcaaattcttcagcctaaatgaggaaattcagtctggtcctaatcaagagagacagggaaagaccaaaaatgataaaggcaggaccaatgagtggaatttgtattgttttaaaatgacttttataatttctccaactccagttgaacaatgagaacacttggacacagggaggggaccatcacacaccggggcctgccagagggtgggggcaagggtagggagggcattaggacaaatacctaatgcatgcaggatttaaaacctagacaatgcattgatgggtgcattaaaccaccatggcacatgtatacctatgtaacaaacctgcacattctgcacttgtatcccagaatttaactaaa

SEQ ID NO: 77469 - DNA, 624 bp, Homo sapiens
tatttgtgtctaatgcatgttttaacatgatagacgtaatgcgttgtgtagctagttttctggaaaagttgatcttttaggaattgtttttcagatcttcaataaatttttttctttaaatttcaaagaaaaaaaataaaagcttaccatccataaattgtcaaattgcatattagctctggagaaactgagacagggtgaccacacagaagaaactagacaatctgaatttgacatgtggccttaaaaggctcctgaagagccatagaggaaagatattcataggtgacaaataatcattttactttttttttttttttttgagacagggtctcactctgtcacccaggctggagtgcagtggctcaatcatggctcactgcagcctcgacctcctgggctcaggcaatcctcccgcctcagcctcccaagtagctgggaccccaggtgtgcaccaccacaactgagcaatttttttgaaaaattatatgtagagatttctaaatacatttttatcagagagacactgtgtgccagccctgccttctaggaacaaagtctgatacaaccagacagttccagggtagtgagaacagcttccccagtctgctctgtggggagact

SEQ ID NO: 77470 - DNA, 552 bp, Homo sapiens
gggagattttccttcagacaattttctcagcctgattttgtcaggtatctaagttgaaccactttaaaaatgtagtaggtattaacaaaaaaaagagtggtcagccaagtgaccgaggtctgctattcggcattgctaagtcatgtctgactgtaggaagaataatacacagaggagagcaatctgcatacacgacaaaatagaatgaatactgaaaaatagcaaatgctgaaatatccttctgcagaatgagaaagaagagcagatgtaagacacaaacatcactttcaaaagataatcaagaacatgaaagatttgtggtattagtggcattattgacaataactttctgtacaaaccatttcttgttcaaattggtttaagtgctagatattaccaaaattatagcatcaggagacattcaaagggatcgtttaagggaaaagaagaaagcaaagcgcattaaaacaaaaaagatgagtatattagtttaattcaatgtaagcactgcttctgtatgataaaagcaacaaacagaaaaagaataacaac

SEQ ID NO: 77471 - DNA, 844 bp, Homo sapiens
atctctgaactgaaggctggaaataaagactgcttccttgggtcaagtgatcctcaggcttgaatcatccaggcaagagtgggtgttccattctcattgatcatcaaatagcagtttctgactagttttagagttttccaattttcttagtccgtgtccttggtgttaattaacaagagcagtttttacagattcacatcaatatagaaaaatgtaaaaagaaagttttgactgaagcaggaagagacaatagatgtgaaattcttttttgttgttgttgtctttttttttttgagacagggtctcactctgttgcccaggctggagtgcaatggcgtgatcatagctcactgcagcctcaacctcctgggcttaaacaatcctcctgcctcagcctcctgaatagctgagactacaggtgtgcactaccacaccaagataattaataggtgtgacattccaaaataagttgtcagagcaagaagcaaatcttaaaaggaaatatcctagccccttggtgactcttaaaagtgcctcacccaaaataggatcataaaagggcagaggaagtggagttcaggaaagaatctatgaagatgttttctctgaagaaagcaattctgttactcctacttctttgagacctttctccttaaactcactagagaggcagtgtcagtgaggcagaccatgaaggcaacttgatttgtgtcccctggtatttggagacaaatctcaagtggagaggctgaagatactggcttgaggcagcagtggggcagtggtggagagagagaacactgaagaccagtctgcacacagccagctgcacttttaccaacca

SEQ ID NO: 77472 - DNA, 1275 bp, Homo sapiens
acctgccttggcctcccaaagtgctgggattacaggtgtgagctaccgtgcccagcctttttttaatttttaatttttattgttttttaccttcaacaaactcacttttactctttacattctttatgtaactctactaccttttccatctgattgaattgctacagatggtgattgatactaataattttggtgtttgtgttcttgaagatccattttttttctttaaatgtatatgtcacggtgtgagaataatgttttctgccattctttctgttaaatgtggggttcagttttccggaagcagggggaatgtctcttgtaggtatctttgttctagcagtggtgtaggttctgcttagcattccatcattcataggaaccgggacacatagattttggtcattatattattcaccttggcctgccataacagaataccactgactacgtggcttaaacagcagaatattttacagttcttggaggctggaaatccgacataaagatgctggcaggtttggtttctggtgagaatcttttcctggtttgccgacagctgccttcttctggtctcacatggcttttgtgctatgcatgcacattcctggtgtctcttcctcttataaggacaccaattctattggattaggttcccactttatgacttcatttaaccataattgcctccttcaaggccctgtatccaaatacaattacactggggttagggcttcaagatacgagttttaaggggcacaattcagtccataacaattgtatttcctgtttatagtgttttcattcatttgttcagccagcatttattgagtatctactatgagccagacagtagggcctggagagtaaaaagtcttcaaagagattactgtttattgtgagagacatagataaacagatgattgcaaaatagtgtaatgataccatgacagtggtggtatgaaagcatctgaaagaggcatataacccatactgggtagggggagtcacagagggcttcccagggaatatcattccagaactgagtcctgaaaaataaggggcagaagataaccaccaaatgaaatgcatgatccttggtttgatcctgaattaaacaaagtataattataggacattttggaataattgggaaaatttcaatagtgactacgtgttaagtaatactgtgtcagtgttatgtattttgggtgtataaacccatgttgttgaaaaaagtttaagaaattaaaaaaatattttacatgtgaaaat

SEQ ID NO: 77473 - DNA, 380 bp, Homo sapiens
aaggagtaatgtcaagaagcacgtttttaaaaaatactttaacaaattacacaaaattattaacaatgccacaaaatatatacaagaaaagccagttggggcaatgggatatggcaaagatgaaaagagaggccattattgaagtcttctaatgaaatgtcagttttctatagataaatgtatgagattgatactagatgagaaggaagttactgaagaagagcagttttagataccttttcatttcatttgccttaaaagtaagaaaactaggagaaaacattagttgtgtagtcatttgataaaccacccctgtaattatgcctctccaggcaaacgtgttacattttctcagtggtaatttatgtagagggtatgcc

SEQ ID NO: 77474 - DNA, 643 bp, Homo sapiens
agagcacatgagcttcataccctgtgctccagctgtgctctcttgcttccagctcttaactttgccccattatttcttggctgggaatgccctttttcgaccctgtgcccccctaatattttctgcacgtggcttacagctacttattctttaagattagaagcccaaagagttactaccactactatgtgttcccattggttatctcaatcataaagacaatagcaattaaggattgcctgctctgtatcaacctcctttttttggtgccccacttaaatattttctaattcctaccttttcttttagccactgatgtggggaatctgttctatgcagacttgaccaacttctatgttgggtgtaactaggccagtacctaggtgggaggtctaagctatggacttcttcactccctggccttaggccttctcttttaatacttgcccctaattttttgtttcaagtgtggcaatttacttggtctgaagtagaatcctactaataaccagagagctgggttgtctgggaaaaaaaatagttgaccttataactaggtggagcttgccagaaggccaagtccactcccaaccatggccttttattcccacaacactctgtcagatctccacttacggctcag

SEQ ID NO: 77475 - DNA, 1197 bp, Homo sapiens
tacctatggcagctgtgttactcttgctacatttcaaattccttgggtaggatgacaccattgtagtttactggattctttcttctctgttttggtttgtgtgcttggtttttttggagagtgactggatgtgtctcctggtatataagccaacgtaaacagaactttcaatagctcatgcttaataaagacagaatggatgcgatcattctgttcaaattaaggtatcctatatgcctatgggttagattaaagggcattactctgatattaaccttgttttttcagtcgttcccagatttcctaaactttccagagaaaatggtcttctccctggctcagcaagaagatgaactttaaacactgagaaactggtcatctccctggctcaaccagaagatgaactttaaacactactctcaatgacttgatgttcccatcactactcctgtcataaagggaggggactcagatattgagaattttatgatagtgtgaactgtctggtatgtcatttaagtaagcccgttgctgaaatattttccatgttattagaaagagctgaagagagggattgagatggcttctttattttttgtcttttgggaattaaaggaacctggttcaacaagggcctacacctaagtctcttgttgtaccagagtacaatttaggactgctcctgaggaaggaattagctagaaatctagagagtaagggtaacagatttacatagaataacagcctcagtatttttggttcctctccagtaaagatcacaaagaatattgctaaatcgctaaaacacctttgcaataacgtaagggcttacaactatataccaatgtagctcagttactaaactggagtaaactaatttctcttgtgtagaaaaattggttggctgtggttttatagcagatctgcaattattaatagttatgccaataatcgtttaacagtgcatatgttaatatatatggaaagacaatgtgtatagacagatgtgtaaaattgaaaaataaacatataacaagagagaaacatctatcgaacagacaatatacatacacatcaaacacaacagcagttttagtgaccataatatttatttctcatttttacattgcttactttagtgacaactgaaaatgacagttggcaatgcagctaacagtttcaataaaagtataaaac

SEQ ID NO: 77476 - DNA, 834 bp, Homo sapiens
ctttagtagaaggataacatgacatagcaggaataatactgccttttctttctggcatggatcaagagaaaagaaaatacaagaaaacagacagaagcaaggcaaggtacttctatggaagggtgagccctcacagatggagcaatggggcgcgcacacctgaacaagggaggggaaggagttcttatccctgatgcatgtgacccctgctgctgtgtccttcccctattggctaaggttagaccacacagcctaaactaattccgattggctaattcaaagagagcgacgggggcttctgacagctttggagattgtgacattggaataaaggaaaaacgtacaggactcatgaagcgctgaaatgttcacaaatatcaagcaaaagtcaatgaaatttattttgagctatttacatcatttaataattgagcaaggtatactcctatgaacaaaatttggagcatgtttgtctctctctgcctggcgtcttcagaatttggaaactagttatggtttataatcagctatagaattttaacacgtgctctcaaatgcaagtttctgataactttggagattgtgacattggaataaaggaagagctggaatgttcatgaatatcaagcaaaagtcatggaaatttattttgagctatttacagcatttaataattgagcaaggtatactcctatgaacaaaatttggagcatgtttgtctctctctgtctgcctggcatctacagaatttggaaactagttgtgctgtactgcatgagaatgcctgcatttagtatgcgaactggaattggcaaaggacgatggctgctctcc

SEQ ID NO: 77477 - DNA, 343 bp, Homo sapiens
actatagtgaggattttaataatgacatgacttctcttttcattaattttgtccttcattctgaggtataaagatagtttaaaggtgagtttggagatgggtaaatgtgcaatatttgttagcttctgtcctaagaatatttggattcatgactagagctagttgattctattaccttttgagtgagaaacatctatcgaacagacaatatacatacacatcaaacacaacagcagttttagtgaccataatatttatttctcatttttacattgcttactttagtgacaactgaaaatgacagttggcaatgcagctaacagtttcaataaaagtataaaac

SEQ ID NO: 77478 - DNA, 1667 bp, Homo sapiens
ctttagtagaaggataacatgacatagcaggaataatactgccttttctttctggcatggatcaagagaaaagaaaatacaagaaaacagacagaagatcctatctgcgacaattaagagcactctaagaggaaaacacatcccaccacacaaggcaaggtacttctatggaagggtgagccctcacagatggagcaatggggcgcgcacacctgaacaagggaggggaaggagttcttatccctgatgcatgtgacccctgctgctgtgtccttcccctattggctaaggcttctgacagctttggagattgtgacattggaataaaggaaaaacgtacaggactcatgaagcgctgaaatgttcacaaatatcaagcaaaagtcaatgaaatttattttgagctatttacatcatttaataattgagcaaggtatactcctatgaacaaaatttggagcatgtttgtctctctctgcctggcgtcttcagaatttggaaactagttatggtttataatcagctatagaattttaacacgtgctctcaaatgcaagtttctgataactttggagattgtgacattggaataaaggaagagctggaatgttcatgaatatcaagcaaaagtcatggaaatttattttgagctatttacagcatttaataattgagcaaggtatactcctatgaacaaaatttggagcatgtttgtctctctctgtctgcctggcatctacagaatttggaaactagtttcgttcccagatttcctaaactttccagagaaaatggtcttctccctggctcagcaagaagatgaactttaaacactgagaaactggtcatctccctggctcaaccagaagatgaactttaaacactactctcaatgacttgatgttcccatcactactcctgtcataaagggaggggactcagatattgagaattttatgatagtgtgaactgtctggtatgtcatttaagtaagcccgttgctgaaatattttccatgttattagaaagagctgaagagagggattgagatggcttctttattttttgtcttttgggaattaaaggaacctggttcaacaagggcctacacctaagtctcttgttgtaccagagtacaatttaggactgctcctgaggaaggaattagctagaaatctagagagtaagggtaacagatttacatagaataacagcctcagtatttttggttcctctccagtaaagatcacaaagaatattgctaaatcgctaaaacacctttgcaataacgtaagggcttacaactatataccaatgtagctcagttactaaactggagtaaactaatttctcttgtgtagaaaaattggttggctgtggttttatagcagatctgcaattattaatagttatgccaataatcgtttaacagtgcatatgttaatatatatggaaagacaatgtgtatagacagatgtgtaaaattgaaaaataaacatataacaagagagaaacatctatcgaacagacaatatacatacacatcaaacacaacagcagttttagtgaccataatatttatttctcatttttacattgcttactttagtgacaactgaaaatgacagttggcaatgcagctaacagtttcaataaaagtataaaac

SEQ ID NO: 77479 - DNA, 1671 bp, Homo sapiens
ctttagtagaaggataacatgacatagcaggaataatactgccttttctttctggcatggatcaagagaaaagaaaatacaagaaaacagacagaagcaaggcaaggtacttctatggaagggtgagccctcacagatggagcaatggggcgcgcacacctgaacaagggaggggaaggagttcttatccctgatgcatgtgacccctgctgctgtgtccttcccctattggctaaggttagaccacacagcctaaactaattccgattggctaattcaaagagagcgacgggggcttctgacagctttggagattgtgacattggaataaaggaaaaacgtacaggactcatgaagcgctgaaatgttcacaaatatcaagcaaaagtcaatgaaatttattttgagctatttacatcatttaataattgagcaaggtatactcctatgaacaaaatttggagcatgtttgtctctctctgcctggcgtcttcagaatttggaaactagttatggtttataatcagctatagaattttaacacgtgctctcaaatgcaagtttctgataactttggagattgtgacattggaataaaggaagagctggaatgttcatgaatatcaagcaaaagtcatggaaatttattttgagctatttacagcatttaataattgagcaaggtatactcctatgaacaaaatttggagcatgtttgtctctctctgtctgcctggcatctacagaatttggaaactagtttcgttcccagatttcctaaactttccagagaaaatggtcttctccctggctcagcaagaagatgaactttaaacactgagaaactggtcatctccctggctcaaccagaagatgaactttaaacactactctcaatgacttgatgttcccatcactactcctgtcataaagggaggggactcagatattgagaattttatgatagtgtgaactgtctggtatgtcatttaagtaagcccgttgctgaaatattttccatgttattagaaagagctgaagagagggattgagatggcttctttattttttgtcttttgggaattaaaggaacctggttcaacaagggcctacacctaagtctcttgttgtaccagagtacaatttaggactgctcctgaggaaggaattagctagaaatctagagagtaagggtaacagatttacatagaataacagcctcagtatttttggttcctctccagtaaagatcacaaagaatattgctaaatcgctaaaacacctttgcaataacgtaagggcttacaactatataccaatgtagctcagttactaaactggagtaaactaatttctcttgtgtagaaaaattggttggctgtggttttatagcagatctgcaattattaatagttatgccaataatcgtttaacagtgcatatgttaatatatatggaaagacaatgtgtatagacagatgtgtaaaattgaaaaataaacatataacaagagagaaacatctatcgaacagacaatatacatacacatcaaacacaacagcagttttagtgaccataatatttatttctcatttttacattgcttactttagtgacaactgaaaatgacagttggcaatgcagctaacagtttcaataaaagtataaaac

SEQ ID NO: 77480 - DNA, 1655 bp, Homo sapiens
ctttagtagaaggataacatgacatagcaggaataatactgccttttctttctggcatggatcaagagaaaagaaaatacaagaaaacagacagaagcaaggcaaggtacttctatggaagggtgagccctcacagatggagcaatggggcgcgcacacctgaacaagggaggggaaggagttcttatccctgatgcatgtgacccctgctgctgtgtccttcccctattggctaaggcttctgacagctttggagattgtgacattggaataaaggaaaaacgtacaggactcatgaagcgctgaaatgttcacaaatatcaagcaaaagtcaatgaaatttattttgagctatttacatcatttaataattgagcaaggtatactcctatgaacaaaatttggagcatgtttgtctctctctgcctggcgtcttcagaatttggaaactagttagtcatggaaatttattttgagctatttacagcatttaataattgagcaaggtatactcctatgaacaaaatttggagcatgtttgtctctctctgtctgcctggcatctacagaatttggaaactagttgatgcaattggagaaactggttgttttaccaaggctttgactggaaggatatgcttccctttaagaaaccaagctcaacttacagagctgataaaacccctttgggaaaactggcctcataccttgtctacacagtccccatgcagggttcctaacgtgtgtcgttcccagatttcctaaactttccagagaaaatggtcttctccctggctcagcaagaagatgaactttaaacactgagaaactggtcatctccctggctcaaccagaagatgaactttaaacactactctcaatgacttgatgttcccatcactactcctgtcataaagggaggggactcagatattgagaattttatgatagtgtgaactgtctggtatgtcatttaagtaagcccgttgctgaaatattttccatgttattagaaagagctgaagagagggattgagatggcttctttattttttgtcttttgggaattaaaggaacctggttcaacaagggcctacacctaagtctcttgttgtaccagagtacaatttaggactgctcctgaggaaggaattagctagaaatctagagagtaagggtaacagatttacatagaataacagcctcagtatttttggttcctctccagtaaagatcacaaagaatattgctaaatcgctaaaacacctttgcaataacgtaagggcttacaactatataccaatgtagctcagttactaaactggagtaaactaatttctcttgtgtagaaaaattggttggctgtggttttatagcagatctgcaattattaatagttatgccaataatcgtttaacagtgcatatgttaatatatatggaaagacaatgtgtatagacagatgtgtaaaattgaaaaataaacatataacaagagagaaacatctatcgaacagacaatatacatacacatcaaacacaacagcagttttagtgaccataatatttatttctcatttttacattgcttactttagtgacaactgaaaatgacagttggcaatgcagctaacagtttcaataaaagtataaaac

SEQ ID NO: 77481 - DNA, 1648 bp, Homo sapiens
ctttagtagaaggataacatgacatagcaggaataatactgccttttctttctggcatggatcaagagaaaagaaaatacaagaaaacagacagaagcaaggcaaggtacttctatggaagggtgagccctcacagatggagcaatggggcgcgcacacctgaacaagggaggggaaggagttcttatccctgatgcatgtgacccctgctgctgtgtccttcccctattggctaaggcttctgacagctttggagattgtgacattggaataaaggaaaaacgtacaggactcatgaagcgctgaaatgttcacaaatatcaagcaaaagtcaatgaaatttattttgagctatttacatcatttaataattgagcaaggtatactcctatgaacaaaatttggagcatgtttgtctctctctgcctggcgtcttcagaatttggaaactagttaaaattgttgtcttattttcatcctctttaaaagatggtttataatcagctatagaattttaacacgtgctctcaaatgcaagtttctgataactttggagattgtgacattggaataaaggaagagctggaatgttcatgaatatcaagcaaaagtcatggaaatttattttgagctatttacagcatttaataattgagcaaggtatactcctatgaacaaaatttggagcatgtttgtctctctctgtctgcctggcatctacagaatttggaaactagtttcgttcccagatttcctaaactttccagagaaaatggtcttctccctggctcagcaagaagatgaactttaaacactgagaaactggtcatctccctggctcaaccagaagatgaactttaaacactactctcaatgacttgatgttcccatcactactcctgtcataaagggaggggactcagatattgagaattttatgatagtgtgaactgtctggtatgtcatttaagtaagcccgttgctgaaatattttccatgttattagaaagagctgaagagagggattgagatggcttctttattttttgtcttttgggaattaaaggaacctggttcaacaagggcctacacctaagtctcttgttgtaccagagtacaatttaggactgctcctgaggaaggaattagctagaaatctagagagtaagggtaacagatttacatagaataacagcctcagtatttttggttcctctccagtaaagatcacaaagaatattgctaaatcgctaaaacacctttgcaataacgtaagggcttacaactatataccaatgtagctcagttactaaactggagtaaactaatttctcttgtgtagaaaaattggttggctgtggttttatagcagatctgcaattattaatagttatgccaataatcgtttaacagtgcatatgttaatatatatggaaagacaatgtgtatagacagatgtgtaaaattgaaaaataaacatataacaagagagaaacatctatcgaacagacaatatacatacacatcaaacacaacagcagttttagtgaccataatatttatttctcatttttacattgcttactttagtgacaactgaaaatgacagttggcaatgcagctaacagtttcaataaaagtataaaac

SEQ ID NO: 77482 - DNA, 1614 bp, Homo sapiens
ctttagtagaaggataacatgacatagcaggaataatactgccttttctttctggcatggatcaagagaaaagaaaatacaagaaaacagacagaagcaaggcaaggtacttctatggaagggtgagccctcacagatggagcaatggggcgcgcacacctgaacaagggaggggaaggagttcttatccctgatgcatgtgacccctgctgctgtgtccttcccctattggctaaggcttctgacagctttggagattgtgacattggaataaaggaaaaacgtacaggactcatgaagcgctgaaatgttcacaaatatcaagcaaaagtcaatgaaatttattttgagctatttacatcatttaataattgagcaaggtatactcctatgaacaaaatttggagcatgtttgtctctctctgcctggcgtcttcagaatttggaaactagttatggtttataatcagctatagaattttaacacgtgctctcaaatgcaagtttctgataactttggagattgtgacattggaataaaggaagagctggaatgttcatgaatatcaagcaaaagtcatggaaatttattttgagctatttacagcatttaataattgagcaaggtatactcctatgaacaaaatttggagcatgtttgtctctctctgtctgcctggcatctacagaatttggaaactagtttcgttcccagatttcctaaactttccagagaaaatggtcttctccctggctcagcaagaagatgaactttaaacactgagaaactggtcatctccctggctcaaccagaagatgaactttaaacactactctcaatgacttgatgttcccatcactactcctgtcataaagggaggggactcagatattgagaattttatgatagtgtgaactgtctggtatgtcatttaagtaagcccgttgctgaaatattttccatgttattagaaagagctgaagagagggattgagatggcttctttattttttgtcttttgggaattaaaggaacctggttcaacaagggcctacacctaagtctcttgttgtaccagagtacaatttaggactgctcctgaggaaggaattagctagaaatctagagagtaagggtaacagatttacatagaataacagcctcagtatttttggttcctctccagtaaagatcacaaagaatattgctaaatcgctaaaacacctttgcaataacgtaagggcttacaactatataccaatgtagctcagttactaaactggagtaaactaatttctcttgtgtagaaaaattggttggctgtggttttatagcagatctgcaattattaatagttatgccaataatcgtttaacagtgcatatgttaatatatatggaaagacaatgtgtatagacagatgtgtaaaattgaaaaataaacatataacaagagagaaacatctatcgaacagacaatatacatacacatcaaacacaacagcagttttagtgaccataatatttatttctcatttttacattgcttactttagtgacaactgaaaatgacagttggcaatgcagctaacagtttcaataaaagtataaaac

SEQ ID NO: 77483 - DNA, 448 bp, Homo sapiens
tgatttgaagtaagctttccatgcttcacttagggtgggaaattttaaatatcagagctttctttgttagcagcatatagttatgcaatttatttaaatctgcagtgccaatctttttttgatgggtgtgcttagaccacacatttaagataattattaatatgttagaaccgaatatattttgatgattagtttttatgtgtcaatttgactgaattaagagatgcccagacaggtggttaaaacattatttctgggtatgtttgtgaggatgtttccagaaaaggctagcatttgaatcagcagactgagtaaagaagataaagataatacttgtcatgtgtacaggcatcatccaatctgctcaggacccaaatagaacaaaaaggtggaggaagagtgaattatgtctacctccttgagctgggacagccatcttttcatgccc

SEQ ID NO: 77484 - DNA, 713 bp, Homo sapiens
agctagtgaacttctgatagggtcttatttatgttgctcaaatgtttacataataacttgtgccaaaaatatagtgctcatgcttttcagttctcacccagaaatgtcctgtggcttctagttgtgtgcctgagatcagataataaaagaccatgccttgaattctctcagctaagtgtaaaggattccttcagagatttatttattccgagaatagagaccattctgatgatgtatacaaggaacaacctaaactgtgctgagccactgtttgaacaaaataactcacttaatgttaatttcaacacacaaaagaaaacagtctggcttattcacggatacagaccagtaggctccatcccattatggcttcagaacttcgtaaggattttgctgaatgaagaagatatgaatgtaattgtagtagactggagccggggtgctacaacttttatttataatagagcagttaaaaacaccagaaaagttgctgtgagtttgagtgtgcacattaaaaatcttttgaagcatggtgcatctcttgacaattttcatttcataggtgtgagcttaggggctcatatcagtggatttgttggaaagatatttcatggtcaacttggaagaataacaggtcttgaccctgctgggccaaggttctccagaaaaccaccatatagcagattagattacacggatgcaaagtttgtgga

SEQ ID NO: 77485 - DNA, 324 bp, Homo sapiens
actatcccagtactcagcttgactgacattttcttatttcagataataaaagaccatgccttgaattctctcagctaagtgtaaaggattccttcagagatttatttattccgagaatagagaccattctgatgatgtatacaaggaacaacctaaactgtgctgagccactgtttgaacaaaataactcacttaatgttaatttcaacacacaaaagaaaacagtctggcttattcacggatacagaccagtaggctccattacattcatatcttcttcattcagcaaaatccttacgaagttctgaagccataatgggatgt

SEQ ID NO: 77486 - DNA, 551 bp, Homo sapiens
aaggtgaaatttagtcaaagattggttctgaggttttctacccaggattaataattagtgttacattttctaaaccatctggttattttagagggaaacagggatagagcagtttcttcagtcctagatttaagtaatatctccattcttttggtttttatgttgtattgggtaagtgaggtatcaggaggcttggagcagaaacctatggatgctttagtctcccatggtttcagcaggaacttaaaatgacagaagttctacacttttgaatcaaaatcagtgtagtttttctgcttggtagcagcaggtaattattgacttgaaacctttgacttattcccttgtggcttatcagttcccgttttttgatggaaagtagcaaagaagtaattctaaagagtggtgtaaccaagtgattttcattttaagttaagttcttaaaatgtactttaccagtctggggtaacatggcaaagctccatctctacaaaaaaaaaaatatatatatatatatataaattatatatatatataatttatatatatat

SEQ ID NO: 77487 - DNA, 608 bp, Homo sapiens
aagaagtcataacagtttcctgagaacaataagtcatatacattgaagtctgtggataacttgagctttcctggtgtagaggaaaggggttgtagaaggttgttttcctctaaaatgcttgttatatgtggaagtggtatggaaaactctgctgtagatagtttggagtcttggctacttcataaaacatggaatgaaaaattcgtcttgaaaattactgataatggtaagtataactaggcattgcatgtttatttttaaaaagtcttattgctctaaaatatggaatactaatctatactccccatccaaagaatttgtttttggaaattcttacttatattctcctcttgccatcctgccatctctcttctctcccccgtttcccatccctgccaggtcgactcaccataagtagaaaaagtagaaaaatctcaccataagtagaaaaatctcttcattaaatcttatctgtaccatgctatcatccccatggttcttatatctgctacaaaatagctaatctaaaaaactaacttgtaccaatataatgtgttagtcctattttggttatcaatggctacataaaaacaaaacaaaacaccaaa

SEQ ID NO: 77488 - DNA, 290 bp, Homo sapiens
tggggttcctggagttggtgatacctggcctgagctttgaagaataagtgtgtgttagccaatgaagagagaacagggacatggaggccttaaaacaatatgttgtgcccaggagctacagattgaccatccctactctgaaaatccaaaattcaaaatgccccaaaatccaagtttttgagccccaatatgatgctcaaaaggaatactcactggagcactttggatttctgatttttggattagagatattcaactggagtgttattttgcatatattcccaaatcca

SEQ ID NO: 77489 - DNA, 221 bp, Homo sapiens
atttatgtttacaggtttattataggggatgttacaaaggacagataaagagatgtacagggcaccagagcctgcacatgttcagctatccagaagctctctgaacccagttcttttggatttttatggaacgttcattctgtaggcacaactaattaaaccacgggtcactggtgatcaacttaaccttcgcccttctcccctccctaaatgttgggggt

SEQ ID NO: 77490 - DNA, 472 bp, Homo sapiens
  misc_feature (236)..(236): n is a, c, g, or t
  misc_feature (265)..(265): n is a, c, g, or t
catctgtaacccactgttgtacatggtcaccatgtctccccaggtgtgttttctccttttgttgggtgtctatgggatggggtttgctggggccatggcccacacagcgtgcatgatgggtgtgaccttctgtgccaataaccttgtcaaccactacatgtgtgacatccttccccttcttgagtgtgcttgcaccagcacctatgtgaatgagcttgtagtgtttgttgttgtgngcattgatattggtgtgcccacagtcacnatcttcatttcctatgctctcattctctccagcatcttccacattgattccacggagggcaggtccaaagccttcagcacctgcagctcccacataattgcagtttctctgttctttgggtcaggagcattcatgtacctcaaacccttttctcttttagctatgaaccagggcaaggtgtcttccctattctataccactgtggtg

SEQ ID NO: 77491 - DNA, 503 bp, Homo sapiens
  misc_feature (461)..(461): n is a, c, g, or t
  misc_feature (475)..(475): n is a, c, g, or t
  misc_feature (492)..(492): n is a, c, g, or t
  misc_feature (502)..(502): n is a, c, g, or t
tatgctatgctgttgttgctgataattaaaattcactgagatttatttctgtatagagtgtgcattctagaaactaactaaaagtattacatatgcacaaaatacataaaagagttgcacaatgaatccaaagtgctgggattacaggcatgagccaccgtgcctgcctttcattgcctcttgaaaagagcttgtcttgtttatactgtagaaattccttgagctcataggcattgctcagggtcagatgacagttctgagacttcactgagttgctgggaacgaggggagaggctgccacggcccgacaaatgtccctgtgaggtgaagacttcctttgtctttcccttgaccccactatcctgctgtgggagagggcagcccccaccagccctggtttttccttctaggtctatcatctcatgaagaactgctgggagacagaggcgtcctttcggccnaaccttcgaggaancctcataccccattctnaagacagtcnt

SEQ ID NO: 77492 - DNA, 377 bp, Homo sapiens
agtagagacgaggtttcactatgttagccaggatggtcttgaccccctgacctcttgatccgcccgccttggcctcccaaagtgctgggattacaggcgtgagccagcatgcctggcctttttttttttttttttaacgaagttatttttctagagcattcatagtttgtttttatacagttaaggttctcatccatctggattttttggtaagtgtggggagaataaaatgaggagccgctgtttttttctccaaatggcatgtattgtcccaacacaatttattgaatcaataattcatctctcccatacgaatttaaactattgaactttcacatcaaatttggaactacaaagtaggttaacaaggtgagaac

SEQ ID NO: 77493 - DNA, 1056 bp, Homo sapiens
catactatcatgtgggctttttgttttattttaaagcatgtttttgttttctggcattataagataatggcatgcagatgtgtttttaatttcttgctcttcacaaattttatgcatgcacgagcgtgtacacacacagaattgttttcatagatgtaatccctaaagtgtcattgctgagtctatttgggggggctctatgtcttcacttctgaattaataacccattgcctgcccaatagattgcatgagtttggactttcacaagaattgttgtagttcatattggatggtgatctatttcaatacttagttttctcagactgaattttcttttctagtttgatagatgaaaaattgtggcttattgctatctttattacatttctttaattatgagtgaggctgagcatttttctacagttttgttggccatttttatgaccatctgttaatgcgtatttccatatttcctttcttgtttttgtttgtttgttttgcaggggttggggtgggcaacggcatgatttcgatcactgcaacctccacctccggggttcaagcaattctcctgcctcagcctccagggtagctaagattacaggtgtctgccaccaaatccagctaatttttgtattttcagtagaggcagggtttcatcatgttggccaagctggtctcaaacacctgaactcagcctcagcctcccaaagtgctgggattacaagcgtgagccaccgtacccagcctatatttccatgttttctgtttgaatactggttttttcttgttgacttccaagtactatttgtgttttaaagaaaaacaaatcaggcttttatcatgtgtagcagaagtttatttatttgtttatttgccaaattgtcatggtttttttttactgggtttgtgtgagttttttttcttaaggtagtatagatgttttacagttctgtgtaatcaaattggcattatttttctccatggcttagctcttttgtcttccaagatttgcagaaatacccatgttttcttctggcacatttattatttttc

SEQ ID NO: 77494 - DNA, 285 bp, Homo sapiens
ttatatggataactcattcacatacacacgtgtgcatgcacgcgcgcgcgcgtgtgtgtgtgtgtgtgtaaacttagaaagggccaagccataactgcaggctaaatttggctctcaaggggccaagttgtgacctctattttaaacaaagtacattattttggcaagagaaactagtttacaaggaaaacatgttgaaataggccctggatttatcttagttgtaatctttcctaatttgatctgagattttaagcatgaaatgagagttaaagaattgactag

SEQ ID NO: 77495 - DNA, 344 bp, Homo sapiens
ggaagccactgattttccctccagtatgatgatttactttaaaaatgaacccagagggacgggcatggtggcttatgcctctaatcccagcacttcaggaggctgaggcaggcagatcacctgaggtcaggagttcgagaccagcctggccaatatggtgaaacgcctgtctctactgaaaatataaaaattagccgggtgtggtggtgtgcacctgtagtcccagctactcaggaggctgaggcaggagactcacttgaaccctcgtggcggaggtcgcaatgagccgagattgcaccactgactccagcttgggcaacagagcaagactccgtctcaaaaaa

SEQ ID NO: 77496 - DNA, 273 bp, Homo sapiens
ttatcctccacacttgctataagtaacactccaattccaaaactagacaccattatactttatcataaaaaaaaaacagtgctggttatttgataaaatgtcccacgcactatgtagtgagaaaactaacactggctttttgtggcaaactggatgaatgtgctttaaaagtatcatcctttaaatgaatgcaaactcagggtagtaggaagacaaaaataatgcacaagatgttcctgggaaaggtagtttatatgctttgtaaaattcaag
